United States Patent 11,913,074 (METHODS FOR ASSESSING RISK OF DEVELOPING A VIRAL DISEASE USING A GENETIC TEST) - sequence listing, part 26

SEQ ID NO: 2633 - DNA, 83114 bp, Homo sapiens
  source 1..83114: mol_type = genomic DNA
tctgttttaaattttaatcttaatgcgtgaaaaagctaacacatcatctttgtagaaaactagaaattgagaaaacagtgtaggcaaaatcagtagtaaaataaagcctcccacaatcccaaggtccagagataatacagctcaagaattggtgcatttctctgccttcttccttttttttctctgtctctccatctgcatctgtatgtgtacaacctgttttctcttcttgctcttcacccacaaaagcaggcatccagccttttgagcatctcgcatatgattaagaacaaatccttcaaagacctgcctcacctaagcccatttctcagacccacctgcggtctactcaggcctccttgtcatccaccaagccctctctggcttcattggtactgccgcaggctgctgggcactagtatctcctggcgtctctgttgcacctgaggttccacggctggctggtgttccttcctggaatggagggagaacaatcacttggatttatttgagtcccagtagattggagaggtccactggccggctttgttagttgcagcaaatccaactcaaactgccatcagagaactccctgcctcctgcaagtgaaaggccccggggtgaaccaaggccaggatgctgaaacgctgtaaccagggtgctgttcctctctatcctacagcgttgccagggacttcttgcatggccagagcctactaggtagtggtaggtactcaggtttttgctgaatgaatgatgcagtgaataacggcagcagcaaactctggttctcacagcttaaccacctcagctaaaagggcttccagttggctggatgaggagaagatggaaccctcatccgtgatgttgagaatgtaaaatggtgcagttccttttttttttttttttgagacggggtcttgctctgttgtccaggctggagtgcagtggagcggtctcggctcactgcaacctctgcctcccaggttcaagcgattctcctgcctcagcctctgagtacctgggattacaggcccacaccatcatgcccagctaattttttgtatttgcagtagagacagggtttcaccacatgggccaggctggttttgaacttcctgacctcaagtgatccacctgcctcggcctcccaaactgctgggattactggcatgagccactgcgccaagccgggtggaagtatatgaagggtgaaattgaaaggtgtggagggtggaatggaaggatggtttaggtggagtgaaagaatgtgaagaatggaatggaaggttgcagaaggcagaatggaaggacatggaaggaccagagagtgaaaagtggaatgagaggatgttaagggtggcacggaagagcttgaaggatgtcatggaggggtgtgaagggtggaattgaagggtgtgaagggtgaaatgggaggttgcttagggtgaaatggaagatgtgaagagagaaacggaaggacatgtagtggactggaagagtgtcaagggtggaatataaggtgtgtaaggtggagtggaagaatatgaaggttgtaatggaatggcgtgaagaatggaatgaaatggtgtgaatgaataatggactggaagggtgtgaagggtgaaatggaattgtgtgatgcatgaatggaaggatgtgaggctagaatgaaagggtgtgtagggtgcaatgggagggttttcaaggtggaatggaagggtgtgaagggtgaaatggaattgtgtgatggatgattggaaggatgtgaggctagaatgaaagggtgtgtagggtgcaatgagagggttttcaaggtggaatggaagggtgtgtagagtgggatggaagagctttatgtaaggctgtggcattgagaaagtcacccaaacctacctatgcagcttaagtgggagtaggtagtggggaagtctcagtaaccaagagggtctcgggcagaaccatgcaaaggcttattggggaggagctgggtgtcagtgaggagtgcaggtgttaaaaatgctttagtaactgcagggtcctttgcatattgagaagatgtgaggctaaatccggagctcagacagcagaggcccaggtgtctctaggacaccttattattttttacctggtctacctgtacagaaatgaatatatcacaaaacagtgctggtcccagcccaggtgacccctgggggctctgtctgtcaggaattgagagagcttggctgactccatggcctcatcctggtgcaagctatgcctatgcccagcaacaagagctaacttcgtcccagcccagggacttcaggaccactagacatccctgacaggacagatactggaagatcccaagctacaacttcacactctgctcgacaccagagcgttccaggaaaaacctcatgagtccagggcctggagccagaatccaccaaaaaaaaaccctgaatggacaaaggctacctttagctcctgcttctgggacctgcccagagtacatacccctctcagaggtgagagaggcctcttctagggggatcttttctccggtgctatactttgataggtttccttcatccatttaggggtatttgcctctggaagaaagatacactgtctgagtcaataggaatcagagatttgagtctgccaggccaaagcctggatctggacaatggccagttgatcatgttggtgaccccctctatgaggaatcctaggacacacatggatgatagcagcagcagcagcagcagccaatcactggccaccgactgtgtgctgggaactgtgctcaacatttctgcagagatggtctcacttaattttcatgaccccctaaattaggcaccagtattttctccaatgttccaatgaggaaactgaggctgagaggtgaaggaatctaaaatctgccactaatactgactgctgggggccgggtgtggtggctcacatctgtaatcccagcactttgggaggctgaggtaggtggatcacctgaggtcaggagttcgagaccagtctggccaacatggcaaaaccccctctctactaagaatacaaaaattagccgggcatagtggcacatgcctgtaatcccagctacttgggaggctgaggcacgagaatcgcttgaacccaggaggcggaggttgcagtgagctgagatcacaccactgcacaccagcctgggtgatagactgagactctgtctcaaaaaaattagaatagaatagaatagaatagaatagaataaaacactgactgctggggttctaacccacatctctctgacccaagggtaagaggtatacctcccaatcccctcagctacccaccccaggcttgctcaccatcaaagactgtgccctgttagcctttcccaggccgcattctgggcctcaccctgcagcaaaacagacttgttccctttagaatgtgtacacagagcaagaggcaaaattcacaaaggccacttttagctcgaagtgttcatgcccagctgaggaaacaggctttggtggtggtggtggtggtggggtgtatgtgtcagtgggtgggtgggagagaaggaccttctgggaatctctgctgcctgggctatagctatttgttatcctggaaaccatggctgccgaattcctctcctgccaacttctaatttatatgcgtgccctggctgggagaagggaagtcaagccaggaatctcccctttccacaggtcctctacccaaacccacagttgatgggaaacctgcaagtgtattgcaacctctacactaggatgtgcctggataagcctagtcacctgctgaaggtgctgtggcacttctagcccaatgcagggtcagctgcctgccccaccctgagaggcttctgggagctcacatccaatgctgatcatccccgtgctccactcaatcccctgctggggttaggggtagcaatggttgctgagcaaggcagagaaggggaggctgagtaaagcctggggctccacggggcagacagtgggaagctaagaacctgtctgggcgctgtgaggtggcacctggcaggtgggattccacatgagctgtggctccaagcccccctaccctcccttcctgcccctatgcatgctccaggtcccatcaaacttcacttacaaagcacaaattcaaagatacaattattaagagtttcaaggcactgactgccacgcattaaaccccaagcatgggggcctactgccattgcacaggttgcacttccaggaagctggccctactcacaccctatcgcaggcccagtttagcctagctgggcactgattgcttcttcctggtcgttggtgaggttctacatcaaatgattagctttccacagtgggttttctcccactagagagaacttagcgcttccagcatctcagcttcattccagggcctagcagagctcaccactctggacattttcatcctcttccccgttttctttcacacacacagacctctgctctctacatatgatcttcctcagagagaatagatttggttacttttgttctgtcctcttctctttgtgccgctcctatagaacaaaaatcatcaaacagggccaggtgtggtggctcatgtctgtaatcccagcactttgggaggcggatgagggtggatcgcctgaggtcaggagttcgagaccagcctgaccaacatggtgaaaccccgtctctattcaaaatacaaaattagctgggcatgggggtgggcgcctgtaatcacggctacccgagaggctgaggcaggagaatcgctggaacttaagaggtggaggttgcagtgagccgagatggcaccattgcactccagtctgggcaacaagaacaaaagtctgtctcaaaaaaaaaaaaaaaaatcatcaaacagccaattcagcaacatcattcttctccttccattactctatccacccagaagctgacccacactaaatggttaagaactgtgaggataatccagcaattcccctgctgggtatatacccaaaagagttgaaaacaaggtttcaaagagatatctgtacacctatgttcatggcagcattactcacaatagccgaaaggtggaagcaacacacgtgtccatcaacagatgaacagataaccaaaatgtggcatagacatacaatgggatgttttccaacattaaaaggaaggaaattctggctgggtgaggtggctcccgcctgtaatcccagcactttgggaagccgaggcgggaggatcacctgaggtcaggagtttgagaccagcctggccaacatggtgaaaccccagctctactaaaaatacaaaaaaaaaaaaaaattagctgggcatgatggtcgacacctgtaatcccagctacttgggaggctgaggcaggagaatggcttgagcccgggtggtggaggttgcagtaagctgagactgcaccactgcactccagcctgggcaacaagagcaaaactccatctcaaaaaaaaaaaaaaaaaaaaaaaaattctgacacatgcaataccatggataaaccttgaacactttgtgataagtgaaagaagcaagcacaaaaggacaatgattgtatgattccacttatataaggtttctagagtggtcaaatttaaagagacagaaagtagaatagtggttcccaggggctgaaaggaggcaggaatggggaattattatttaatgggtacataatttcaattaaggaagatgaaaaaattctggagatggacagtggtgatcgttgcacgtcgaggtgaatgtgcttacacttaaaaatggttgtaatcataaactatattatagatatattcaactaaaataatgaaaaaataactgtgaggacattttgttctccctcaaactgtcttcaaataaattaaattaattaaattaaattaaattaaaggtcttcaaattaaggccttctaaaatcaaaagaaaacaaaaaccagccattaaagaatcaagaaattcagccgggcatggtggctcaagcctgtaactccaacactctgggaggccgaggtgggcagattgcttgagtccaggagttccagacgagcctgggcaacatggtgaaaccctgcctctactaaaactacaaaaattggctgggtgttgtggctcacgcctgtaatcccactgggaggccgaggcgggtagatcacgaggtcaggagatcgagtccatcctggctaacacagtgaaaccccgtctctattaaagatacaaaaaattatccaggcatggtggcacgtgcctgtagtcccagttactggaaactcaggaggctgaggcaggagaatcgcttgaactcgggaggcgggggttgtagtgagccgagattgcgccactgcaccccaacctgggcaacaaagcgagactccgtctcaaaaaagaaaaaaattagccagcggccaggcgcagtggctcacacctgtaatcccagcacttcgggaggcttaggtgggcggatcacaaggtcaggagttcgagaccagcctggccaacatggtgaaaccccatctctactaaaaatacaaaaattagccaggcgtggtggcgcacgcctgtaatcctagctactcaggaggctgaggcaggagaattgcttgaaccatggaggcggaggttgcggtgagctgacatcgtgtcattgcactccagcctgggggacagagcgagactcggtctcagaaaaaaaaaaaaattagctgggtatggtggtgtgcacctgtaatcccagctactgagatggctgaggcaggagaatcacttgaacctaggaggccgaggttgcagtgagctgagattgcgccactgcactccagcctgggtgaccgaacgagactctgtctcaaaagaaaaataaaaattaaaataaatttgttttgtagagacagagtcttgctatgttgcctaggctggccttgaactcctggcctcaagtgatcctccttcttggcttcttaaagtgtgagaattacaggcttgagccactgcacccagcatgagggaagctattgcaaaatatagaaagtcatgagactatttatgccctttgatactatcccttagtattgacttcaagacagtgatctaaaggataacgaaaagctctctgcagaaagacgtgtattgcagtactgcttattgtggcaaaaaattggaagcaaactcaatgtcagaacaagaggagaatagttaagtaaatgatatatctactgcaaggagtcatgcaggggaagattatcctgaaaactcttaagtagcttgagggatgcttgtgatgatctaaatcaaagtcaaaaaaacaaggtttaaaaccccatgtactaggatgataacaagatgaaaatgtgttcctgcagagaaagactggaatggaaagaggaaagacagaatttttgtattgtttggataatgagatcatggggtgacttctttctcatttgaccagaacttgtgcaccatggttatattagtttctgtgcaacaaggccaaaaaaatctaagtaatggacccagtggccattttcaggattaacaatactctgtgatggtctgattcatgcccacgcagacaaaggtccttacctaaccgcctagatggccccgcattgcctagcaactacctgcttaacagcagttgctaggaaaccaagaacacagcaggactcctgaccaatagcacagcgtccatactactgctagacttcccttcaagttctctccaacagtcatgctcctgtctagcctttcctcttcttctcctattctcctccttctcattcctacctgcctggggctaacctgtgagtagcactcaatggggtccccacaatcatacaacctgacacaacacaggtaatcacaggttccagaggaccttcttccttcccctgcttccttcttgctccaggactggggcctggaccagagtgtgtgcatggctcaaagtttaaatctgtagttatcccaccattgagacaagtattgctcatggcctctatcggattctagcacctggcaaatcctactccttgggagagtgactccttcaggaaaggcattaagctcagcccagggctcccaccatccatcagagtgcctggtggaagcattccatgattcttccgtttttctgagatggagtctcactcttgttgcctacactggagtacaatggcgtgatctcggctcactgcatgagccagcacgcccagctcattttgtttgtatttttagtagagatggggttttgctatgttggccaggccggtctcaaactcctgacttgaggtgattcatccgtctcagcctcccaaagtgttgagattacaggcgtgagtcacctcgcccagccaaatccatgattcttgaatgcattctttgacaggggtccctgttccaagtggcccactttaaagagaaagaaaacttcatgtagggtggattagtctgaacacagtgatcctggaagactccaattttccaccattgttgagaatgatccctgctgccctgcacttctcattcccatcatctccatgtgctgttcaaccgtcacatccattctgaggaagttgccatctatctctattcaaaaagatctttcttctattcttcttcttcttttttttttttaaatagagacagtgtctcactatgctgcccaggctggtctcaaactcctggactcaagcaattcattggcctcagcctcccaaagtgctaggattataggtaagcacccagccaattatttttatttagagacaggatcttgctctgtctccagggctggagtgcagtggcatgattatggctcactggagcctaggctcaagggacccttctgcctcagcctccagagtatctgggaatacaggcatgtaccacgatgcccggctaattaaaaaaactggtttttttttttgagatagaggctcgctctgttgcccaggctggagggcaatggcgtgatctcggctcactgcaacctgtgcctcccacgtacaagcaattctgctgcctcagcctcccgagtagctggggttacaggcacctgccatcatgcccagctaatttttgtatttttgtagagacagagtttcaccatgttggccaggctggtcttgaactcttaaactcttaacctcaggtgatccgtccgccttgacatcccaaagtgctaggattacaggcatgagccactgcatctggccaaaaaaatgaaaaaaaatttttttttttaagagacggggtcttgctatgttgcccaggctggtcttgaactcctggtctcaaactcctggtctcaatagatcttcaggccttcgcctctcaaagtgctgggattacagacatgggtgcgtatttcgtatctccttgccactagaatataaattgcttgagaatagatactctggcctctgttatcactggcacctacaacagcctcaggctcaaagaagctaagatttactgtctgcctagtgttgtgtaccagctcgcccagaacaacttcccactcatgagctcacctagtcaaacaaccgtttgacgcaagctttgctattcccttcttacacatctgaaaacctgtttcaagatcacacatctaatgggtggtagagccaagaatttgattcccagctcactgcctgtccctcagaattctagctgttgctattagaatccagatccaggccgggcacggtggctcacacttgtaatcccagcactttaggaggccgaggcgggcggatcacttgatgccaggagttcgagaccagcctggccaacatggtgaaaccccgtctctactaaaaatacaaaaatttatccgggtgtggtggtgggcgcctgtaatcccagctactcgggaggctgaggcaggagaatcgtttgaacccgggaggtggaggttgcagtgagtgcagtgagctgagattgcgccactgcactccagcctgggcgacagagcgagcctccgtctaaaaaaaaaaaagagaatctggatccaaagcggacatgcatgtgtgtctcccccatccccacacacttgtttgtgtctggcctttctcctactccaagactggctccacttcggggctcgctgccatggagacgactccagatttaggaatacatttcctaggcttccggcaactaacgtgaggacttgctgggatgagggacggggaggtctgcagaaggaggcggggcatgcgggggttgcggggcttagagggttggcggagcccctcctcgcgtaggtccttccttctttccctccctccctttctcttttctttttctttctctttctctttcttctttctttctctttcctttctctctttccttccttccttcctctttttcttcattccttcctcttcctctttctcttcctttttctttctctctcttctttcttctttctctctgttgaaaattgtttttgaccacacccagatcatactgatatttacagtatagtcctggctacaagggagcccagctgtaacttgtgaagtgggcctggtttagaaagtaacaatgaggtggtaactaatgacagtactagttgttatcaaaaattaacacctttaggtatttttgttttgggtttttgtggttttggtgcatccacaatgtcttcatagtctgcacttattccctttgcccacagaccaactgtggccattcgatctgaattctcactttcagggcaatctttctttaaatgttccacagagccatgaagttggcaaccactaccatcagcatagagtcctttgggattatcaggacaagatctagacaggtgccccatttctccacagacaaaacattctgcaaaaggacattcgccaagaggcgggtctactttagccttacacttggttatttcgtgatctgtggacccacacttgtaacatcttctagtgcccatatcttgattttcaagggcggcagggcaatccgcaattccacgaccaggttttctacaatggaaacacaccattgcatttttctttgccccttgtcttttaaatcttcttacttcccattgactgtcctcttggaggaagggttgtgtggagagtggaggtctgcatgtggtaaaggagatgggtgggtggggcgtgaaggacccgaaagacaaggccagtctcatgggtgtgtgacctgtgcggtcacacagagccctgagctcagcagggcctggcgcttgatttcatgttctgttgtcaccgtcttgacattcttatcatttttgaacgaggggccctgtgtttccattttgcactgggtcccacaactgctggagctggtcctacaggagggtgaaaattagcatataatgagcagtgaggacaaccaggagtccctttcattgccatcttggctttggtgggctttggccagcttctttaccgcatcttatcagtggagtctttgtgacctgcatcttgtgaagccagtcctgcccacctcctgtgtcacccccagcttagagatctgcatacagtaaaattactactagctttctcctgaggccctgcaagctaaagcttataccttgtgatacaggcgtgtcagattgccaccactttcctgctttataactaaagatgcttttgagtctaatacctggatagactgtgtccagcattaacctttttttcttctgttctcataaaaatctctcttattaaaaatctgtttggctttgtatttcagacaacagaagactagttttccagcctattcacttagattccaaatggcatctgatctcttatttttttctttcttatttttttaaagagacaaagtctatgttgcccgggctagtctcaaaagcctgagctcaagtgatcctcctgccttggcctcccaaagtgttaagattacatgcatgagccaccatgcttggctttgatctcttctttaaaactgggcttaagtattttatgaattatcactaggtgctatttgattttaaaaatatttgttatattcatcaggtgttcggacggttcaagtttatgtcttccaggctacaacagtttcagagaaaaataattagtccagtgttccagcctgtgccactgcagaaaagatggagtccctataagtcattcgatcaggtacgaagacatttctatgcctccagagcaggtagggatgatggcccctgttcagcatgaagcagtgacagaagatagatctctgtccttctacaacctcttaagattaaggacgagtatgtaatgtctgaggtggggataagataggaggttggcaggactggtttcacaaagactcctcgtataaaacaggatgtggtaaagaagccaaaacccatcaaaccaagatggtgatgaaagggacctccggttgtcctcgctgctcattatatgctaattttaatacattagcatactaaaagacattcccaccagcgccatgacagtttacgaacgccatggcagcatctggaagtttccctaagtagtctgaaagggggaagaaccttcagttccaggaattcccacccctttctctggaaaactcatgaataatccactccttgtttagcacacgatcaagaaataaccacaaaaatagccaaccagcagccagtcgggactgctgtgcctatggagtaggtaacttcttattcctttattttcattttttcttttttgtatttttttaattcttaaatttaagtaaaaaatttttaatttataggggttttctggtaaaaactggaaagcctgctagacaaattctaaaagagctgtgatactcctttattttctgaataaacttccttccactttactctgttggcttgctcttgtagatcttcctgtacaaagccaagaatccacgtggcctcccacgctgaaccccaattttggggctcaccctgtgacacagccagaggcaaatggttccatgtccctcctattcctctttgcgcctggatgggatccggagggctctaggcttggctgctgtggccaccagatgaggctctatgaggtctgcaggggtcttgccagctccagatggacattccctgagatgctgttaggccacctggactggggccccctgtggcatccctggcatggacacataatgcccagcaaaggcatcatcaaagttccattactttagtgctggaaggcaaaccagatggcaacttgtttgcagagaaagaaactgagacccaaagaagggtcagccaaagccaggactcaagggtcaagggctggtgttgatacttcagctgctgagtggcaggagtccctttttgctgcccttctcccagagttccataatgaggtgaggatgggtctccttcagggcttggtagagtccatctttgcacttccggtcccaggactggctcaagctgaacagcttccgcatctggctgggcctcgtgttctcagccagcaccctctcgtactgctcctggctcagcacctgtccatgcagtttgtccaagacaacctccaccgatgtcactcgggctatcagctgctctcgatactggtccacaaagtgcagcaactgcggggcatccagaggtgaaggtacggctggcaacgaacaaagaagggctccaaccacagcctccacctccaatccccaccttcagtgctttcctctctcatctctgcatccctcgcttccttctgcctccagaaatgcacctgtgtcctccctcatggcagcatctagcttggcattctgccagagtggggatcgggagtggggttcctgctgggcacattggaggctgtcagataaggaattctagggtctctgtggataggacaagggggtatggggagcgaccatgcaccgctctccagggcctgactctttgtgaggtttgcagtgatgagtcccttcctttctctcttcccttcccccagaaccagacagtaccccagaactgccaccgcctcctgtggtctctgagagctgttactgacctatgcgggctggagggatcagagtagttgcaggcatgagatctcctggaggaaaacagagatgaagatgcatctgaaacagtgctaagttattaacacacatggtacacctccaagctcccactcacttctgagattctttgatttagaaaaaagccacagacaaattctggtagaatctggagtaagagctggaagggtccttagaggttatttaggtgaatcccttccttatgcatatggggaaactgaggctcagaagctgtgatcatacagtaatagaagacatccaaatgagcgatagcaatttctcctataacatcccagacttggttttaatcccgtgttggcctgaattgtatccctggtgaactaaccaaaccccttgctagatagcttgaactatttagcacctccttgtctgagcagaaatctacttccttgttcttgtttagccttctagactggcaccaaccaaaggtgtacgttctggatttggatgtcagaatctagaatcaagatcaagcaatcttaggacatgggaataacaaattaattttaacagaaaaaacagacaacgacaaaaatgaagggacttaaaaattgctttgcaaaggagagaaaggggaagttcacagcagctcgcatgtacaaggcctgagagtctgagcaggctctaagttcagtgtgatctcacagttcagggaggtgggcacaggggagggagttcaggttgtggtaccaggagcaccgggtccatgtaggtggagaaaggagggtgtttacatgctctctgctgactggacagtccaggggtcaattctgactcattcccacactggagcatctactgagggaggtgactggatggcaaagaatttacaaaccaaaatagaagaggaatgatggaaggagctgagatgtctaacttgcataacaagagtcatcaggaatgctatgaccacagtctttgagaatctaaatggctttttagatttaaggggaaggagatagactttttctatgagttccaagggacagaattaagactgataagaggcagagattggcttaacatgaggaaaaagataacattgctacgatttgttaaggattactgcatgaggcatgtatagacatcgctttgtttaatctttccagcattcctacaaattagtcattatgatcctctttttacagacgagggactcaaatgaattaagtaattttcccaaggtcactcagcaagtaagtgccagagtgggatttgaatccaggtctgaagctggggctggttagttctccatctgtggttgcacccaagccaggattcagtaaagcccatcctctttccactacactgtgaagccagcttgttgcagctcagaggtagattcaccattttttgagagctgactagggatggttgtcctagaaggactgtttgggggtttgggttcttagattgttggtactagactaagagtccataaattttctctatcccagaaaatttattatttgatttcctcttgcctacctcaaaaatactgagcgatacaggggagagtatctgaaattgccaaatcggtttaacccatacgaccatatgactatctaggtcttattcttccacctcacacccaaactatcatgagaaacttagctaaaagctttgtgtatgtcgacatctgttaattcaagggcactgtgaagacaccattgtgcatgggagagaacataaattttagagggtcagattgagtcaagtttaaattctagtcataacaactgttatgtaacttgagaaagccacctacctcctacctcctgtgggctatttcttctcatcaataaactgtgatagtgcactctgcacccccccccctcccacatacacagactttcttccattgactttttctttttttttggattgcagtcttgctcttttgtccaggctggagtgcagtggtgcgatctcagctcactgcaacctccgcctcctgggttcaagcgattcttctgcctcagcctcctgagtagctgggactacaggcacgcgctaccacgcctggctaatttttgtacttttggtagagatggggtttcaccatattggccaggctggtcttgaactcctgaccttgtgatctgcctgcctcggcctcccaaagttctgggattacaggcgtgagccactgtgcccagctccttcattgattttctttctcctcccacctctgagttctctggaattgtcctggatttacctggtttcaccaaggcctcccacaccagagtctcatctttcttgtctttcacttgcagcctgatccctgatcccaagtggccaacgtagaactccgagaacagctggtcttctccagggcttcgatagcagagctccagttcctgaagaggcaaagagttgagttgccaccctgttcatcttgcatggaaggtctttccccacctgacaccttcttggccctgcttggctccataaggacactctgatgatccctgtactgaaatcaaccatcaccttcagacattgctcttttcccaattttccacagaaggatgaggacacaactgagtacctcacgggtaagtcagggcttgtccttaaacgtagtgctcataatcctaagccagatccttcttccttcacctcccccatcttgaatccaaaccctcatttctccagcccaaagcctgtcttcccaatggaccctaaactccacccactgtcgattgacaaaaatttatatccatcccctttcctaaatcccagctaagacagaactcttgattccccactgtcttccaaacatgctccctttccagtttccccaaactcagtaaaggataggaccatccactgagcatgcaggctccaaactcggaatcatgcttaagtccttccctacacaggcaatccagcaggtcctgttggctctgccttcaaaatcaaccctgaattcatatacttttctccatctccctcgctaccttcctagtcaagtgaccttcaactgtagcttgcagtattgcaacagccttttgtttttttctctttttcttttttgtttcttttttttttttttttaaagagagatggggtttttccatgttgcccaggctggacttgaactcctgggctcaagtgcctcagcctcctgagtagctgggactacaggcgtgcatcaccatactcattttttcatttttcatagagatgaggtctccctacatggcccaggttggtcttgagctactggcctcaagtgattctcccactatggcctcccaaagtgatggaattacaggcgaaagtcactgtacccaaccacaacagcattttttttttttttttttgagacagggtcttgctctgttgaccaggttggagtgcagtggcacgatctcggctcactgcaaactccacctcccaggttcaagcaattctcctgcctcagcctcctgagtatcagggtttacaggtgcccatcaccactcccggctaatttttttttttttttgagacggagtctcgctctgtcgcccaggctggagcacagtggcacaatcttggctcactgcaacctccgcctcccaggttcatgccattctcctacctcagcctcccaagtagctgggactacaggcacccaccaccacgctcggctaaagttttgtatttttggtagagatggggtttcactgtgttagccaggatggtctcgatctcctgaccttgtgatccgcccgcctcagcctcccaaagtgctgggattacaggcttgagccaccacacccggccctcccggctaatttttgtatttctagtagagactgggttttgccatcttggccaggctggtctggaactcctgatcttaggtgatctgcctgccttgaactcccatagtgctgcgattacaggagtgagccaccacacctggccttttttttttttttttttagacagagttttgctcttgtagcccacactggagtgcagggggggtgatcttggctcactgcaacctctgcctcccgggttcaagcaattctcctgcctcagcctcccgagtagctggcattacaggtgcctctcaccatgccccactaattttttgtatttttagtagagacaggttttcactatgttggtcaggatggtctcaaactcctgatctcaggtgatccacccgccttggtctcccaaagtgctgggattataggcgtgacccactgcgcctggcccataatggccttttgacttgtctctctgctttcactcttgcctgcttatcattcgttctcacccagcagccagaggcatctttatgaaagtaaatcaggtcttttttttttttttttttttttttttgagacagagtcttgctctatcacctaggctggagtgcagtggtgcactctcggctcactgcaacctctgcctcccaggttcaagtgattctcctgcctcagccccctgagtagctggcattacaggcatacaccaccacacccagctaatttttgtatttttagtagagacagggtttcaccatgttggccaggctggtctcgaactcctgacctcaagtgatctgcccacctcggtacccaaaatgctgggattacaggcgtgagccaccgcgcctggctgtaaatcaggtcttgtattagctgtttatgaccctcaaaagcttgccattgcacttagaacaaagtgcaaagtgcataccagggccaacagggcagatgaggcctggtaagaccctgcctctaatctgactcatcttttgctatactgacctcttttttgtcatctggaggcgtcaagcttgctcccacctctatgcctctgcacacattccttctgcctgaaatgttcttccacaaatctccgtgtggcctgaaccaacacccaatctaaagaaaatcttcgtttccttagatcttcctcaaatgtatgcaaccaaggcccaaatcctatagcagattctttcaaacaccctttactgagacaccccatggttccccataatatgtgttctgccactgcaatgattaataaagccagtatgttcaactacaggtttgttcctggtggtctggactgaaggacattgatgacctatagcccaaacacttcccagtgcccccaagtcaaaccccatcatccttcacatcctgcatgtgatcctccctcctccgaactttctttctcctagtcttggaagcattcccactttctctaaatcccactcactttctgttcaacctcgatttatcctgtccctgagaaagccctgagacctgccccacaggcattcattcccaggtaggacttctgttcgcagtgaagaggcagacactgggctgctcaccttggggagtatttccagcatccctgaaccagacccagacacagtgtaacgacagcccatataaagtggggtcagcgggggtggcttgtggattcgcacaaactggaatttcatttctagatcatctatggcctacagaacatagggaacaatgattaagggaggcttctgccccgtggaatgtggtttgaataggggggatggtgcatctgtgtgtttgtgtggacagagtggggctatatcacccctgcctccctccccccatgcactgctacagagacagcccgcacttggtctttgatgtcttcaggataggaatagggttattgttagggaagttagaatgaggaaaggctacagttttaggcatggaggactccaatcctttgattcctggacaggggccgtaagaaactgtccaaagatcagtgattgatcaatgaacctagcagggggataccttggagaggcaggagaccagtccaagactgagaggggacgaattgtttgcccacttcaaggttctcctgtacaagaggcccatccttggtcccagttgaagaccctctagggggctctctggctgcattttgtgtttaccgtcaacccaccgtggcccagcctttctggctcttagtgtcaccttccgaatggagcagtcacttgggatcaggtagaggtggaaggtgacttcctcaggatggacgcggtggtaaagcaacaccacagaggtgacgggaatgaagcgcagggcattatggatcattttcaggaggactcccaagggggagaagctggggttttccagaactatgtgatgcagctccaccctggctggcttctccaggagcatcccctcctctttaaagtgggccatttggaacagggatgtgtccacatggccccctgtaaaagaatggattgaagaggcacaggtttatttttatttatttattttgttgagacagagtttcgctcttgtcgcccaggctggagtgcaatggtacaatctcggctcactgcaacctccgcctcctgggttcaagcgattctcctgcctcagcctcccgagtagctgggattacaggcgcctgccaccatgcccagctaatttttgtatttttagtagagatggggtttaactatgttggccaggttggtcttgaactcctgacctcaggtgatccgcctgcctcggcctcccaaagtgctgggattacaggcgtgagccgctgcatccagcccaagaggcctagatttagtgttgttactgagtcaggatttgctggcactgtaggatcccagggcttaggctcaggtaccctcttgggggagcccagtgctatggtcttgaatgtctgtgtcctcctacaattcatatgttgaaattctaacccccaaggtgatggtattaagaggtgaagcttttatgggaggtgattaggtcatgggggtggaattctcatgaatgggattagtgcccttacaaaagagactcaagggagcttgcttgtcccttccaccctgtgaggacacagctagaaggctccatgtatgaggaatgggcctcaccaacacaccaaatctgctggcgccttgatcttggacttaccaggctccagaactgtgagaaacaaatttctgttatttacaagctacctagtttatggtattttgttatagcagcctgaacaggctaagacacccagcatggggaagagggcatttctaggcctggggcctttggaggctgtgggaaattgtgccaccaggtgggagcacttagcagtgctgaactcctaagtggagctcaaggatcacccttgagccaaacttatacgcaaacccagcccctggccctggagctgggaaagatatagaacctctagttgcctgtgctggtgtggattctctatgagagaccattgagtgatgctggaaggtttgactaggcaggtagagaacaaggaggaggaaggggcagtaggaacatagagtgaccaaggtgtttggccactcactattcaaactcttctttttaggaagagcctcctcctccagcactgtgtgggtcttggcaggaggcaagccaagccccccactcaggatgctactactccctggcagcaaggacacaggtgtgtgaccaagacttgactaagtggttgtctctaactgggacctcaagtctagaggggtgaaacagatgcagagagagagaattctggcagtagcagttgggtgaagagtccagtgagaggcaggtgtggtggtgcacactcataattccagctacttaggaggctgaggtgggcggatcacttgaacccagaagttcaaggttgcaatgagctatgagtgtgctgctgcattctagcctgggtgacagagtgagaccctgtctcaaaaacaaaaaacaaaaaacaaaaaacaaaataccagaaagaaagaaaaagagcccagtggctcctgggcaggagggtcctacagtagctgtctccgtattttctgccgcctgtctccgtattttcctgatgtgaccttggctctgcccttggtttctctgagtcattgggtcactatcttcccccccgcttagatttgttgcataaccttttgctaagtctatgagttagtcaataacctttcaatgtatcccttttctgcttaaatcagccagaattggtacctttgattgcagtctctgaccagcgccaggcaaggacattgaagttacaagagagcttgagggatgaatactggtaatgggagagacactggcctagggatcagaggtcccagctccatccctgcattgcctggtaactgctgcaatgcaagtggtttctgggcaacaaggcatccagcaagctggacaaagcccttagtcagatgtcaatcccagaagggtccatgaagaccattacttaagttttgtcatttaactgcgtttttgggatgaaaataaagtcacagtggtatctatcatctgaaaaaatgaggaagaattcacctatgaatcttaccaatcaaacaatacaactattctttttttatttttgacacggagtctagctctgtcaccgaggctggagtacagtggtgtgatcttggctcaccacagcctccgcctcctgggttgaagtgattctcatgcctcagcctcccgagtagctgggactacaggcatgcaccactgcgcctggctttttagtagagatggggtttcaccatgttggccaggctggtcttgaactcctgaccttaggtgatccacctgcctcggcctcccagaccgcgcctggccacagtataactattcttagcatgggacgcctgcattacagtctttctctgcggcaacaccttttcctatttttattgtagtccatgatactttgtctcttgtttcctgtgacagtttaacttgctgcaaggatgtcagaccatttaattaccacagtatatgatccctgctagtggatgcaccaccctgtgattcagcctgtttctcatttcagtgttgagtttgcttccaacttttcaccatgataaatagcacctgcaatgcacatattctgcagaaagcttctatttcccttgtgttattgccttgaaatcaatcagtaccaagggatgaggaaagcgtgtgagatggtatgacctccttcactccccagttgcttctccaagaggcgatgctggtttgcgttgccatcactggcactaaatggatggtctcatcctgacctccaaagcactggaatgtcttcacatgtcagttgagggagctgaaatcctgggaggaaagtgctttttccaaggccacacaaccagccatggtcctaggaccagatcccaggattctgaccacagtctggagcactaacagacgctcggtgccacttgaatttttgctgaattccagaaggtgctgggtgtctccaacttaccttcttgctagggtgaccaactgtccatgcttgcccaggaccgagagggctcctgggggtgcaggactgtcagtgttaagatgagctggtcaccccccttcttgcacatactgccctttccatagattgtggtagagtcacctcatccaaacctgacagtatatttgtgctgatagattggagagagaagggaagcaatggggaagactgtggtctgaaggagaagaaggttgagtgttgactggaggaagtctcactggcagaaagacctacgctgcctttggctggttgcaccagaaaaatttagaaaaagctatcatgaggtaggcatgtttctgtgggtctggggtccagggctttgcatctgcttattacacaaaagcttactgagtacggacaatgtgccagcccctgtggatgtagctgtgaacaggaaagacatgggcactgcaattccagagcttgtggcccaatggggaatacagacagcaaatagaacaatggctcaaagcatgacaagtgctccgccaatggaagcctgtcagctccttcctcctttcccagccgcatgcccggtgtttgccttgggacattgctgctcctgctgtccaggagcctggggactctccctcctttagatgctgcccttgggcctgtggcctgatgcctggccgtgcccttcctgctgagtgtgtgtggtcagcaccttccaggctcaggtgagctgttgaggggcacagtggctctcctactcaagcagggacagtgggacccacatcacatgaaggtagggcactagagggttgtctagcagagcagctaaatgatagggactgcctggctttgactcccagcaagggttcttaccaactgtgggactctgagcagattacttgccctctctgtgcatcatctgtaaagtggggctgataacagcatccccctcccggtgtcactgtgcagattgactgggtttgtgtctataaagccctggggataataaggaccacttgctcgtattacagataaaatgcagcttgaccaatctatccacctggctgtggtggttccttctgtttcttcctcaaacaactcggcccagtcctcttggtaactcttggggtctgggaagaaaaagctactaaattttttttttttttgagacagagtcttgctctgtcacccaggctggagtgcagtgcacgatcatgactcactgtagccttgaccttccaggctcaagtgctcctctcacctcagcctcctgagtagttggaactacaggtgcgcaccaccatgcctggctaattcttcaatatttttttgtggagatggggtctcactatgttgcccaggcttgtctcagactcctgggctcaagtcatcctcccgtttctgcctcccaaagtgttggaattacaggtgtgagccactgcacccagccactaaggtattttgaatatccattttgcttaatctgagttttgggactctatattgttatacgattcagtaagtgttggttccaggaagacaacagttttgaggcctgagggataccactgtggtttccagccatctcatctggttgaactcctgagtaggtgggcagggggagggagtgggaatggggcgagaccccactcaggtgtctgtgtgaagtgttcttgttcccacaggcagcacagagaggagcaagtgtgacaaaaatgagggaactcacttcctcttggagggagggttgtgtggagagcagaggtctgtgtgtgctgaaggagatgggtgggtgggggaacgaaggacccgaaggacaaggccagcttcatggatgtgtggcctgtgcagtcacacagggtcctgagctcagcagggcttggtgcttggtttcatgtttggtggtcttgacattcttaatcatttttgaatgaagagctccgcgctttcattttgtgctgggccctatgactgctggagctggtcctgcaggagggtgagaatgcccattgccacggtgatgaagctgagaggctgaaagcctcaagctctagctatagtgggagaaaactcaccatggaaagttaatgactcatcacccgttcagcgacgacagtgatgaagcaccagtgcccaagtcctaaatcagaccctgtgtcaggcagtgaggtcatcgtttccagggcaatgaacagctgcagcccagacagcaggcagcaagcatttctggaaggggccctgcccggccccagggattggtttcctggctggtcacagctagctaaaagcagcctctgtgcattttgcctcttgttctgtggcaggggtgtccaatcttttggcttccctgggtcacattggaagaagaagaattgtcttgggccacacatgtaaaatatactaacactaatgatagctggtgagctttaaaaaattcgcaagaaagtctcataatgttttaagaaagtttacgaattcacgttgggcttcatcgaaagccatcctgggccgcatgtggcccacaggccgcaggttgtacaagcttgtgtacggagtccaaagggagtaaatcctatctggccacaaggtgaggctcagaatttggtctagagaaggctagtgggacatgggcttgggcaggactggggaggggtaggggtgtagctcttagcctgggataaacaggacttgggatagaatcccaactctggaagagggtcttcacctctctcggcttcagtttcctcactggtacaccaagggaaaactgtagtgcctaatttcccggttcattatgaaaaaagagatgatattaatatatacggaactaccttgcatggttccaggcacaggatgctcagttattgttcacagttcttattggccaagttccagtgccacaaaggacagtgccacaagcacagtgaattcattcctattctgatttggctgtcagcctggcaggcttcagctagatgcctgtgcactcggagggtcacccaattccttggacaaatcccgtctcccaggcccacttgatgcacgcaggagactgagcagggcatggcctgggagtcctcacaatggggagggccagctcatccacctctgagagtggggaatgagggggcgctggagcaggacctgaaggcagactttgtcccctcgggccctggtggtacattctggctccagaccttagctgcatgaggtttctcctggaataccctggttagagcagggagtggtggtgcagccctgagcatcccaggttggggcaagccaagttcttttgctgctggtcatgggcagagctacgacagagctgagcccactgactctattagccaggcccctctcttcttgatagagtacctggggatccctggccacggtctcacttgtggaagaggcaggctggttgtggtagtggctgtgttcattactctatagattgcccggtgggaacaagtaacttgtcccagcttcttgtttcagccatcagtttcctctcctcaatctcttcctttctaaatggacctctacaattccagagctgtcttgcacctcttccctctattctgttttagtctgggaccttccctagggaatgcccatatgaccctgactgttcaaccaggtgccccagggatcctgaggcccccgggactctatttccctgccccatgctctcctcctggtgtgcagcttgaattgtttactgaacttttgtggcctcaacaaacaagactttcctggttctgggtactgagcagttccctgctttttatttttctcatttgatttttctctttctactagcttctaaataatttttcttatatatatgccttgattaccttaatatatgcatactgtaaagttaatacctttattttgaggtgatactaaaaatacattgaactactgggatgatactacaacatatcaactaacaaatgagaaattaaaaataaattctcatttacctctattcctgggaaataaagaaattaagacaagaaaaaatattaaaaacccatttaatatctagctaaactgtacaaatcataaaagtgcttataactgatgtaagctataacataaattgtttatcaaatcattttatcagcaattaaatgaagcttctattggagtcatgatttgacatggggacacatcagattcttctaacttgctcactaaattgacagacattggctgggcacagtggctcacacctataaccctttctttctggctgatgtcaaggctttccctcatactttcttattctgtagtttcacattaatgagactaatcttgattttttctctcccttctctctctctttcctgcattgcagttttggggattctcattctgagaagtctcatatgtctcaatacttccagaaatttgtttgcaattgtcttgttgaatattctatttttttcccttctatcttatctttctggaattccatttagatatatattaggacttatcatggtatcctacaagttacttgattgtttattcttttttttttttttttgagacagagtctcgctctgtggcccaggctggagtgcagtggtgcgatcttggctcactgcaagctccacctcctgggttcacgccattctcctgcctcagccttccgagtagctgggactacaggcgcctgccgccacgcccggctaatttttgtatttttagtagagacggggtttcactgtgttagccaggatggtcgcaatctcctgacctcgtgatccgccctcctcggcctcccaaagtcctgggatcacaggcgtgagccactgcgcccggccttgttttttcattttttttagtcaatttagtttccaactttgatttgtcatttttaatggttcattgctttttgctgatagttttaaggttacttttttttttttggtcatattatacacacttattttatgttctttttctgataatttcagcatctgaaggatttaagggactgattctggtatctgtcgtttctgctggctcttacttctggtgccttgtttcccctttgtgagatttttgactgttagctgatatttcttggaactctgtgggaagtctttggaggtgacataaaatcatactttgtgattactatcttctatgggaagcccctgtttcatggctccagctctcagatggcgtctgatgacactgtttcttctccctgcctgtaggagtagtgatggcttcctattgttgctagtccctgttgccccaacattcttcgttagttcacttagccttactttgtaaatggtcctgtctttgaaaagcttcttcaaaaatctcaactgagcatatcatctctttcctgctgggaccttgagtgatacagtctatataaatgacacttaataaaaactttcaagtaagtttaggcagatataattatgaggctgggagatgtgtttcaaaaagataagtccagagaagagtggaatgcaggaaaatcttagtccccatctccataaccccccctcggcccctctaaggaagccacaacaccctctcccaggagattatcattctacactccctttcaggcccataattaccaccaccttcctccctatccttccctgttgtttaccttggagagccacaaagtgagggaggtgcacagcttccacagctccaggctcagccttgatgtccagcagaggccctgccaccatccagctgtgctgtgggttgatctcacccaggaactggtcccacacacagaattcaatctcaacggtcaccgcttctctcatcacaaagcagagacccgtgttgggccagcggtaggagccagctacagggaagtgaactctgggaagaagagggagaggcagacacttactgcacgaactcactgagcacctgctggatgccagaccccatgcaggggcttgcggatacggtacagtggcttcaagcccagacttcggaatcagatggacttgcattttagtcctggctcttctgctcttgactgtggatccctgagcaagtcatttaaccttcctgtttttggtttcctcatctgtaagtaggagtaattatagctcccatctcctagttacgagaataagtgacttaatgcatgctcacagcttagtacacgcctgggagctgtgaactgtttctactatgttgatgatggcaatgatggtaatgatgaaataacaagtgttcgtatatgtaaggggcctatttagcaataattaataacaatatatgtgctaagattatctgtcttgtcttgtctgtctatctatctatctatctaatctatctaatctatctatctatctatctatctatctatctatctatctatctatctatctaatctatggaaatatggtctcactctgttgcccaggctggagcgcagtggcccgatcttggttcactgcagcctcgaaatccctggcttaggcaattcttccacctcagctccctgagtagctaggactacaggtacatgtcaccacgtccagctaatttttttggtaatttttgtagacacaaggttttgccatgttgtccaggctggccttgaactcctggactcaagtgatcctcctgcctcggtctcttaaagtgctgggattataggcatgagccactatgcctggccgtatgtgctaatattaatgctaaacccttagaattggaaacaacacttttatagagatcagaagtgattttcccaaggctcctcaggtgggttaatagtgggtcccgggatgccccagcttctgtaggtgtgagctgggagtgacgctgtctcctggttgagatgatgtctgtggcagtgtttggtgagtggtaacatgttatataagagatcatgagtatgactatagagaattactactagtgcgactgtaagccctgggagggcagggctgccatattcatcttagggtccccagctactagtacagtccttagctcattagtggctgttaataaaacaggagcatacagattaagagagttaagtgagatttaagaaatataacaaagaaaataaaatgagtggaccttgtttggatcctgataagaacacaccaactggccaggcgcggtggctcacgcctgtaatcccagcactttgggaggctgaggaaggtggatcgtctgaggtcaggagttcgagaccagcctgtccaatatggtgaaacccccatctctactaaaaatacaattttcatttttcacacgtggtggcatgtgactgtagtcccagctactagagaggctgaggctggagaatcgcttgaacctgggaggtggaggttgaggtaagccaagattgtgccattgcactccagcctgagtgacagagcaagactctgtctcaaaaccaaatcaaaccaaacccaaccaaaccacaacaccaactataagaacatgttttagacaattgagcaatttgaatatggattggggagtagatgaaatgaaagacttactgccagctttgtcagatgtgatattggcattgtagttatgttatggaagaaaaggtttttatttttgttttttgagatgcgtaatgaaatatttaagggtaaaatcacccgatgtcttggatttaaaatactgtaacaataacaaagagggggaaagtgaacagctgaaacgaatttggcaaaacagtggctgaagctgggtgatgggtacatggaagctccttgtactatttttgtatatgtttgaaaattttaagtttcataagaaaacatctttttccatatgaaaagcagacacccagtgtctcagccctgtctctgcctgttgtcttggcaagaggaggggacccagtggtgagtgtgagttgggggtagggggtggcgctgactgtctgtggggacccaggatgggcagtggggtgcgggaggccagcctgggaccagcagagccccctcactcaccggtacaagttcttttctttgtcaactacctcagtagccacaggccccgtggggccccagaagtcatcgtcagtccccaaaggcttcgtatgcaggtccccttgagaggcaggagaaggcacgcacaagagttccaccggtactacctctggggagctttcctctgaaacagcaaggcagcggtcagctccagattctcccgcctggcctcccctagcccctatggctgcactgtaaggggcccttcccaaggctggcctgcctggaccatggcagggagtgtgtctgcagcttctgctcctgctccatggctgcctgcctgctgtctggggagccccactccagtgcctccagcccagcctccgcccatctccccttccccactggaatagaagtgccactctccccagcatgcccaggtgggcaggttgagagagaacatggttcaaaagatgaaaggggccaggcaccgtggctcttgcctgcaatctcagcaattgggaagatcttgctcacgtccaggagtttgagattagcctgagcaacatgggaagccgccctctctacagaaaaaagaaaaatatcagccaggcatggtggtgagcatctgcagtcccagttctactcaggaggcggaggtgggaggattgtttgagctcagaaggtttaggctgcagtgagccatgaacatgccactgcactccagcctgaacactagagtgagactctgtttttttttttttttttttttttttagatggcagggcaaagatggagatgtgattcccaggccttagcagccaagaatggaagaggccggaccccggttcagggtttgatacatgccatagacgttctggagaggggaagcaccagccggtgggtctcggagagagggtaacggaaatccagccagttcctaggagtgggagctctctcgtgggggtagcaccctcttgggtaggaaacctgccccgtcccacatcaggggcagagggatggagggaatgacctcccacagctgacctcccccaacccctgtcacgatgctcccagccttgccccttcaaactacctgatccgagtctctgccgcttgagtgaggatgtgctattactcatctctcccgtatccaggccctcagtaggggtcatcacacttggtttcctggacaaagaattgttcattctgcctaagatcttggaggaagcgagggctgtccacatgacattcccactaaaaattcaactcctcctcgggtcgggtgcagtggctcatgtctgtaatcctcgcactttgggaggccgggatgggtggatagcttaagctcaggagttcgagaccagcttgggtaacatagtgagacctccccacctcatctctgccaaaaatacaaaaattagctgggcatggtggcatgcacctgtatcccagctacttggaaggctgaagtgggaggatcacttgagcccaggaggcagaggttgcagtgagctgagattgtgccactgcactccagtctgggtgacagagccagaccctgtctcaaacaaaacaaaacaaacaaaaaaactccatccgaatttgaactcaatcctgtggttcttctgtggtccctgtctctgtgagcagcctccatccacccatgcatccaggctagagctggggtgtcatcccaactccttcctcgcccaccctaagagctgatcaccttgacaacacctctcaaatagctcttctttctattgtcttctctccacctccatgacctccacctgagtcccaggccctggcctctgtggcccgcaccactgcagcatcctctgaaaggtctccctgcttctgctcgggtccctctgccgcccattttctacacagcagccaatcttgaaataggaacctgacccatcacttggctgctgcaaccctgtaatgtcgcttcattgcttctgggggaaaatggaaagtttttaacatagtccaaaagggcttgccagggcctctgtcaccctccaatgtcacctgggccactttttcctggctcactgacctctagtccatcggttctcaaactgtgcgcttaacaatcatctggaaggcttgttaagacacagattcagccgggcgcggtggctcacgcctggaatcccagcactctgggaggctgaggcgggcagatcacaaggtcaggagttcgagaccagcctggccaacatggtaaaaccccgtctctactaaaaatacaaaaattagctgggtgtggtggcatgcacctgtagtcccagctactctggaggctgaggcataagaatggtttgaacctgggaggcagaggttacagtgagccgagatcatgccattgcactccagcctgggtgacagagcgagactctgtctcaaaaaaaaaaaagacacagattcctgggccccaccccagagattctgattcagtgggtctggagtggggcctgagaatttgcagttctatcgagctcccagtgagggtgatgctcatgctgctggtccacggaccacagtttgagtagctgctcctgacgcctggcctcccattcctccaggaggctaaactcttttctctctcagagcctctacttctgcctggactccaccccttcttgggcccagccaacctgtcctgtctttcagacctcagcccagatcctcttgaccaggtcaaataggcccataggtgcactcacactgaccccaggtgcatttgcgcagacacttctgggataacctgtgcctgtctccctgctggactaagctcctggaggttgggttgtgtctttcttgttcactgctgtgtccttagatccccaaacagtgcccgacacatagtgggtctgcagggaatgtttgttcaatgaataaatggctcctcttaagcctaggagctgttttccttccatttcaggtgagccacagcagccaggaacctggggacagatgagcttcatggtcaggtggaaatgcacccaactgggagaatgtgggagctgcagcagattcctcggggaagggaagatggactttcctggccccggggcttgcccctcaagtcaggggtgtgtgtggtggtggtggtgagggtggtgggtgacggtgatggcgaggatggtctttttcccagggcacaggcgctctctctctctgtctttatctccctcttgtgatcatcgctttcattgttccaaaccttctctgttcttcatggaaggattcctggactagaggccatttggtatcatgctgtgctgggtccaggggattcgctggctcacccacccactgactttttcttgttcttttttttttctttttgagatgttgtcttgctctgtcacccaggctggagtgcaatggcgtgatcctggttcactgcaacctctgtctcctgggttcatgtgattctcctgcctcagactcccaagtagctgagactacaggcgtgcgtcaccacacccagctaatttttgtatttttagtagagacagggtttcaccatgttggtcaggctggtcttgaactcctgacctcatgatccacctgcctcagcctcccaaagtgctgggattacaggcgtgagccaccatgcccggctttttttttttttttttttttttgagatgcagtcttgctctgccacccagactggagtgcagtagcgcgatcttggctcgctgcagcctccacctcctgggttcaagttattctcatgcctcagcctcttgagtagctgggaccacaggcacccgccaccacgcctggctaattttttagcccacttactttttcatgttttcctttccttgtttgtctaacgttaagagttgaagcaaggggggatttgattctacttgcactgacaagtgcacctcactctggctgctgtggtgtctgggtttctccctggctgtgtttgtctctcaccccatggctctttccctgtctcctgctcagccctgggcctgggtcagccagagggagttctgggtccccccttaccgtctgctgaagatgagcagctgaggtttctcctgctccagggccctcagttcctgcctcatctcatcactcagagttgtctggtccagcctgaaagcacaaagggagccgggtcctcctgggatcccccatgtggtccccaggtccccagggcccagaatcctgggacctgtcaccttctgaggcagcggccgcagggtgggttccctggaagccaggctctgaggaggagggtacagtgaggagattcattagggtgtgttcttgggtcaatgccagggcaagggaagggagggaatcggggagacgtgggctgtgaggcagtctccaatggaggcctcagccaactctgggagatgatcctttagagctgtttaaaggagttgggttgaggggctgggcctttctaccccaacattggccagtcatcggatgtgggcctccccaggaaggagatgtggccttgggtgaggtggctctcactggcagaggctgtctctacagccggctgccagggatttccccatggcctcaaaatgaccacctcaggcctgggtcctgggattttcttcccagtggtcggaagttttgctgggaagagagagtcctggttccatcctcccaggccttgtggtctggggtttctgccagatgtgagatgctgattgtcttctctgggtctctgtgtcctccatctaccacgtaggatgaatcaatcctgccctgcctgttctgaggcccagacaaggaggcggtgaaaagaccctgtcttctgcgaagggctctgcattcattcccctactgctgttagagctgttctgcccctggggaggagcgcagaccttgaagtagaaggttattcttctcaactaagtcccggctccaggagggaaggaggtggaaacctactcgggactctagagagcaaaccccctcagaagcagcccaggtttgacaggtaagtgttgagctggggcctgaagccatatctgcctgccatggccaagctctggggaaaggctcttcagcataagggaggtagtgatagccaaaaatactcagtggggagcagcaggctggggtgcaaaggtgctgcccccttgggatggagttcccatggttgtagatagccagtgtcagctacaggagaacccaaatgtagactatttatttctgttattctgccttgaccacttctttaggtttgggaggcctggctgaggaaagcccgaggcccaggcttcccggaccccctctgagaaggctctggatgtgggggtttggagcccctgtctgctccctgagatgtggcagggcccctggcaggagccgtgggtaagtgtcaagacagaagccactcatgggcttgctcccagggaggtggaggggagcagaagtggcccagagatagtgtgggggtggctcctcggggaagggcaagaatctctggggcctacgggatgggaaatgagggctgggggctcactccactcagggtccttcagttctccggggctcaagtgcctctttgttctgggcctttccccacaccatccctaggcctagaatactctccccaacttggcctgggtacctattcctccttcagacctcagcctgacgtcactgtctcagggaagtcctccctggccctttgatcaaatcccatcctccctcaatattacattctcataataccctgtactttcctttcactccacagagctcataaatatagacttgtgcatttacaggtgaccagtgtccgtctcttccccactagagtagaagcttcagtagggcagggcccatgtctgtttggtcactattgtaccccaaggcctggtctggtgcttacacacgggaggcactcagtgaatgaatgaatgagtaaatgaatgaatgaagcgctgccctggagtgaggggaacctgagcgtcccctagagcatgcagcctcagtaatagttatcatttgatcatgcccgactctcttcccagcactgtccttgtttttattttatttgtttaattaattaattaatttttgagactgagtctcactctgttgcccaggatggagtgcagtgctgtgatctaagctcactgcaacctctgcctcccaggctcaagtgattctccctgcaagtagctgggattacaggtgcacaccaccatgcccagctagtttttatatttttagtagagatggggtttcagcatgttggccaggctggtctctaactcctgacctcaagtgatccacccgcctcggcctcccaaagtgctgggattacaggcgtgagccaccacgccctgcctgtccttgtttttatatacattttatttcattacaatccatgaagtgggtatgatactcccattccacagatgaggaaacagagtcccagagaattcagcgacttgtccaagtcacacagtgtaagtggtagagctggtaagaaacttgggttggctatgcatttatcagtcctttttccatcccctgtccgatacccccccaaccctcttccctctgcccagaagggacccacagggccttaccccaggcgtatgagtttgcaggcaggatgcctgagcccctcacagagcagtcgcacgccaacgtcatccaggttgttctgctgcaggtctagctccttcaggctggggctggcactaagcacagaggccaggtcctggcagcagtcagacgtgaggccacagctgaccagcctgcaggaaagatacacgccagcccaggtcattgtcctaagggctcgctcttcagggtaactagggtctgatcttccttctcagcatctgtggccttttgagggtctgggatgacatgcagagaagatacaaactttcctggcttgcggtaacctgagagattttcactttcctcttgcagccacggaacccctcaggatgccagcacctaccctttctcaatcctgtgtgattcacactgatccagtcccctcactctgtccacattgatgagtaacttactcaatgtcccacttgtacacctgggtctatctgttttctctttttcttttttcttttgagacgagttctcactctgtgtcccaggcctcccaaagtactgggattacaggggtgagccaccgtgcccggccggtagggcctttttagagggcaaaattagcaacatatcgttttcccagcagttccatttttcggaagttaagctacagataatatgctgggtctcaggacgcactgggggatgttaactgctgccctgtttacagcaaacactggagacaatctggctgctcataataggcgatggataaaaacatgatggtaagtccatgtagtgaaattccatgctgtgattaaaaagaatgatgtgactttgtacgtacggatgtgggaccatctccaagatatattttaactgataaagcaaagtgcagggcagagtttgtgctgtgctaccatttatgccagaaaagggctatgtacctgctgtatgttgtatatatgtaggctctctctgggggttctcctgtctggggatcctctgctcttggggtctcagccctgcttctagaactgttggctctcccagctgggtctgctcagacccagctgcagtccaagcttgtaaatgtcacaaagcattccagggccttcgctaagagagggaacagggagaatggaaaaccaggctttgaggtcagacctggcttcaaatcctggtgcagctacttcctggctatgtggccttgggaaaataatgaatctctccgagatccaatcttgtcttctgtagatgtagcgaggattaaatctgacaagtgttaccgacttcctagccgaccagggatcgccgacccctgatactaggagaggatcctcgttgtctccccttcccatgcccccttcccatcaactcttgatcaggattactgaatggggaagcaggcaatagccttgggaagggcagaggtttggccttgggaagaaggaagggacgtgtgatgtgtgaacaaagatctcgcaaggtgtaaacaaggatatttcagggcttgggcagaaacaaaagaagaccctgaaggcagccccctgagcgggtgcacagaggggtgtgtataactttgtgcatcaagggaggaggcccagcaggaccagggagaggtaactatgcactcttgtttcttttcttttcttttttaagaaggagtctcgctctgttgcccaggctggagtgtaatgaggtgatttcagctcactgcaatgcctaccttctgtgttcaagcaattctcctgcctcaggctccctgagtagctgggattacaggtgcccaccatcacgcctggctactttgtgtagttttagtagagacaaggtttcaccatgttggctaggctggtctggaactcctgacctcaagtgatctgcctgcctcgacctcccaaagtgctgggatgacaggcatgagccagggcgcctcacttgtttctacatggtggcgggggggatggctctgtcccctcggatgagatagtaaatcgaactaagtggacaccagtgatttcagctctccatggcagaaccccatgccaagtaagaggacctgttactaggcagatcacagctcgtgggaacaggagaagaatagaaaaacactgctgcaatcctcatagctctatgaagtgggcacgattatcatcatcctctgtggtagtctgtgaaaatggccacaaattctgccccctgtccccaccttgcattcacgtcccttgactcgacttggcttctcttgctgtatttggagcctggaggccccctccctctgtccaagggtggatgagcttcctcctgagcctctactgcctggctgagatcctgtaggctcctcccactcccacaaagcaggtctcaccttctctctgctcttaccctctgcctgcctcatggtggcaggcagttccctccacctccccctgcccaccaagaacaattactgcagtcgctgtagcttgcagctcggctgtctcagtctctggcaaaggtgtttggctccagcatccgtgagcacattgaagctcaggtccagctcggtcagggtctggttggctctcagcccaaaggcaaggtccttgcagtcctcagctgtgaggccacagccagccaacctgtggaagacacacacccatggtcttcaggttactcacctgttgattcaacagacacccataagcaaccattaatcacctactatgcaccaggcctgtgggccaggcagaggtctagaaaaccctcccaggccccagaaatgcacatggtacttggggatagacatagaaacacataatagttagttttttgatcctttttgattaaaaccctccaatgttttcccacattactcagaatacaattcacggtccttttcctggtctacagggctctggggacttggatcctcatcatctctgtcctcatctctaatctcttttaggtccatagtcactgcccttctctctcttccttcctcaccccaggcacagttccacctaaggtctctgcacctgctgcttctgctgcttcttctgcctggaacaatcttctggtgctgacacctcatggggtgctcctccacttgcgtcaggtctttgctcagaaggaagtcgctttggtgacatcttgcctcgtctctccacttaaaattgcacacccatccccagactccctgctcctttctgctttacttttctctatagctcatgtcactcacaatatattttacttacttatttggcttcttgtcctccctcccaactagaatgtaagctccttgaggaaggaattttgcccatttccctccctccctccctccctctccttccttccttccttcctttcctctttctccttccttcctccctccctccctcctttctttctctctccttcctccctccctccttccctccctcccttccttctttctgtgagatggagtctcgctctttcacccaggctggagtgcagtggcgtgatctcggctcactgcaacctccgcgccctgggttcaagtgattctcctgcctcagcctcctgagtagctgggattacaggtgcctgccaccatgcccggctaatttttgtatttttagtaaagacggggtttcgccatgttggccaggctggtcttcaacccctgacctcaggtgatccacccacctcagcctcccaaagtgttaggattacaggcgtgagccaccgtgcccagccccattttcattactagtcatatcccagtgcccagagcagggtctagcatacagtaggtgcttagtaagtatgtagtaaataaatgaatgaaatagcctcaaaagaggggcaagtcaggtgcagctgaaggcagaggaatgagtgattgccaaggcagggtggaaacggtgaaacttaaatgagtgattcactgaggtgagggcggaggcaggggcacgcgtggctggtagggcagatgtgaaatcacagcacgcggttagtatagtgatgttagcgtaaaggctacccaggtagagagaaagtctgagggtaaagctagaaaatatcaagatagtagtaggtcttggatgtcattataagatgtttagacctatttccctgtggcagtgatgagcccatgaaagttcctgaggccagcagtgatgtggtctctgcattgctttagaaagatccctgagggaggttgtagtgagctgagatcatgccactgcactccagcctgggtgacagagcaggactccatctcaaataaaaaaaaaaaaaatgcaagatccctgaggaagtggaggtggctgggtggggaaaggcaggaggcaaggggtctgtgggggaggatgagcaactgtcagagcagcgacttcgggagatgtttggagcagaccctgtggcactcagtggagtccagggaggcctcaaggttggattcagagtagaagctgctgtcacttactgagaaagcagatgttagaagagtgtcagtttcattggtgtacaaccagggtggttgcacagggccccgtgctcagaaggacccggaactggcaggggtgtgagaaggacccttctagattgggggggttaatgctctgtggtggccatcttgaatttcttaataattttgtctttaaatttgtgttttgtaggtgaagtctgatgggaccatggagcctcagctcataggtgatgccatctcctgccacctccctccctccctctaggggaaatagttcttggtcatcctgcatttgagtgttgtggggcccccactcaacctcagcccagtgattattgccacgctttatctctggtgggggcctggatcaggcatgggtaggttggggtggggcatcttggggtagggcaggtggcagcctttctcgatttgggctggcagcatcatggcacatttggtgatttggtgggggcaaatctcccccaccactgatctagatacctaatgcatcctggcaataccctggagggtctcccatctgctttaggctggggtggtggcccatgggaaggagacatgtctggcttgacattttacccactctggggcatggtgcctggatctggtgacttgtgggagaggcaccctgcatctggtgcaccatgtgcacatgctgagctgtggagaggcctccgagcacctttgagggtctggacaaacactgctagtgtcccagtgcccaagggaatgcattgttaaatagcaaataaaatacactgtgataggttgagagagaaactatggaagaaagaaaaagctctgtatcgtagtacctttaacagcactttcatcctgacttttgagctaggacactgcattttcattttgtattgggtcctgaaaatgatgcagttggttctgagaggaggaacagtttgtttttagttagggaggatagtctaggtaagaataggctgaatttcaggagcctctgggacacctcagaggagggtgttgggtttgggtctggagctgcagatgcagggttggcagacactgtgggagcggccatctgatatgattatgggagcggctgtgtgtgagggggaaggaggctgaaggtggggcctggttatccttctggttggactcaaataccactctccatcctctccaaaaatctctgtctttccttgctctcataagacctacttttcccctttgtttttctctggcttccttctggactttcctatccagccaggaatttaaggtcagctgcattaaacacacatcctggcaaggtgtggtgactcctgcctgtaatccccacacttttggaggccgaggtgggaggatggctcgtatccaggagtttgaggctgcattgagtcatgatcacaccactgcactccagcttaggtgacagagcgaaaccccaattccccctgtctctcttacacacagacacacagacacacacacacacacacacagacacccacacagacacagacacccacacacagacacacacggatacacacacacatacacagacatacacagagacacacactttgacacacagacacacatacagacacacacacagacacacacacacagacacacagacacacacacacatacacacacagacacagacacagacacacacacagacacacacagacacacacacacgactcagtatgtggcattgtagagcacttggattttagagtgcaccaggccctcggtaacgtctccctggacaatcactgtcttccttctctgcttccaaccctgagctgcagagtgtggcccaagaaagtccagacgcagctggcagatgtggctctgtgctcactgcctgtggctggcatctcacagctgagggcctacttcccagatggctgtctcctgccagcccactctctccctgggtggtcggttctacccacctggcttatctgatttcctgcttgttgacaagctcattttcactaggcatgttcctgcccccaggactcatctcagcataaacaaatgtgcctctcttggggctttatttatttttaaacaacttaccattacaagctgtgctgtgtggacttccctcctccaatcctacccactcccaagccccagtgaagacacttggtattggacctctgtgaggaggctgaggccatctgaccttgggcagcagtgaccccagtgggcaggtgaagggcacaggctttggggctagacagagatggattcaaatcttgcctctgtcagttacaagttgaagactatggcagatgtctttaccaagtttcagttcactcatcagtatcatggatctgccatgtctattgtaccagctggctgcaagatccaaggagatcatgtatgccatgttcttagggaagcccctggcagaaggttagtgcttaaaggatgctgctgctgtggaaaccaaaaccctcaatgtccctccacctctccgtcctcagctgcctgtgtcatcacatagtcctttctcttctgttccagaggaggccaagggtccaccctcatgtgtcttcgattccacaccctctgtctggtctctcccctgaccttgctctttccggcattccttttttgagctctccaaccccactcccgccaatttctcctttgtctgcgtaatgtgctcaattttacaggccattagtgacaaaaccccagaattcctgacaccagcttattcaatgcatttcaagataaatccaaaagtgaaataagccagacatagaaagaaaaacactacatggtctcacttgtgggtgaaatattaaaaaagcaaaatacatacaaagaaagaataaatggtggttatcaggggcgaggagggggaggaaatgaggagatgtaggtaaataaaaaaagagaaatacaatagttaggactttgcttgcgggtcttgggtagtctggcatccaagcgtgtgtaaggctgtacactcttccatatggagatgtttttattgtgggaaatattcacatttgcctgatccagattttctttctttttatggtgctacccccagtgagccagaattaatcaggccccggcttacctgatacagaggaggtaggtgttggtgctgggtcttgccctcactgagttgtgtccagctctcccactgctaactatgtgaatttggcaagtcgttaatttctctgagcctcttaggacaacttaggcactaaatacatagcatacatgaccctaaatacacatcatacatgaacctaagtacatagcatacatggtcctaagtacatagcatacatgaccctaaatacatagcatacatgaccctaagtacatagcatacatgtcctaagtacacagcatacataaccctaaatacatagcacacatgaccctaagtacatagcatacatgatctcctttgactttgcagccaccttgtgcaacagacatggtgaatccatgttattaatgagtaaactgaaacttgctaaagaaacctacccatagttttcaatctgtaaccgttagaggcaagatttgaacctgtgtgtgtctggctccagggaatgtccttccccagcccatttctttatatatggaaaatggaaatagttgtccctgctctgccatttttgcagggtgttttttggaaggcccaaggaattaacagatatggagttgtttgggtttgagatagtgaaattttatgccaatgtaaaaagagtacattgaagattggtgtcttcctactggggtgtgaagtttgaggtagaaccaggattccttagtcctgctcaaaagcatttttactggactctggtggttctccttggataggtcttaggagtgggtagagcagcctcataaggatacagaaagtcacagcacgaggctgggcttgcctccttactctgcctgctcaacttctcccactgtaactcctttttaatgaacaatctcttgattgctttcctttcttacaatctcctttctttcaatctcttatcactttcttttcttcaatttccttggaatgtaggttagattccatgatccttcattggcagtatcctgaatttcttaccctctgaccttccatcacattcctctggctaaccctgaattctgctatctttccactctccacccaaactcccacctgtgcaacagggtaggtggctgccatcttgaatcatgaccacgaccctcacatgggccacagcaatgcctgactggcagagatctcacactctactatggccatttgaagatcttgccttttccaaacatccaacacctcaaccctcacactcactcctagcaaacaactcaattcctatttctcagagaaaaatgaagccatcagatgggaacctctcagcttctcagagtgaaacctatgttcctacctctctcttccctgtcctcatctcccctcctgttacagtaaaggagacatttcctccctcttccaaggccaatctttctcctccctcctccctctgaggatagagagccatcaatgactccttctccttcttgtgtcttttatcactcctcctcactgattctcaaactgagatcttttccttcttaaatgcaagtaagcagatggacagacacacacatttactcagcccaccatcccctctgctttagtgctttcctccttttcactatcaaagtctttgaagaaagtatatttgtggtctcattttttacctccttctccctctttaatgcactccagtctgcattctcgcctcttcatgccacataaggtacttctgctgaggttattcatgactttcctatcactaatccaatggacaaatttcagtccttatcttgacctcccagcagcagtagtccctgctgacctccttgagaccctctgctctgttgggttccatgacacctctctctcctggtgtccctttcatctatgtggcccctccttctcaggcttgtttgttggctcttctttggccattaaatactggggtgggggtgttccccaggcttgacatgcaatcttatttttgcccgtgaattttagaatcagcttgtccatttctgcaaaaatggcagctgggattctgctagggattgtgttgaatctatagatcagtttggggggtattgtcattttaataatatcaagtcttccaatctatgaacatgggacatcttttcatttgtttaggtcttacataatttctttcaaccattttttgtagttctctgtatacaagttttcttttgttaaatttattgttttcctaatttaatttttggattgttcattgctagtgtatagcagcacaactaatttttgtatattgatcttgtttcctgaaaccttgctgaaatcattagttttttttttttttctttttcaacagggtctccctttgtcacccaggttggagtgcagtggcacaatctcagctcactgctacctctgcctaccaggctgaagcgattctcccacctcagcctcctgagtagctgggactgtgggcgtgtgccaccacgcccggctaatattttgtagttttggtagagacagggttttgccgtgttgccctggctggtcttgaactccggaactcaagcaatccacccacctcagcctcccaaagtgctgggattacagggcatgagccaccacacctggccctaattttaatatttgtagattccttaggattttctacatacaatgtcatgtcacctgcaaataatagtttaattactttcttttcaatctggaagctgttaatttcattttcttgcttaattactctggatggaaccttgagtacagtgttgaatagaaatggcaagaacagacatctttgtcttattcctaatcttagggggaaagcactcagtcatccaccattaagtataatgttagctgtgggtttttttactggtaacaactttatcaggttgataaagttcccttttatttctagtttgctgagtgtttccaatgtgaaaaggtgttgagggtttgtcaaatgctttttttgtgtctttgagataatcattggtttgtgttctttattctattaacatcttgcattacattgatcaattatcctaggttaaacccaatttgcattcttgggataaatcccatttggtcatggtctacaatcctttttatatgttgccagtattttgttatgtaattttgcatatatattcataaaggatgttggcctgcagatttttttttttctcttgtgatgcttttggttatcttagtctaattttggtatcagggtaatattggtctcatagaacaaattggcacgtgttctcttttctgctatttttggaagagtttgaaaatataagtgttaattcttctttaaatatttggtagaattcactagtaaagccatctgggcctgggctttgtttcatagaaagtttttaacttactaattcaatatctctatttgttataagtctattaagattttgtatttcttattaagtcagtttaggtattcgtgtctttctggaagttggctcatttcatctgggttatctaatttgttggcttacaatatttcataatattcacttataatccttttatttctgtaagttcaattgtgataccccatcttttatttctgattttagtaatctgaatcttcttacattttagttagtctagctaaaaggtgtcaaattttgttggtatttttaaagaactaacttttagtttcattggttttctgtattgttttctattctctgtttcatttatctctactctagtctttattatttctttccccctgcttgcttttggttttgtttgctttttaaaaaaatttctttactaacatgaaagacctaaggaaaacaaattcttaaggtgtaagtttaggttacttatttgagatttctctgcttcttctttttcttcttcttcaatagactttattttttagagtagttttaggttcacagtaaaattgagcaaaaagtacagcgagttcccatatactccctgtccccacatccctcatacaatctttcccactgctgacatgctgtaccacactagtatattgtggtgacatttgttacaattgataaactgacatggacacatcatcacccaaagtccatagtttacattaggggtcactcttggtggtgtacattctatggattttgattgctgtaaaataatatgtatgaacgattacagtatatagaatagtttcactgccctaaaactctactgtgctctattaattcctcccttcccccaagccctggaaaccactaatcttttttactatctccttgtttttgcctcttccagaatgtcatatagttggaagcatacagcatgtagcctttttagattggcttcttttagtaacatgcatttaaagtttctccatatctttgtgtagcttgatagcttatttctttttagcattgaataatagtccattgtctgtttgtaccacaatttatgagtccattcactttctgaagggcagcttgcttccaagttttggcaatgatgaacaaagctgccataaacattcatgtgcaggtttttgtgtggacagaggtattcaactcattttggtaaatatcaaggaatgcgattgctggatcctatggtaaaagtatattttgttttgtagaaaactgctagactgtattccaaaggggctgtctcattttgcattcccaccaacaatgaatgagagttcctgtttttccacatcctcgtcagcatttggtgttgtcagtgttttggattttggccattctgataagtatgtagtggtatcttttctttttttcattaattaaaaaaattttgagtaatttttttagagataaggtctgtctctgttgcccagcttgaagtgcaatggcataatcacagctcactgcagtgttgaactcctgggctcaagtgagactcctgtctcagcctcctaagtagttatgacaacaggcacacatcatcattctcaactaattttttattttatgtttttgtagagacagagtctctctatgttgcccaggctggtctcaaactcctggcctaaggcaattgtcctgccttggccttccaaagatttgggattacaggcatgggccatcatgtctggctctatctttcctttttttttttttttttttttttttttttttaaatagaagtatttataactataaacttccctttaagcactgcattagctgcatccaatacattttggcatgttgtgattttgttttcatccctctcaaagtgttttctaatttcctttgtgatttcttctttgacccttggttatttaggagtgtgtttttaaatttcagtgtatttatgaactcctcaactttccttctattgttgatttctaatttcattttatcatggtcagagaatatactttgtatgatttcagtccttgcagatttgttgagatttgttttatggggcgatcttatctttggatagagctttatttgaaacctatttggcaggtccagttggataccttgaaaggatcttgaaaccagcaagcacgagatcacactcatgacattccaccccccaatcacttttcttttagtattccccatcttgatgaagatgccactatcccatgagttgctttggtcagaaacctaaaatcatccttgatatcttcctcttcctttttttcctaaattcaatccattactgagcccagttgattttacttttatagctctcttacatctagccactttgttccatatccattgccaataccatagtccaagctatgactatctgtgacatttaaaagtactataattttccttagtccaaactattaccatctttgcagggactactgcaattttcttactaattggtttcccagcctctacttttgcactcttccaatccatttttcatgttgcagccagtttctattttgaaaatgtactgatcttgtcaaccttctgcttaaaattccacaccatcaggaaaagacccaaatccaacatggtgcacaagcctggcatagtctacttcctgttggtatctgtagccttatctcaaccctttgctatctgccctccagccacactggcctgctttcagtttcttgactgcctcctcctgccttctccacagagcctttgtacatgctattctcttttcctggaactttttccttcctgctttgcttagttaaatcctctgtattcttcagacctccctcaaacctcacttcatgaaggaattttttttttttatgagcaaaaaatcctatctgtgtttgtttactaaagtcatcccggccagagaaggcctcaacgaatatttgataaatacaaagacaaatccctcagcccagactcagcttctgccttggatctcttccccatccctgcttcagaacagaacccaggccagactcaccgcagggtctccaggaggcagcgagggcgtctcagggtcttacaaagactcttcactgcagagtggctcagcgagtttccacttaggtccagctccttcaggtttctggtgaccttgaggacggagaagagaatctgccaataggcatctgtgactgggacccacctgaacctgagggggagagagaaggacaggagagatgtgatgtgtctggcaggggtttgaggtgcccagccctgcacaacacagttgggctttgtccccctgagcaccaggccacagcgggtagtgccatctccagtactgaccagccctccctgcctgtctgcccgtcacccagggctaggtccctctcctccatgtggctcctcattctacagcccttaccatagcacactgaagtgttcaccttgtgtgtctgtttctgcctcagtctgggagttccttgagggcagggacagacatttgtctttttttttttttttttaaatctgcactgctcagcatagggcctggcctcggtgctgagcactgcagataagaaaaaaattttttaaaaaaatttgacaattttaatttaaaaaaaatttgacagccttcctccctttgatgcagacacacctgtgttcctttggcacagacattctggagtcccagtgcccaggaaagaagacgggaggcagtagcagagcctgggagagatggcctgaggatgttgtgatggaagactgtatatgatcatatgcactgctgtccaggttggctcacatgggaccctatccccttcccaggataacaagagggtctgcaggagagggatggctgtggggagtgccctaggagagaatatttgcagcctgaggggaagagatgacgggctttgtctgagggtgttagagtagactccgactcatggaatttccacccatttaatctgttttcacacactactttagtgacctcatctacctccaaggcttcaactactcaaatctctattccaagtttcagactgagttttctattttctggttggatatccccaccttgacatcccagtaattctttgatctaatttgtcccaacaagtccccaacctgaattcatcttttcccctaagtctgcagagccatgtgggggcaagaagcagaggcaaggagctgcctgcatgtgggctctgcttctctatccctcactccgtctcctccgctgcaaaaagaggacagcaatagcacctgctgcagaggggtatgtgagaattaaaagctactaaagagtatcccaaaagtcctagagcagttttaagttttaataactgtgaaagtacaagtactacaaacatataaaaaaagccagctgagtgcagtggctctagcctgtaatcccagtacttgaggaggtagaggcaggaggatcgattgagcccaggagtttaagaccagcctgggcaacatagtaagatcctgtttctacaaaaaataaaaaaaattaggcaatgtggtggtgtgcacctgtagtcccagctactcaggaggctgaggcaggagaatggcttgaacctgggaggccaaggttgcagtgaggtatggtcatgccactgcactattcctgggagacacagtgagatcccatcacacacacacacacacacacacacacacacacacacacgaaaaaaagccataaatgaaagcttacttgaatttcttttacacttacttagttttgtgaaacttgaaaaatacattttaaattttttatttccgttggcatttgccatccttaatcaaggtgactgaaaaaaaattaaaaatttatacttgaaaatgcacaatgcttaatcacatgccaaacacctggaagctcccatcctgtcatcttcatttctttaatatctctggttggttctcctcttccttcacacagcccttggccaacctccaccctttcttcctgaactttcttgttttttttatagtagcttccttattcttctctctgccttgtctagctgattcagttccttgaaaatttctcctcccacttgtggctgaagcctctgactttcccacggcattctcttaaggctccacttgctcccgcccatcccaaactctcctctctggcctggtgttcttggttccctttgcctatcccagcccccatcccccggccagccaccatctggtctctgcctctagctgcttggaactctttgaagatttcccacctgtccactgctacttgcagtacctgtatccaggtcctttaaagcctacctcacatttataactatgaacaactagaagcagcttaaaatggccaagaacaggagaatggtcaaatcagccatggcactttccctatggaatagcatgtggtcattcaaaatggtgttgtatcagactacttaaaaatatataaagggctggcatggtggctcatgcctgtgatcccagcactttgggaggctgaggcagaaggatcatttgaggtcaggagttcaagaccaacctggccaacatggtgaaaccccgtttctactaagacgacaaaaaattagctgggtgtggtggtgcgtgcctgtaatcccagctactctggaggctgaggcatgagaattgcttgaacctgggaggcagaggttgcagtgagcagagatcgtgccaccgcatgccagcctggtgacagagcaagactctgtctgtctctgtctctgtctctctctctacacacacacacacacacacacacacacacacacacacacacacacatgaagggctgggcatggtggctcacatctgtgatcccagcactttgggaggtcaaggtgagcagcttgcttgagcccaggagtttgagaccagcttggtcaacacagtgaaatctcatctctatacaaaaaatatacaaaaattatcgctgcatgttggcatgctcctgtagtctcagctcctagcggggctgaggtaagaggatcccttaaactcgggtggtccaggctgcagtgagctgtgattgcaccactgcactccagcctaggggacagagcgagactccgtctcagacaacaacaaaccaaaaaaaaaaaaaaataccccacacccactcacaagaagatagccttgatatataaagaaaataaaactgactataaaataaaatgtacaatatggttcgatttcgccatagacatgtgcacagaaaaaagactggggttcttacaattgaccactaattttttttttttttgagactgagttttgctctttttcccaggctggagtgaagtggcacaatctcagctcactgcaacctctgcccctgacctgtcaagtgattctcctgcctcagcctcctgagtagctgggattacaggcgcctgacaccattttcggctaatttatgtatttttagtagagatggggtttcaccatgttgaccaggctggtctcgaactcctgacctcaggtgatccacctgcctcggcctcccaaagtgctgggattacaggtgtgagccaccacacccagccaatttttaatgatggttattacagaatgatggaattcttattgatactatttttcatctttttgcttatctacgttatcttttgtttgtttgttttttgagacggagtctggctctgttgcccaggttggagttcagtatcacgatctcagctcattgcaaactccgtctcccagattcaagtgattctcatgcctcagtctccctaatagctgggattacaggcgtgtgccaccatgcccagataatttttgtattttttggtagagatggggttttgccatgttggccaggctggtctcgaactcctggcctcaagtgatcctcctgcttcagcctcccaaagtactggaattacaggtgtgagctacttcacccagcctacatatctttttttttttcctataatgaacatgaattttattgtgagaaaaagttttaaaaatataaatatgaaggcccacatcaaacatttcttcctctgagaatctttattacccactcgtgtgatcactcccttccttgggccaccacagtaccttgtccatacctctactgttgtagacatcacactctgttgtcattaaatgaatgtttgtcttctcccctattttttgagctccttaaggcacgtattgtgctttttaatctgtgatctgtagggcctggcatagaatcagtgcttaataaatacttatggaatgaatcatctaaagcaggacatagacacataccaatagcatgtgatcgataccacgacagaggtcggggaaccgggatggggaagttctcagtactgccgggctggagaatggttggaggaagctattcttgcacagccagagagtgggtttcaggttgagtgcgtggggcaatggtggcaccacggtcacaaataattatgaagtcagttttgcagggaaaaataggaaactctttttgagagctgatggggaagatctcagggccaatgtcgttgtcatggaaagggttcctgaagcagctggaggagcaatttctccgagagaatgaatgcccagagagaggagcaggggtaggggggctgcctgatccttggggagtgtgggggtagctaaggtcagcaggaaggtgggagcacgtccaggagagaagatggacggtcattctaagggtaggaggagaggtggcagacacggcagggcccagtggcctctccagaagcaagcagggcctgccccacagccgggcactgcagaggagcttaggtagacagagcatggtggtcagattgggcagttagaagtcactggagaccctgatcctttagccacccccacccccggccaggctcagtgagcatgcctctggtgctcaggtcactcgggcttatggactgacagaggagctgcagacatgggtggtttgggtactcacaggactaccatggtggggctccatgttgatctgtgctgcctgccctcaatcagctgaagcttcttcacgtggcggctgaatttaatgcagaaagtgcacactaagagctccatgtctgtttctacacacatgcccatttcttcgaaatgggccatcacttgtgtcaggaacgttttgttccgagtctcgtacaagcagtggagggactccagagagtgtggctgcagcagcagctgcagggacgggacccactgcatcaggttcctcccctgagacagccggcagtgaaagatgttctccatctctctctccccctcatcacttaacaggcccaataggaaacgtgtggttgatgccccaaacaggccatgtattccatatgcttctagcgtcttttccaaatctatgatgcaattagaatgtttacctctccccttctcatcctccaagacataggacattgctgcaaagaactcttggaaacagaggtgaatgaagctgtagctcagagggatggggtgctcttgaagaatacccatcttcaagaaggtggagatgatggccccatctaacccatgcttcctgaggtcatctggactgaaaagggtctttttttgccagatgccctcagcagccagagagcagaggtctctgagctggggtcccaatggctgagcttggagagcctgggcaaggtaatgtagacagagggttgtggtggtcttggaagtcagtgtgagtttttccttccgcttcatctgctgcatcaggcaagtgcaggccagccaggacacccagggcacaagacacagggcccagagctctttgtttgatttgaccaacctaaaggctctaattgcttgcctttcatctgtgaaatatctgtagaaatattccttcctgctggactcagagaaccccaggacctctacccaacgtgcctgctccaaagaaggaatgaggttctgcagagctgtggtccgagccgtgatcaggaaggatgcctcgggaagtatagttttccccagcaaactgcccagcagtgcatccgccggctgtggctggctccagtgcagacagagctcagaactcggctcctgcaagacccatcctggctcatctacaccatcgaggatgaagagcagccgctctggcctagacaggatctgtctaatgggagccggagtggctgtcccatcttttccgatgagctcagcgagactcaccaccttggactgggccagctctctgcagctgaagtagaagacatgctggaagcggtccccatacagctggcctctcccccaggcttccttcacctgcctggccagtgttgacttcccaattccagcagccccctgcagtatgactatgcgaggttcttgggtatccaggcctgggccaaataagtctctgatctcaattaaatgtcctcgattctcctccacataatcaggccagcttctcttgaccaggggatcttggcttctggggtgaggtctttgtagaagtagcagctgtgtgaatttttggttaaaatcctcatttttccagggccatgtggaacagaggctctctctcacagaaggctcccatgggtggtggtggggctgtaggctggtgtgcgcctgtgggggcgttcctaccaccgctgcccatgggggcctgcctttctctgatttctctctctctctttctctgatttctaagtaagggagggaaagaaggaacataaaggtagagaatagaagaattaattaattaattaaacaactgttttaggcacctactccaagccacacactgcgctgtctgcagacactggtatgttcttgccatgcggcggaaggacatgtgctttggggtagaatatcccagttcaagtcttgactcaactaagtcacactccctgaatgactttccttcactgaatatttatcaagggcttactctgtgccaggtgctgctataggggttggggataaagagtgaacaaaacagacacaactctcagtcctcactaagcttatgatgctggccattagcccctatgagcctcagttttctcatctgtaagctgggggttgtaggtcatggaggactggaggagacactggagtgtgtagcagatgctgacagcatcccaagcacctgctattgcagtacctgccaatggtgtccctcggcaacagctgtggtcatctgtctgagggctctttctctgcctgtaagccgggtgggccagaaatactggaggatagttctccagtccaggaggtgcccttagtggatgacaggtggggtcccttgcccccaggacagataacactcaggcatgttctcaccgtctcccagacaaccgcagcagcatggagcctcagttgctcacaaggtaacctgttccataatctacctttcctgggtttccccgcctcaccattctctcttgttgatgagtccaagaaatcacctccccagtaagccacctgcaaccaaatccggtctcaggcttccgggcgagcccgacctgagactgatggaagatacctcatgacctgtgagaagctgaggttatatacaccattgtttcccagggagggacctcaggctcctatcttagtcagattccaaatagaacaacagttacaacctcttctgttcttttcttcacaatatgttcagtgcctctcccttctctccttaggtgaatttcattttattttatttatttttttgaggcagagtttctctcttgtcacccaggctggagtgcagtggcacgatctcggctcaccgcaacctccgcctcccagggtcaagcgattctcctgcctcagcccccagagtagctgggattataagtacccgccatcacgccagctaatttttgtatttttgtagagatggggtttcaccatgttggccatgctggtctcaaactcctgacctcacgtgatctgcccgcctcagcctcccaaagtgctgggattacaggcatgggccactgcacccagcctactatcttgtcttttactcaaacaagttttcctacctttgctcttgatagatcaaaaagcatgccatgtggttttttttttttttttttttttttttttgagacggagtctcgctctgtcgcccaggccggactgcggactgcagtggcgcaatctcagctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccatgtggtttttatacttgccatgaaactgttctttgggatattattttgttcaggttccccacttggacagcagagggggtgactctgcccatccctgccactggtagccaggcgggcaatgtctgctagcagtctgcttctgtctgaactcagccagcagaggcaaactcccggttccccgagaaacactctgaaggcagggtgggtgactccacccaccaccgcctctcctagccatgcaggccatgtctgctagagcttccagcgcagtggtcctaattctgtctgaatccggctgaggggtgcagcctcctgttactgcccagggaaacacccagatggcagggtgggtgactccaaccacctctgcctgtggtagccagatgggccacacctgctagagcttccagcccagcagtcccgctactctgtgggtgggtgccatcccctgttcctctgggaagcacccagacagctgattacgtgaccccacccacttctgcagatcctagctgagcaggacttgctggtttggacaatgcccaagcagggaagagccctcattctcttatcactgacagaggtgagatgtccgagtttgtaggctggtggaggagtgaggtggaggaggtatgcctctctctgcagggcggacccagcaaggatacggcctgtctgccaaccacggcccctgcctgaaggaaccccgtttaccagaacacccaacaaaagaaatgcaggtgtggagccagtaatcagaagggtcttgtctaaggcccaggagtggactaagtgagaaggtcacccccctgtccccaacacacacagaacactactgccaactgtactgaaacatgaagaaccacgcagcagagtaagagtgtatctcctggtgatcactcttaagcactgcctactggatggcggccccaaaatacaacaccaaaatgttttgcagtattcagtgccatgaaaactaaggcaaaggctcccaccagtgccctgccccagccaacacacacgcaccctgccatgccactgtggctggtgccatgtgtgagtgagcacagatcctgctggcactgccacaaggaagcactttggcctgcacccccactggactgttgaggccagcggactgggaacaccttggcccctctaatgcagcaggttctgaaccccaggaggccagaggaaaaggctggggacccagtaccagccttctagagttagagcaggcagctcaggagtgctgagctgagccttggccacctgaaatcttccagaatcgaagccagttgactgaacccaccttatacgacaatcaaacccccaagggcttcaaacaagataaaaacaaaacaaaaaaaaccccatccaaaggaagacaacttcaaagattaaaggaacatcagcccacacacacgagaaagaaccagctcaagagctctggtaactcaaaaagccacagtgtcttcctatctccagatgtgtgcactagtgcctcagcaatggtattttaacaggctgaaatggctgaaatgacagacatagaattcagaatatgagtaggaatgaagatcattgagattcaggagaaagtcaaaatccagtccaagcaatctaaggaatatgataaaatgatacaggagctgaaagacgaaatggtcattttaggaaagaaccaaactgatctgatagagctggaaatctcactacaagaatttcataatacaatagcaagtattaacaacaggatagaccaagctgaggaaagaatctcagagcctgaagactggttctccaaattaactcagtcagacaaaaataaaaaagaatgaaaacaaatgaacaacacctctgaggaatatgggattttggaaagagaccaaatctatgactcgctggcatccctgaaagagcatgagaaagccagcaacttggaaaacgtatttgaagatattgtccacaaaagtttccccaacctccctagagaagccaacatttaaattcaggaaatgcaaagaatccttgtgagatactatacaagacaatcatccctaaaacacatagttctcagattccccaagtcctcagattctccaaggccaacatgaaagaaaaaacaataaaggcagctagacacagaaggggcaggtcacctaaaaagggaacctcatcaggctaacagtgaacttttcagcagaagccctgcaaggcagaagagattgggggcctatattcagcatccttaaagaaaagaaattccagccaataatttcttttcttttttaaaattttaaaattattttttaaaaattttgtggatatgtagtaggtgtatgtatttatggggatccatgagatggtttgatacaagtaagcactgtaaaataagcacatcatggagaatggggtatgcagctcctcaaacatttaacctttgagttacaaacaatccaactatattctttgttattaaaaagtatacaattaatttattattgactatagtcaccctattgtgctatcaaacagtgggtcttattcattctttctatttttttgtacccactaactatccccacctttccctcttgccccccactacttttctcagcttctggtaaccatccttctgctctctatgtccatgagttcaattgatttgagttttagatcccacaaataagtgagaacatgtgatgtttgtcttcctgtgcctggcttatttcacataacgtaatctccagtttcatccatgtttgttgcaaatgactgggactcattctctttgatggctgaatagtatgtatatgcaccacgttttctatatctgttcatctgctgatggacacttgggttgcttccaatcttggctattataaacagtgctgccacaaacatagaagtgcatgtatctcttcgatattctgatttcctttcttttggatgtataccctgcagtgagattgctcaatttttagtgttttttttttttttttttttttagacagagtcttgctctgttgcccaggctggagtgcagtggcgcaatcttggctcactgcaagctccgcctcctgggttcacaccattctgctgcctcagcctcccgagtagctgggactacaggtgcccgccactgcacctggctaattttttgtgtttttagtagagatggggtttcactgtgttagccaggatggtctcaatctcctgacctcatgatctgcccacctcggcctcccaaagtgctgggattacaggcatgagccactgcgcccagccaatttttagttttttgaggaaactccaaactgttctccatagtggttgtactaatttacgttcccaccaacagtgtatgagagtttccttttctccacaccctcacaagaatttgttcttgcctgtcttttggataaaagccattttagctggggtgaggtgatattgcagttttcatttgcatttctctgactatcagtgatgttgaatgccttttcatatgcctgtttgccatttgtatatcttcttctgagaaacgtctattctaatcttttaactattttttgatcgaattttagattttttcctatagagtcatttgagctccttatatattctggttattaatcccttgtctgaagggtagtttgcaaatactttctcccattctgtgggttgtctcttcactttgtttattgtatccctcactgtgcagaagctttttaacttgacatgatcttgtttgtccatgtttgctttggttgcctatgcttgtgtgttattgctcaagaaatctttgcagaccaatgtcctggagattttccccaatgttttcttgtagtagcttcatagtttgaggtcttagatttaagtttttagtcaattttttgatgtgtttttgtctggttttggtattaaggtaatactggcctcagagaatgagtgtggtaatagtccttcctcctctattttttcggagtagtttcagtaggactgatactagttcttcttaaatgttgggtagaatttcagcagtgaagccatccagtccttggcttttcttcactgtaaggctttttattacggcttccatgttgttacttgttattggtctgtttaggttttggatttcttcctagttcagtcttggtaggctgtatgtatctagagatttgtccatttcttctagattttccaatttattggcatataattgctcatagcagccactaatgatcccttgaatttctgcagtatcagctgaaatgtttcctttttcatttctgattttatttatttagatcttctctctttttttcttagcttggctaaaggtttgtcgattttaacttttcaaaaaatcaactttttgtttcattgatcttttgtattttttctttttaatttcatttatttctgctctgatctttgttatttcttttcatctactaatagtgggtttggtttgttcctgcttttctctctttaagatgcatcattagattgtttatttgaagtttttcctcttttttgatataggcacttatagctataaacttctctcttaatatatcccataggttttggtatattgtgtttccatgatcatttgtttcaagaaatttttctttctttattttgttcttaatttcttcattgacccactggtcactcaggagcatattgtttaattttcatgtatttatgtagttttctaaattcctcttattattaatttctaattttattgcattgtggtcagagaagatgcttgatattatttcaattttttgaatgttttaagacttgttttgtgagctaatatatggtgtatccttgggaatgatccatgtgctgaggaaaagaatgtgtattctgcagctcttggatggaatgttctgtaaatatctattagatccatttggtctgtaatgcagattaagtttcatgtttctttgctgattttctgtctggaagatacgtccaatgctaaaagtggggtgttaaagtctccagctattattgtattgaggcctatctctctctttagctctaataatatttcctttacatatctgggtgttcctgtgttgggtgcatatatatttaaaattgttatatcctcttgctgaattgactccattatcattatatagtgaccttctttgtctctctttgtatagtttttgttttgaaatctattttgtctgatacaagtatagtgacttctgctcttttttgttttccactggcatgtaatatatttttccatcacttcattttctgtttatgtgtgtctttataggtgaaatgtgtttcttgtagggaacagatcattggttcttgttttttcattcattcagccagtctatgtcttttgattggatagtttaatccatttacattacttattattgataagtaaggacttactcttgccattttattatttgttttctgcttgttttgtgatcttctcttctttcttttattcctgtcttcctctagtgaagatgattttctctggtgatataatttggtttcttgatttttattttttgtgtatccattttatgttttttggtttgaggttaccatgaggcttgcaaataccatcttataatctattattttaatctgataacaacactatttggataaacaaataaacaaacaggcagaaagaaaactaataaaaacttaacttcatttcccagctttttaaactttttgttgtttctatttatatattattttactgactgtgtcttgaaaagttgttgtagttattatttttgattggttcatcatctagtctgtctacttagggtaagagaggttatacaccacagttacagtgtaaaaatattctgtgtttttcggtgtacttactattatgagtaagtttcttaccttcaggtgatgattgctcattaatgttcttctctttctgattgaagtactccttttagcatttcttgtaggatgggtttggtattgatgaaatccttcagcttttgtttgggaaaatctttatttctccttcatgtttgaaagatattttcaccagatatactatttagggtaaaagttttctttccttcagaactttaaatatgtcatgccactctctcctggcctgtaaggtttccatgaaaagtctgcggccagatgtattggaactccatagtatgttacttgtttcttttctcttgctgcttttaaaatcctttctttatccttgacctttgggagtttgattattaaatgccttgaggtagtctactttgggttaaatctactcggtgttctaaaaccttcttgtacttggatatctttccctaggtttgggaaattttctcttatccctttgaataaaacttctactcctatttctttcactacctcctccttaaggccaataactcttagatttgccattttgaggctattttctagatcctgcaggtgtgtttcattgttttttttattcttttttcttttgtcccttctgtgtattttcaattatagcctgtcttcaagctcactaattctttcttctgctggatccattctgctatgaaaggactctgatgcattcttcagtatgcaaattgaattttttcagctccagaatttctgtttgattatttttaattatttcaatctctttattacatttatctgctagaattctgaattccttctctgtgttatcttgagtttctttgaatttcctcaacacagctattttgaattctgtctgaaaggtcacatatctctctttctccagaattggtccctgatgccttatggtgaggtcatgttttcctggatggtgttaatgctagtagatgttcttcagtgtctgggcattgaagagttgagcatttattgtagtcttcactgtccaggcttatttataggcagcctttttggaaaggctttccagatttgaaaggacttgagttttgtgatctaaggcatttctgctttagagggcaccctaagcccagtaatgctgtggttcttgcacagtcatagaggtaccaccttaatagtcttagacaaaatctggttgaattatctaggttaccaggcagagactcttgttctctttccttactttctgccaaacatacagtctctgtctcttctaagccacctaaagccacctttaacctcattagaaagtgacacaagcacccccgtggccacctaccactatgactgtgctccaaccaagaatttcatatacagccaaactaagccttataagcgaaggagaaataagatccttttcagacaagcaaatgctaagggaatttattaccaccagacctgccttacaagaggttcttaagggagtgctaaatatggaaacaaaagaccatcactggccaccataaaacacactaaagtacacagtccactgatactatcaagcaactacaaaatcaagtctgcaaaataatcagctaacaacatgatgacaggattaaactcacacatatcgatattaatccaaatgtaaatgggctaaatgctcccattaaaaggcacagagtggcaagttcaataaagaagcatggcccaactggatactgtcttcaagagatccatctcacatgcaatgacattcataggctcaaagtaaagggatggggaaaaatctaccaagcaaatggaaaacaaacaaaagcacggattgccattctaatttcacacaaaacagacttcaaatcaacatcaatcaaaaaagacaaagaaaggcatcacataataataaagggttcaattcaacaagaagacttaactgtcaggaatatatatgcatccaatacaggagcacccagattcataagacgagttcttagagactgatgaagagacttagataaccatatagtaataatgggagacttcacccactgacagtattgaacagatcatcaaggcagaatactaacaaagatatttgggacctaaattcgacacttgaccaaatgggcctaagagacatctacagaactctccaccccaaacaacagaatatatattcttctcatttgcacatggcatatactgtaaaatcaaccacacaatctgccataaaaagttctcagcaaattttaaaaaacccaaatcataccagccacactcttggaccactgcacaattaaaaaaaatcaatactaagaagatagctcagaaccatacaattcatggaaattaaacaacctgctcctgagtggcttttgggtaaacaatgaaattaaggcagaaataaagaaattctttgaaaccaattagaacaaagatacaatatgccaattctctgggacacagataaagcagtggaaagtttatagcagtaaatgcccatatcaaaaagttagaaaaatctcaaattagcaacctaacatcacaaatagaagaattagaaaaacaagagcaagatcaatcccaaagctagcagaagacaagaaataaccaaaatcagagctgaactgaataaaattgagatggaaaaaaccatacaaaagatcaacaaaaccaaaagttcattctttggaagaataaataagatcgatagaccactagctagactaataaagaaaaaaaaaagacagaagatccaaataaacacaaccagaaatgacaaagaggacattaccattgaccccgtggaaatataaaaaaccctcagagactattacgaacacctctatatacagaaactagaaaaacctacaagaaataaattcctaggactgaaccaggaagaaattaaaactctgaacagagcaataacgagttctaaaattgaatcagtaataaaaattctaacaaccagaaaaaggccaggaccagagagattcacagctgaattctaccagacacataaagaagagctcgtacaatttctactgaaactattccaaaaaattgaggaggaggggactcctctctaactcattctatgagttaggtatcattctatgagtttggtatcattctgataccgaaacctggcagagacacaacaaaagaagaaaacttaaggacaatatctgtgatgaacatagctgcaaaaatcttcagcaaaatactagcaaactgaatccagcagcacgtcaaaaagcgaattcaccacaaccagataggttttatctctgggatgcatgtttgattcaacatatgcaaatcaataaatgtgatctatcacataaatagaagtaaaaaagcccccacatgatcatctcaatagatgcagaaaaagcatttgataaaattcaacatccttcaatgttaaaactctcaacaaactagacattgaaggagcatacctcaaaataataagggccatttatgacaaaaccacagccaacatcacactgaatgggcaaaagctggaagtattctccttgagaaccagaacaagacaaggatgctcattctcaccatctattcaacatagtactagaagtcctacccagagcaatcaggtaagagaaagaagtaaaagacatccaaataggaggagaggaagtcaaagtatctctgtttgcagatgttatgattttatacctagaaaacctcctagtctctgtcccaaatctgctagatctaataaacaacttcagcaaagtttcaggatacaaaatcaatttcttctattgggtagtaagtattatgtaacattgtgcaataagcaccaaatcaagaatgcaatcccattcacaatagccacaaaaaagtacctaggaatacatctaaccaggattgtgaaagatctctatagcaagaactacaaaacactgctgaaagaaatcagagatgatacacacacaaatggaaaacattccatgctcatgaataggaataatcaatattgttaaaatcgccatactactccaagcaatttacagattcaatgctattcctagcaagcaaccaatgacattcttcacataatgagaaagaaattctaaaattaatatggaaccaaaaaacagcccaaatagccaaagcaattctaagtaaaaaataacaaatctggaggcatcacattacctatttttaaactatactacaaggcaacagtaaccaaaacggcatgctactggtacaaaaacagacacatagaccaatggaacagaataaaatgcccagaaataaagctgtatatctacaaccatctgatctttgataatgttgacaaaaacaagcaatggggaaagcattccctattcaatacgtgatgctgagataactggctagccatatgcagaagactgaaactggaccccttcctgatactatatacaaagatcaatggaagatggatgaaagtcttaaacgtaaaacctagaactttaaaaacccttgaagaaaacttaggaaatactattctgaacataggtcctggcaaaaatttcatgaggaagatgccaaaaacaattgcaatgaaaacaaaaattgacaaatgggacctaattaaactagagaacttctgcacagcaaaagaaactacccacaaagtaaatagacaacccacagaatgggagaaaatatttgcaaactacccatctgacaaagttggaatatccagaatctataaggaacttaaacacattaataagccaaaaacaatcccattaaaaagtggacaaatggccaggcatggtggctcatgcctgtaatcctaccactttggggactgaggtggacagatcacttgaggtgaggaattcgagaccagcctggccaacagaccatctctactaaaaaatacaaaaattagctgggcgtagtggtgcacacctgtaatcccagctacttgggagggtgaggcaggagaatcccttgagcccgtgaggtggaggttgcaatgagcagagatctcaccactgcattccagcttggatgacagtgtgatactttgtctcagaaaaaaaaaaaaaaaaaagtggacaaaggacaccaatagactcttcaaaagaagacatacacatggccaacagcatatgaaaaaatgctcaacatcacttattattagcaaaatgcaaattggggtggttccaagatggccgaataggaacagctccggtctacaactcccagggtgagcagcgcagaagacaggtgatttctgtatttccaactgaggtaccaggttcatctcactggggcttgtcagacagtgggtgcaggacagtgggtgcagcccaccgagcataagccaaagcagggcgaggcattgcctcacctgggaagtgcaaggggtcagggaattccctttcctagccaagggaagctgtgacagatggcacctggaaaattgggtcactcccaccctaatactgcacttttccaacggtctttgcaaacggcacaccaggagattatatcccgtgcctggctcagagggtcctgtacccacggagcctcacttattgctagccagcagtctgagattgaacagcaaggcggcagtgaggcggggggaggggtgcccaccattgctgaggcttgagtaggtaaacaaagcagctgggaagcttgaactgggtggagcccaccgcagctcaaggaggcctgcctgcctctgtagactccacctctgggggcagggcatagccaaacaaaaggcagcagaaacctctgcagacttaaatgtccctgtttgacagctttgaagagagcagcggttctcccagcatggagtttgagatctgagaacagacagactgcctcctcaggtgggtccctgacccccgagtagcctaactgggaagcacccccaagtaggggcagactgacacctcacacagccgtctacctctctgagacgaagcttccagaggaaggatcaggcagcaacatttgctgtttagcaatattcgctgttcttcagcctctgctgctgatacccaggcaaacaaggtctggagtggacctccagcaaactccaacagacctgcagctgagggtcctgactgttagaaggaaaactaacaaacataaaggacatccacaccaaaaccccatctttatgtcaaagaccaaaggtagataaaaccacaaagatggggaaaaaactgaccagaaaagctgaaaattctaaaaatcagagcgcctctccccctccaaaggaacatagctcctcgccagcaatggaacaaagctggacggagaatgactttgatgagttgagagaagaaggcttcagaagatcaaacttctccgagctaaaggaggaagttcgaatccatcacaaagaagctaaaaaccttgaaaaaagattagacaaatggctaactaaaataaccagtgtagagaagtccttaaatgacctgatggagctgaaaaccatggcacgagaactacgtgaagaatgcacaagcttcagtagccaattcgatcaactggaagaaagggtatcagtgattgaagaccaaatgaatgaaatgaaggaagaagagaagtttagagaaaaaagagtaaaaagaaacgaacaaagcctccaagaaatatgggactatgtgaaaagaccaaatctacatctgattggtgtacctgaaagtgacggggagaatggaaccaagttggaaatcattctgcaggatattatccaggagaacttccccaacctagcaaggcaggccaacattcaaattcaggagctacagagaacaccacaaagatactccttaagaagagcaactccaagacacataattgtcagattcaccaaagctgaaatgaaggaaaaaatgttaagggcagccagagagaaaggtcgggttacccacaaagggaagcccatcagactaacagtggatctctcggcagaaactctacaagccagaagagagtgggggccaatattcaacattctttttttttttttttttttgagatggagtctcgctctgtcacccaggctggagtgcagtggcataacctcggctcactgcaagctccgcctcccaggttcatgccattctcctgccttagcctcctgagcagctgggactataggtgcccgccatcacgcccggctaattttttttgtattttttagtagagatggggtttcaccatgttagccaggacggtctcgatctcctgacctcatggtctgcccatctcggcctcccaaaatgctgggattacaggtgtgagccaccacgcctggcaatattcaactttcttaaagaaaagaattttcaacccagaatttcatatccagccaaactaagcttcataagtgaaggagaaataaaatcctttacagacaagcaaatgctgagagattttgtcaccaccaggcctgccctaaaagagttcctgaaggaagcactaaacatggaaaggaacaaccggtatcagccactgcaaaaacatgccaaactgtaaagaccaccaatgctaggaagaaactgcatcaactcatgagcaaaataaccagctaacatcataatgacaggatcaaattcacacataacaatattaaccttaaatgtaaatgggctaaatgctccgattaaaagacacagacagggaaatgggataaagagtcaagacccatcagtgtgctgtattcaggaaacccatctcacgtgcaaagacacacataggctcaaaataaagggatggaggaagatctaccaagcaaatggaaaacaaaaaaaggcaggggttgcaatcctagtctctgataaaacagactttaaaccaacaaagactaaaagagacaaagaaggccattacataatggtaaagggatcaattcaacaagaagagctaactatcctaaatatatatgcacccaatacaggatcacccagattcataaagcaagaccttagagacctacaaagagacttaagactcccacacaataataatgggagactttaacacccccctgtcaacattagacagatcaacgagacagaaagttaaaaaggatatccaggaattgaactcagctctgcaccaagggacctaatagacatctacagaactctccaccccaaatcaacagaatatatattcttctcagcacacattgcgcttattccaaaattgaccacatagttggaagtaaagcactcctcagcaaatgtaaaaggacagaaattataacaaactgtctctcagaccattcagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacatttaaagctgtgtgtagagggaaatttatagcactaaatgcccacaagagaaagcaggaaagatctaaaattgacaccctaacatcacaatagaaagaactagaaaagcaagagcaaacacattcaaaagctagcagaaggcaagaaataactaagatcagagcagaactgaaggagacagagacacaaaaaacctttcaaaaaatcaatgaatccaggagctggttttttgaaaagatcaacaaaattgatagaccgctagcaagacgaataaagaagaaaagagagaagaatcaaatagatgcaataagaaatgataaaggggatatcaccaccgatcctacagaaatacaaactaccatcagagaatactataaacacctctacacaaataaactagaaaatctagaagaaatggacacattcctggacacatacacccttccaagactaaaccaggaagaagttgaatccctgaatagaccaataacaggctctgaaattgaggcaataattaatagcctaccaatccagacggattcacagccaaattctaccagacgtacaaggaggagctggtaccattccttctgaaactattccaatcaatagaaaaagaaggaatcctccctaactcattttacgaggcaagcatcatcctgataccaaagcctggcagagacacaacaaaaaaaaaggaattttagaccaatatccctgatgaacattgatgcaaaaatcctcaataaaatactggcaaaccgaatccagcagcacatcaaaaagcttatccagcatgatcaagtgggcttcatccctgggatgctaaggctggttcaacatacgcaaatcaataaatgcaatccagcatataaacacaaccaaagacaaaaaccacatgattatctcaatagatgcagaaaaggcctttgaaaaaattcaacagccctacatgctaaaaaccctcaataaattaggtattgatgggatgtatctcaaaataataagagctatttatggcaaaccgacagccaatatcatactgaatgggcaaaaactgcaagcattccctttgaaaactggcacaagacagggatgccctctctcatcactcctattcaacatagtgttggaagttctggccagggcaatcaggcaggagaaagaaataaagcgtattcaattaggaaaagaggaagtcaaattgtccctgtttgcagatgacatgactgaatatttagaaaaccccatcgtctcagcccaaaatctccttaagctgataagcaacttcagcgaagtctcaggatacaaaatcaatgtgcaaaagtcacaagcattcttacacaccaataacagacagagaaccaaatcttgagtgaacttgcattcacaattgcttcaaagagaataaaatacctagcaatccaacttacaaaggatgtgaaggacctcttcaaggagaactacaaaccactgctcaatgaaataaaagaggacacaaacaaatggaagaacattccatgctcatggataggaagaatcaatatcatgaaaatggccatactgcccaaggtaatttatagatttaatgccatccccatcaagctaccaatgactttcttcacagaattggaaaaaacgacttaaaagttcatatggaaccaaaaaagagcccgcactgccaagacaatcctaagccaaaagaacaaagctggaggcatcatgctatctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggttagccatatgtagaaagctgaaactggatcccttccttacaccttatacaaaaattaattcaagatggattaaagacttaaatgtcagacctaaaaccataaaaaccctagaagaaaacctaggcaataccattcaggacataggcatgggcaaggacttcatgtctaaaacattcaaagcaatggcaacaaaagccaaaattgacatatgagatctaattaaactaaagagcttctgcacagcaaaagaaactaccatcagagtgaacaggcaacctacagaatgggacaaaatttttgcaatctactcatctaacaaagggctaatatccagaatctacaaagaactcaaacaaatttacaagaaaaaaacaaacaactccatcaaaaagtgggtgaaggatatgaacagacacttctcaaaagaagacatttatgtagccaacagacatatgaaaaaatgctcatcatcactggccattagagaaatgcaaatcaaaaccacaatgggataccatctcatacaagttagaatggtgaatattaaaaagtcaggaaacaacaggtgctggagaggatgtggagaaataggaacacttttacactgttggtgggactgtaaactggttcaaccattgtggaagacagtgtggcaattcctcaaggatctagaactagaaataccatttgacccagccatcccattactgggtatatacccaaaggattataaatcatgctgctataaagacacatgcacacgtatgtttattgtggcactatttacaatagcaaagacttggaaccaacccaaatgtccatcaatgatagactggattaagaaaaagtggcacatatacaccatggaatactatgcagccataaaaaaggatgagttcatgtcctttgtagggaaatggatgaagctggaaaccatcattctcagcaaactatcgcagggacaaacaaccaaacaccgcatgttctcactcataggtgggaaatgaacaatgagaacacctggacacaggaagggcaacatcacacaccagggcctgtcgtggggttggaggaggggggagggatagcattaggagatatacctaatgtaaatgatgagttaatgggtgcagcacaccagcatggcacatgcatacacatgtaacaaacctgcatgttgtgcacatgtaccctagaacttaaagtattaaaaaaaaaaaaaataagatcaccctccctgatgtgggtggctctcattccatcagttgaaggccagaatagaataaaaaaagagaccttctctggaaaaaaagaaaaatgcaaatcaaacccataatgaggtactattctacaccagtcagaatggctataatttaaaagtcaaaaaataacagatattggtgagattgcagagaaacaggaacacttatacactgctggtaagaatgtaaattagttcagccactgtggaaaggaatttcgcgatttgccaaagaactctgaactatcattcaatctagcaatcccattattgggtatatacccaaaggaatgtagagcattctaccataaagatgcatgtacatgtatgtttattgcagcactagtcacaatagcaccagtatggaatcaaccatactgctaaagaaaatgtgggacatttacacatggaatactacacagccataaaaatgaatgaggtcatgcctttgcagcaacttgaatggagttggagagcattataagtgaactaacacaggaacagacaatgaaataccgcatgttctcattcataagttagaggtaaacattgcgtacacatggacacataaaaggaacaatagacactgggaccttttgagagtgaagagtgggagaagggtaaggattaaaaaactaccgggccgggcgcggtggctcacacctgtaatcctagcactttgggtggctgaggtgggtggatcacctcggatcaggagttcgagaccagcctgactaacatggtgaaaccccatctctactaaaaatacaaaaaattagcagggcttcgtggcgggcacctgtagtcccagcgactcgggaggctgaggcaggagaatggcgtgaacccgggaggcagagcttgcagtgagtggagatcacgccactgcactccagcctgggtgaccgagcaagactctgtctcaaaacaaaacacaacaaaaaacaaaaaacaacaaacaaaaaacaaaaacaaaaacaaacaaaaaacccaacctaacaggtaccatgcttattacctgggcgacaagataatctgtacaccaaacacttgtgacacataacttacctatataacaaacctgcacatgtgtttctgaaactaaaataaaagtttgttgttgttttttttttaagttccctatttgaagaattcccttagaatttagaatcagggaaaaatgttatttcccttgcattggtcttttctattgagtaacaggtattgtgtaacccattatatttccccttttgccagtgttgctagaatgcccacaattgatggaaactttatttatagcaatgaggtagtctttgtggttttcatacttgtttttttcacttttaaagttactgcatttttatgcttctatagatggctctgatatgtctttatattcttcctatcttccttcttttctgtttttcagttttaattgtctttattgtttggattttttaattcacaaaataattctgagaaaaagttatctttgtgattctcaaatatagaaagaaacaacttaaagtattagaatcttcctttcttgactttctgttttccttagtttaactcgaatgttgatctttccttatataccctatcaagatttttaaaacatgagtttatttattttttattttagactcacgcggtatatgtgcaggtttgttacatggcttctttttttgaatggcaagtggtgtgagtaattaagtaaactgatatactttgagcctaggccatatacgaccacaaaatctacaagttcactccttgctgggtgcagaagaaatccttttaacttaaaacctctcagatttcaaaggaggcatcctccggcattgagaggcagcatggttcagtggttaaggaacctgtggcatcaggagcctctgtacctgtggctttagtatgactgtccttattgcccagatgagggcactccctgtgtaagagttaaaagtgtggattgctgcgtgagagagagtgaaggctgaattccatctttgctagtactaactgtgagactatctttttaatccttggttttctcatctccagggtatgataatagcaatatttatctcacggagtggttgtaaaatttaagtccaatgtacacgtaaagccctggacatggtctaacccagagagtgtccagtgagcactgatgggcatgggactagctgtaggccacttgtggggtgaggagctcagtggaaattgaacccagctctcctgaccccaggccagtgccctgtccagtaaaccaggtgatgtgtaaccccatccaggctcccctctccttgctctgttgtcccccagatgtgctgggtaacacatctgtattttaatgtccaggtgcctcctggaaacagtgccttggaccagtggagaggctccaagggtgggatttcctgagggaaatttcagatgttttccagaacctctgcttagcctgccaacctggtccccaggggactctttgtccatacatttgcctctcccacctcaccaccccgccaggagctcagtagggtctcacctgtgtagtaaattcctgacgtttcatccagaggccattgggtcccaggagcctcctgctctctgggtgctaggctgggctgaggtggggatccccagctccccagcactgctgtggatgtgggggcgttgggtgactcctggcttggagactcatggtctggggagcttggaagagcttggtagaggagtgaggcagagatttctggggggaatgaaaagaaaaataaccatttactgaacatttattttcttttaggtgcatatattttaaactctcacaacagtcctgagagatgggtcttaataatattattttgaaaaccatgttgaagtagaggggcaattttattctcttagtagtgaagagagaagtcatgtgagggagctggcttgggccgaggactaagcctagcctcttcttggggtctgtctggaaaacagagtcctccttggaacttctggaccaccctgaccctaaggatcttcagagcccatcaatattatgagctgagttctcgggcaaggaccatgtcacgagttgggcacccagttggggaagactcattgcctgacccacatgggtctcagcttccccatctgccacatggggagggatgcaatctcagcaccggaaggtccctgaaagatcaatttcaggcctacctctcacagcccatcctggctcccctatccttcctctgctgtcccccatgtcaggtccccatgcacagacatgatcctctgggtggggcccaccagctgattcacagctccacccagggctgtcagcctgcctcagcaagcctcacctctccagcggcgtccagatgtgtcaggcagctgtctcaaaacccttctctctgagccctgggtgcaccccgccggcaattcatggatccagggcattagcactgcggtggaggtgggttggctgggagaccccaggtggggttcacttgggctgtaggggaatgagggagagtggcctacaggaaagagacaaagaggttggagacacatcagaggggcaggggcaaggtgccagggaactgagctggtctcctctctcaaccaagagaggtcaggatacaccagtgaacccgctgcagccctctacaacttcctctagaggcttgtctgaagaatgatgttcttatagatactgctaggcaaaaaatcctcatctaggatcaggaaatttgcatatctgtcttggtcctgactatctccctgtgtaaatcactactcctactgagcctcagctgtgctttattgggccaacggcatctgcaacccagggtggctaatagtaataataacagcagcagcagcagcagcaacaacagcaatgggagatcttatttattgagcacttactgtatatcagactctgtgctaaatgtttaacctggatgatctcttttaaccctcacacagcccagggaggcgggctctcactctcccattttgcagacagagaaataggcagagagcagtgaagtgattggcccagggtgatagtgccaggactggtgatagtgcctgactcccaagtccgtgctcataactacaatgccaggcgagtaccgggaatgcacttgaatagaagagggtgtggggctctgaggtgcagcaagggcccccccagcaagcctcctggctccagcatagtctggggcctggatccccctttgagagggcagttccatgtcactgctcagaggaaggcctggcagggagggctcagtggtggggtcccaagagggcagggcaggcatgagggccaggggatgtcccgcgggcagtggggtcctctgtccactcacctgccccttcctgggcttgggcgcacagtgacctcagccccatctgctcccaggtatggagggctaggtcccaggcccgctgctccccatactgagccaccaggtacgaggccacctccatgccactcgtcttctctggctgagcgggtgtctcacccgaagagctcctggagtgcgctttattggcgagcagaagctggaactccttcagctcctccttcttcaggaactccaagtaacaggccaggcggccccaggctccgccagccatctctgtcccggagttaagagggtgtctgggggatgttcccaggtggtgagggtatcaggcaggcagagaacagtgctgtcctttgccttggctcttaccgtctcttattcagcattcggaacccagttttataaatcccagggcacctacagatagacgccgatagagggggagtggtaggaaaagccaggggagggaggagcccagaggggcctgcaagacactggaagaagtcagctgatagggaggtcctgggatggggtccagggccaggcagggagggtgagggtgaggggagatgtggtgacgggagatggggtgtgggcaacgctcactgttctgtgttcctcagattcttccctctcctgggtcctggactcctgagatcaacccttgagctgcaaggctgagaagaggtggggtgggaggagccgcagagcagggaatgggctttcagaacccagagtggagccccgggctgctggctcccaggtttcttcagacctctccaggccctggggcaccagccagcaagaacagcgcctagtcaacaag

SEQ ID NO: 2634 - DNA, 70395 bp, Homo sapiens
  source 1..70395: mol_type = genomic DNA
tggagtaggtaacttcttattcctttattttcattttttcttttttgtatttttttaattcttaaatttaagtaaaaaatttttaatttataggggttttctggtaaaaactggaaagcctgctagacaaattctaaaagagctgtgatactcctttattttctgaataaacttccttccactttactctgttggcttgctcttgtagatcttcctgtacaaagccaagaatccacgtggcctcccacgctgaaccccaattttggggctcaccctgtgacacagccagaggcaaatggttccatgtccctcctattcctctttgcgcctggatgggatccggagggctctaggcttggctgctgtggccaccagatgaggctctatgaggtctgcaggggtcttgccagctccagatggacattccctgagatgctgttaggccacctggactggggccccctgtggcatccctggcatggacacataatgcccagcaaaggcatcatcaaagttccattactttagtgctggaaggcaaaccagatggcaacttgtttgcagagaaagaaactgagacccaaagaagggtcagccaaagccaggactcaagggtcaagggctggtgttgatacttcagctgctgagtggcaggagtccctttttgctgcccttctcccagagttccataatgaggtgaggatgggtctccttcagggcttggtagagtccatctttgcacttccggtcccaggactggctcaagctgaacagcttccgcatctggctgggcctcgtgttctcagccagcaccctctcgtactgctcctggctcagcacctgtccatgcagtttgtccaagacaacctccaccgatgtcactcgggctatcagctgctctcgatactggtccacaaagtgcagcaactgcggggcatccagaggtgaaggtacggctggcaacgaacaaagaagggctccaaccacagcctccacctccaatccccaccttcagtgctttcctctctcatctctgcatccctcgcttccttctgcctccagaaatgcacctgtgtcctccctcatggcagcatctagcttggcattctgccagagtggggatcgggagtggggttcctgctgggcacattggaggctgtcagataaggaattctagggtctctgtggataggacaagggggtatggggagcgaccatgcaccgctctccagggcctgactctttgtgaggtttgcagtgatgagtcccttcctttctctcttcccttcccccagaaccagacagtaccccagaactgccaccgcctcctgtggtctctgagagctgttactgacctatgcgggctggagggatcagagtagttgcaggcatgagatctcctggaggaaaacagagatgaagatgcatctgaaacagtgctaagttattaacacacatggtacacctccaagctcccactcacttctgagattctttgatttagaaaaaagccacagacaaattctggtagaatctggagtaagagctggaagggtccttagaggttatttaggtgaatcccttccttatgcatatggggaaactgaggctcagaagctgtgatcatacagtaatagaagacatccaaatgagcgatagcaatttctcctataacatcccagacttggttttaatcccgtgttggcctgaattgtatccctggtgaactaaccaaaccccttgctagatagcttgaactatttagcacctccttgtctgagcagaaatctacttccttgttcttgtttagccttctagactggcaccaaccaaaggtgtacgttctggatttggatgtcagaatctagaatcaagatcaagcaatcttaggacatgggaataacaaattaattttaacagaaaaaacagacaacgacaaaaatgaagggacttaaaaattgctttgcaaaggagagaaaggggaagttcacagcagctcgcatgtacaaggcctgagagtctgagcaggctctaagttcagtgtgatctcacagttcagggaggtgggcacaggggagggagttcaggttgtggtaccaggagcaccgggtccatgtaggtggagaaaggagggtgtttacatgctctctgctgactggacagtccaggggtcaattctgactcattcccacactggagcatctactgagggaggtgactggatggcaaagaatttacaaaccaaaatagaagaggaatgatggaaggagctgagatgtctaacttgcataacaagagtcatcaggaatgctatgaccacagtctttgagaatctaaatggctttttagatttaaggggaaggagatagactttttctatgagttccaagggacagaattaagactgataagaggcagagattggcttaacatgaggaaaaagataacattgctacgatttgttaaggattactgcatgaggcatgtatagacatcgctttgtttaatctttccagcattcctacaaattagtcattatgatcctctttttacagacgagggactcaaatgaattaagtaattttcccaaggtcactcagcaagtaagtgccagagtgggatttgaatccaggtctgaagctggggctggttagttctccatctgtggttgcacccaagccaggattcagtaaagcccatcctctttccactacactgtgaagccagcttgttgcagctcagaggtagattcaccattttttgagagctgactagggatggttgtcctagaaggactgtttgggggtttgggttcttagattgttggtactagactaagagtccataaattttctctatcccagaaaatttattatttgatttcctcttgcctacctcaaaaatactgagcgatacaggggagagtatctgaaattgccaaatcggtttaacccatacgaccatatgactatctaggtcttattcttccacctcacacccaaactatcatgagaaacttagctaaaagctttgtgtatgtcgacatctgttaattcaagggcactgtgaagacaccattgtgcatgggagagaacataaattttagagggtcagattgagtcaagtttaaattctagtcataacaactgttatgtaacttgagaaagccacctacctcctacctcctgtgggctatttcttctcatcaataaactgtgatagtgcactctgcacccccccccctcccacatacacagactttcttccattgactttttctttttttttggattgcagtcttgctcttttgtccaggctggagtgcagtggtgcgatctcagctcactgcaacctccgcctcctgggttcaagcgattcttctgcctcagcctcctgagtagctgggactacaggcacgcgctaccacgcctggctaatttttgtacttttggtagagatggggtttcaccatattggccaggctggtcttgaactcctgaccttgtgatctgcctgcctcggcctcccaaagttctgggattacaggcgtgagccactgtgcccagctccttcattgattttctttctcctcccacctctgagttctctggaattgtcctggatttacctggtttcaccaaggcctcccacaccagagtctcatctttcttgtctttcacttgcagcctgatccctgatcccaagtggccaacgtagaactccgagaacagctggtcttctccagggcttcgatagcagagctccagttcctgaagaggcaaagagttgagttgccaccctgttcatcttgcatggaaggtctttccccacctgacaccttcttggccctgcttggctccataaggacactctgatgatccctgtactgaaatcaaccatcaccttcagacattgctcttttcccaattttccacagaaggatgaggacacaactgagtacctcacgggtaagtcagggcttgtccttaaacgtagtgctcataatcctaagccagatccttcttccttcacctcccccatcttgaatccaaaccctcatttctccagcccaaagcctgtcttcccaatggaccctaaactccacccactgtcgattgacaaaaatttatatccatcccctttcctaaatcccagctaagacagaactcttgattccccactgtcttccaaacatgctccctttccagtttccccaaactcagtaaaggataggaccatccactgagcatgcaggctccaaactcggaatcatgcttaagtccttccctacacaggcaatccagcaggtcctgttggctctgccttcaaaatcaaccctgaattcatatacttttctccatctccctcgctaccttcctagtcaagtgaccttcaactgtagcttgcagtattgcaacagccttttgtttttttctctttttcttttttgtttcttttttttttttttttaaagagagatggggtttttccatgttgcccaggctggacttgaactcctgggctcaagtgcctcagcctcctgagtagctgggactacaggcgtgcatcaccatactcattttttcatttttcatagagatgaggtctccctacatggcccaggttggtcttgagctactggcctcaagtgattctcccactatggcctcccaaagtgatggaattacaggcgaaagtcactgtacccaaccacaacagcattttttttttttttttttgagacagggtcttgctctgttgaccaggttggagtgcagtggcacgatctcggctcactgcaaactccacctcccaggttcaagcaattctcctgcctcagcctcctgagtatcagggtttacaggtgcccatcaccactcccggctaatttttttttttttttgagacggagtctcgctctgtcgcccaggctggagcacagtggcacaatcttggctcactgcaacctccgcctcccaggttcatgccattctcctacctcagcctcccaagtagctgggactacaggcacccaccaccacgctcggctaaagttttgtatttttggtagagatggggtttcactgtgttagccaggatggtctcgatctcctgaccttgtgatccgcccgcctcagcctcccaaagtgctgggattacaggcttgagccaccacacccggccctcccggctaatttttgtatttctagtagagactgggttttgccatcttggccaggctggtctggaactcctgatcttaggtgatctgcctgccttgaactcccatagtgctgcgattacaggagtgagccaccacacctggccttttttttttttttttttagacagagttttgctcttgtagcccacactggagtgcagggggggtgatcttggctcactgcaacctctgcctcccgggttcaagcaattctcctgcctcagcctcccgagtagctggcattacaggtgcctctcaccatgccccactaattttttgtatttttagtagagacaggttttcactatgttggtcaggatggtctcaaactcctgatctcaggtgatccacccgccttggtctcccaaagtgctgggattataggcgtgacccactgcgcctggcccataatggccttttgacttgtctctctgctttcactcttgcctgcttatcattcgttctcacccagcagccagaggcatctttatgaaagtaaatcaggtcttttttttttttttttttttttttttgagacagagtcttgctctatcacctaggctggagtgcagtggtgcactctcggctcactgcaacctctgcctcccaggttcaagtgattctcctgcctcagccccctgagtagctggcattacaggcatacaccaccacacccagctaatttttgtatttttagtagagacagggtttcaccatgttggccaggctggtctcgaactcctgacctcaagtgatctgcccacctcggtacccaaaatgctgggattacaggcgtgagccaccgcgcctggctgtaaatcaggtcttgtattagctgtttatgaccctcaaaagcttgccattgcacttagaacaaagtgcaaagtgcataccagggccaacagggcagatgaggcctggtaagaccctgcctctaatctgactcatcttttgctatactgacctcttttttgtcatctggaggcgtcaagcttgctcccacctctatgcctctgcacacattccttctgcctgaaatgttcttccacaaatctccgtgtggcctgaaccaacacccaatctaaagaaaatcttcgtttccttagatcttcctcaaatgtatgcaaccaaggcccaaatcctatagcagattctttcaaacaccctttactgagacaccccatggttccccataatatgtgttctgccactgcaatgattaataaagccagtatgttcaactacaggtttgttcctggtggtctggactgaaggacattgatgacctatagcccaaacacttcccagtgcccccaagtcaaaccccatcatccttcacatcctgcatgtgatcctccctcctccgaactttctttctcctagtcttggaagcattcccactttctctaaatcccactcactttctgttcaacctcgatttatcctgtccctgagaaagccctgagacctgccccacaggcattcattcccaggtaggacttctgttcgcagtgaagaggcagacactgggctgctcaccttggggagtatttccagcatccctgaaccagacccagacacagtgtaacgacagcccatataaagtggggtcagcgggggtggcttgtggattcgcacaaactggaatttcatttctagatcatctatggcctacagaacatagggaacaatgattaagggaggcttctgccccgtggaatgtggtttgaataggggggatggtgcatctgtgtgtttgtgtggacagagtggggctatatcacccctgcctccctccccccatgcactgctacagagacagcccgcacttggtctttgatgtcttcaggataggaatagggttattgttagggaagttagaatgaggaaaggctacagttttaggcatggaggactccaatcctttgattcctggacaggggccgtaagaaactgtccaaagatcagtgattgatcaatgaacctagcagggggataccttggagaggcaggagaccagtccaagactgagaggggacgaattgtttgcccacttcaaggttctcctgtacaagaggcccatccttggtcccagttgaagaccctctagggggctctctggctgcattttgtgtttaccgtcaacccaccgtggcccagcctttctggctcttagtgtcaccttccgaatggagcagtcacttgggatcaggtagaggtggaaggtgacttcctcaggatggacgcggtggtaaagcaacaccacagaggtgacgggaatgaagcgcagggcattatggatcattttcaggaggactcccaagggggagaagctggggttttccagaactatgtgatgcagctccaccctggctggcttctccaggagcatcccctcctctttaaagtgggccatttggaacagggatgtgtccacatggccccctgtaaaagaatggattgaagaggcacaggtttatttttatttatttattttgttgagacagagtttcgctcttgtcgcccaggctggagtgcaatggtacaatctcggctcactgcaacctccgcctcctgggttcaagcgattctcctgcctcagcctcccgagtagctgggattacaggcgcctgccaccatgcccagctaatttttgtatttttagtagagatggggtttaactatgttggccaggttggtcttgaactcctgacctcaggtgatccgcctgcctcggcctcccaaagtgctgggattacaggcgtgagccgctgcatccagcccaagaggcctagatttagtgttgttactgagtcaggatttgctggcactgtaggatcccagggcttaggctcaggtaccctcttgggggagcccagtgctatggtcttgaatgtctgtgtcctcctacaattcatatgttgaaattctaacccccaaggtgatggtattaagaggtgaagcttttatgggaggtgattaggtcatgggggtggaattctcatgaatgggattagtgcccttacaaaagagactcaagggagcttgcttgtcccttccaccctgtgaggacacagctagaaggctccatgtatgaggaatgggcctcaccaacacaccaaatctgctggcgccttgatcttggacttaccaggctccagaactgtgagaaacaaatttctgttatttacaagctacctagtttatggtattttgttatagcagcctgaacaggctaagacacccagcatggggaagagggcatttctaggcctggggcctttggaggctgtgggaaattgtgccaccaggtgggagcacttagcagtgctgaactcctaagtggagctcaaggatcacccttgagccaaacttatacgcaaacccagcccctggccctggagctgggaaagatatagaacctctagttgcctgtgctggtgtggattctctatgagagaccattgagtgatgctggaaggtttgactaggcaggtagagaacaaggaggaggaaggggcagtaggaacatagagtgaccaaggtgtttggccactcactattcaaactcttctttttaggaagagcctcctcctccagcactgtgtgggtcttggcaggaggcaagccaagccccccactcaggatgctactactccctggcagcaaggacacaggtgtgtgaccaagacttgactaagtggttgtctctaactgggacctcaagtctagaggggtgaaacagatgcagagagagagaattctggcagtagcagttgggtgaagagtccagtgagaggcaggtgtggtggtgcacactcataattccagctacttaggaggctgaggtgggcggatcacttgaacccagaagttcaaggttgcaatgagctatgagtgtgctgctgcattctagcctgggtgacagagtgagaccctgtctcaaaaacaaaaaacaaaaaacaaaaaacaaaataccagaaagaaagaaaaagagcccagtggctcctgggcaggagggtcctacagtagctgtctccgtattttctgccgcctgtctccgtattttcctgatgtgaccttggctctgcccttggtttctctgagtcattgggtcactatcttcccccccgcttagatttgttgcataaccttttgctaagtctatgagttagtcaataacctttcaatgtatcccttttctgcttaaatcagccagaattggtacctttgattgcagtctctgaccagcgccaggcaaggacattgaagttacaagagagcttgagggatgaatactggtaatgggagagacactggcctagggatcagaggtcccagctccatccctgcattgcctggtaactgctgcaatgcaagtggtttctgggcaacaaggcatccagcaagctggacaaagcccttagtcagatgtcaatcccagaagggtccatgaagaccattacttaagttttgtcatttaactgcgtttttgggatgaaaataaagtcacagtggtatctatcatctgaaaaaatgaggaagaattcacctatgaatcttaccaatcaaacaatacaactattctttttttatttttgacacggagtctagctctgtcaccgaggctggagtacagtggtgtgatcttggctcaccacagcctccgcctcctgggttgaagtgattctcatgcctcagcctcccgagtagctgggactacaggcatgcaccactgcgcctggctttttagtagagatggggtttcaccatgttggccaggctggtcttgaactcctgaccttaggtgatccacctgcctcggcctcccagaccgcgcctggccacagtataactattcttagcatgggacgcctgcattacagtctttctctgcggcaacaccttttcctatttttattgtagtccatgatactttgtctcttgtttcctgtgacagtttaacttgctgcaaggatgtcagaccatttaattaccacagtatatgatccctgctagtggatgcaccaccctgtgattcagcctgtttctcatttcagtgttgagtttgcttccaacttttcaccatgataaatagcacctgcaatgcacatattctgcagaaagcttctatttcccttgtgttattgccttgaaatcaatcagtaccaagggatgaggaaagcgtgtgagatggtatgacctccttcactccccagttgcttctccaagaggcgatgctggtttgcgttgccatcactggcactaaatggatggtctcatcctgacctccaaagcactggaatgtcttcacatgtcagttgagggagctgaaatcctgggaggaaagtgctttttccaaggccacacaaccagccatggtcctaggaccagatcccaggattctgaccacagtctggagcactaacagacgctcggtgccacttgaatttttgctgaattccagaaggtgctgggtgtctccaacttaccttcttgctagggtgaccaactgtccatgcttgcccaggaccgagagggctcctgggggtgcaggactgtcagtgttaagatgagctggtcaccccccttcttgcacatactgccctttccatagattgtggtagagtcacctcatccaaacctgacagtatatttgtgctgatagattggagagagaagggaagcaatggggaagactgtggtctgaaggagaagaaggttgagtgttgactggaggaagtctcactggcagaaagacctacgctgcctttggctggttgcaccagaaaaatttagaaaaagctatcatgaggtaggcatgtttctgtgggtctggggtccagggctttgcatctgcttattacacaaaagcttactgagtacggacaatgtgccagcccctgtggatgtagctgtgaacaggaaagacatgggcactgcaattccagagcttgtggcccaatggggaatacagacagcaaatagaacaatggctcaaagcatgacaagtgctccgccaatggaagcctgtcagctccttcctcctttcccagccgcatgcccggtgtttgccttgggacattgctgctcctgctgtccaggagcctggggactctccctcctttagatgctgcccttgggcctgtggcctgatgcctggccgtgcccttcctgctgagtgtgtgtggtcagcaccttccaggctcaggtgagctgttgaggggcacagtggctctcctactcaagcagggacagtgggacccacatcacatgaaggtagggcactagagggttgtctagcagagcagctaaatgatagggactgcctggctttgactcccagcaagggttcttaccaactgtgggactctgagcagattacttgccctctctgtgcatcatctgtaaagtggggctgataacagcatccccctcccggtgtcactgtgcagattgactgggtttgtgtctataaagccctggggataataaggaccacttgctcgtattacagataaaatgcagcttgaccaatctatccacctggctgtggtggttccttctgtttcttcctcaaacaactcggcccagtcctcttggtaactcttggggtctgggaagaaaaagctactaaattttttttttttttgagacagagtcttgctctgtcacccaggctggagtgcagtgcacgatcatgactcactgtagccttgaccttccaggctcaagtgctcctctcacctcagcctcctgagtagttggaactacaggtgcgcaccaccatgcctggctaattcttcaatatttttttgtggagatggggtctcactatgttgcccaggcttgtctcagactcctgggctcaagtcatcctcccgtttctgcctcccaaagtgttggaattacaggtgtgagccactgcacccagccactaaggtattttgaatatccattttgcttaatctgagttttgggactctatattgttatacgattcagtaagtgttggttccaggaagacaacagttttgaggcctgagggataccactgtggtttccagccatctcatctggttgaactcctgagtaggtgggcagggggagggagtgggaatggggcgagaccccactcaggtgtctgtgtgaagtgttcttgttcccacaggcagcacagagaggagcaagtgtgacaaaaatgagggaactcacttcctcttggagggagggttgtgtggagagcagaggtctgtgtgtgctgaaggagatgggtgggtgggggaacgaaggacccgaaggacaaggccagcttcatggatgtgtggcctgtgcagtcacacagggtcctgagctcagcagggcttggtgcttggtttcatgtttggtggtcttgacattcttaatcatttttgaatgaagagctccgcgctttcattttgtgctgggccctatgactgctggagctggtcctgcaggagggtgagaatgcccattgccacggtgatgaagctgagaggctgaaagcctcaagctctagctatagtgggagaaaactcaccatggaaagttaatgactcatcacccgttcagcgacgacagtgatgaagcaccagtgcccaagtcctaaatcagaccctgtgtcaggcagtgaggtcatcgtttccagggcaatgaacagctgcagcccagacagcaggcagcaagcatttctggaaggggccctgcccggccccagggattggtttcctggctggtcacagctagctaaaagcagcctctgtgcattttgcctcttgttctgtggcaggggtgtccaatcttttggcttccctgggtcacattggaagaagaagaattgtcttgggccacacatgtaaaatatactaacactaatgatagctggtgagctttaaaaaattcgcaagaaagtctcataatgttttaagaaagtttacgaattcacgttgggcttcatcgaaagccatcctgggccgcatgtggcccacaggccgcaggttgtacaagcttgtgtacggagtccaaagggagtaaatcctatctggccacaaggtgaggctcagaatttggtctagagaaggctagtgggacatgggcttgggcaggactggggaggggtaggggtgtagctcttagcctgggataaacaggacttgggatagaatcccaactctggaagagggtcttcacctctctcggcttcagtttcctcactggtacaccaagggaaaactgtagtgcctaatttcccggttcattatgaaaaaagagatgatattaatatatacggaactaccttgcatggttccaggcacaggatgctcagttattgttcacagttcttattggccaagttccagtgccacaaaggacagtgccacaagcacagtgaattcattcctattctgatttggctgtcagcctggcaggcttcagctagatgcctgtgcactcggagggtcacccaattccttggacaaatcccgtctcccaggcccacttgatgcacgcaggagactgagcagggcatggcctgggagtcctcacaatggggagggccagctcatccacctctgagagtggggaatgagggggcgctggagcaggacctgaaggcagactttgtcccctcgggccctggtggtacattctggctccagaccttagctgcatgaggtttctcctggaataccctggttagagcagggagtggtggtgcagccctgagcatcccaggttggggcaagccaagttcttttgctgctggtcatgggcagagctacgacagagctgagcccactgactctattagccaggcccctctcttcttgatagagtacctggggatccctggccacggtctcacttgtggaagaggcaggctggttgtggtagtggctgtgttcattactctatagattgcccggtgggaacaagtaacttgtcccagcttcttgtttcagccatcagtttcctctcctcaatctcttcctttctaaatggacctctacaattccagagctgtcttgcacctcttccctctattctgttttagtctgggaccttccctagggaatgcccatatgaccctgactgttcaaccaggtgccccagggatcctgaggcccccgggactctatttccctgccccatgctctcctcctggtgtgcagcttgaattgtttactgaacttttgtggcctcaacaaacaagactttcctggttctgggtactgagcagttccctgctttttatttttctcatttgatttttctctttctactagcttctaaataatttttcttatatatatgccttgattaccttaatatatgcatactgtaaagttaatacctttattttgaggtgatactaaaaatacattgaactactgggatgatactacaacatatcaactaacaaatgagaaattaaaaataaattctcatttacctctattcctgggaaataaagaaattaagacaagaaaaaatattaaaaacccatttaatatctagctaaactgtacaaatcataaaagtgcttataactgatgtaagctataacataaattgtttatcaaatcattttatcagcaattaaatgaagcttctattggagtcatgatttgacatggggacacatcagattcttctaacttgctcactaaattgacagacattggctgggcacagtggctcacacctataaccctttctttctggctgatgtcaaggctttccctcatactttcttattctgtagtttcacattaatgagactaatcttgattttttctctcccttctctctctctttcctgcattgcagttttggggattctcattctgagaagtctcatatgtctcaatacttccagaaatttgtttgcaattgtcttgttgaatattctatttttttcccttctatcttatctttctggaattccatttagatatatattaggacttatcatggtatcctacaagttacttgattgtttattcttttttttttttttttgagacagagtctcgctctgtggcccaggctggagtgcagtggtgcgatcttggctcactgcaagctccacctcctgggttcacgccattctcctgcctcagccttccgagtagctgggactacaggcgcctgccgccacgcccggctaatttttgtatttttagtagagacggggtttcactgtgttagccaggatggtcgcaatctcctgacctcgtgatccgccctcctcggcctcccaaagtcctgggatcacaggcgtgagccactgcgcccggccttgttttttcattttttttagtcaatttagtttccaactttgatttgtcatttttaatggttcattgctttttgctgatagttttaaggttacttttttttttttggtcatattatacacacttattttatgttctttttctgataatttcagcatctgaaggatttaagggactgattctggtatctgtcgtttctgctggctcttacttctggtgccttgtttcccctttgtgagatttttgactgttagctgatatttcttggaactctgtgggaagtctttggaggtgacataaaatcatactttgtgattactatcttctatgggaagcccctgtttcatggctccagctctcagatggcgtctgatgacactgtttcttctccctgcctgtaggagtagtgatggcttcctattgttgctagtccctgttgccccaacattcttcgttagttcacttagccttactttgtaaatggtcctgtctttgaaaagcttcttcaaaaatctcaactgagcatatcatctctttcctgctgggaccttgagtgatacagtctatataaatgacacttaataaaaactttcaagtaagtttaggcagatataattatgaggctgggagatgtgtttcaaaaagataagtccagagaagagtggaatgcaggaaaatcttagtccccatctccataaccccccctcggcccctctaaggaagccacaacaccctctcccaggagattatcattctacactccctttcaggcccataattaccaccaccttcctccctatccttccctgttgtttaccttggagagccacaaagtgagggaggtgcacagcttccacagctccaggctcagccttgatgtccagcagaggccctgccaccatccagctgtgctgtgggttgatctcacccaggaactggtcccacacacagaattcaatctcaacggtcaccgcttctctcatcacaaagcagagacccgtgttgggccagcggtaggagccagctacagggaagtgaactctgggaagaagagggagaggcagacacttactgcacgaactcactgagcacctgctggatgccagaccccatgcaggggcttgcggatacggtacagtggcttcaagcccagacttcggaatcagatggacttgcattttagtcctggctcttctgctcttgactgtggatccctgagcaagtcatttaaccttcctgtttttggtttcctcatctgtaagtaggagtaattatagctcccatctcctagttacgagaataagtgacttaatgcatgctcacagcttagtacacgcctgggagctgtgaactgtttctactatgttgatgatggcaatgatggtaatgatgaaataacaagtgttcgtatatgtaaggggcctatttagcaataattaataacaatatatgtgctaagattatctgtcttgtcttgtctgtctatctatctatctatctaatctatctaatctatctatctatctatctatctatctatctatctatctatctatctatctaatctatggaaatatggtctcactctgttgcccaggctggagcgcagtggcccgatcttggttcactgcagcctcgaaatccctggcttaggcaattcttccacctcagctccctgagtagctaggactacaggtacatgtcaccacgtccagctaatttttttggtaatttttgtagacacaaggttttgccatgttgtccaggctggccttgaactcctggactcaagtgatcctcctgcctcggtctcttaaagtgctgggattataggcatgagccactatgcctggccgtatgtgctaatattaatgctaaacccttagaattggaaacaacacttttatagagatcagaagtgattttcccaaggctcctcaggtgggttaatagtgggtcccgggatgccccagcttctgtaggtgtgagctgggagtgacgctgtctcctggttgagatgatgtctgtggcagtgtttggtgagtggtaacatgttatataagagatcatgagtatgactatagagaattactactagtgcgactgtaagccctgggagggcagggctgccatattcatcttagggtccccagctactagtacagtccttagctcattagtggctgttaataaaacaggagcatacagattaagagagttaagtgagatttaagaaatataacaaagaaaataaaatgagtggaccttgtttggatcctgataagaacacaccaactggccaggcgcggtggctcacgcctgtaatcccagcactttgggaggctgaggaaggtggatcgtctgaggtcaggagttcgagaccagcctgtccaatatggtgaaacccccatctctactaaaaatacaattttcatttttcacacgtggtggcatgtgactgtagtcccagctactagagaggctgaggctggagaatcgcttgaacctgggaggtggaggttgaggtaagccaagattgtgccattgcactccagcctgagtgacagagcaagactctgtctcaaaaccaaatcaaaccaaacccaaccaaaccacaacaccaactataagaacatgttttagacaattgagcaatttgaatatggattggggagtagatgaaatgaaagacttactgccagctttgtcagatgtgatattggcattgtagttatgttatggaagaaaaggtttttatttttgttttttgagatgcgtaatgaaatatttaagggtaaaatcacccgatgtcttggatttaaaatactgtaacaataacaaagagggggaaagtgaacagctgaaacgaatttggcaaaacagtggctgaagctgggtgatgggtacatggaagctccttgtactatttttgtatatgtttgaaaattttaagtttcataagaaaacatctttttccatatgaaaagcagacacccagtgtctcagccctgtctctgcctgttgtcttggcaagaggaggggacccagtggtgagtgtgagttgggggtagggggtggcgctgactgtctgtggggacccaggatgggcagtggggtgcgggaggccagcctgggaccagcagagccccctcactcaccggtacaagttcttttctttgtcaactacctcagtagccacaggccccgtggggccccagaagtcatcgtcagtccccaaaggcttcgtatgcaggtccccttgagaggcaggagaaggcacgcacaagagttccaccggtactacctctggggagctttcctctgaaacagcaaggcagcggtcagctccagattctcccgcctggcctcccctagcccctatggctgcactgtaaggggcccttcccaaggctggcctgcctggaccatggcagggagtgtgtctgcagcttctgctcctgctccatggctgcctgcctgctgtctggggagccccactccagtgcctccagcccagcctccgcccatctccccttccccactggaatagaagtgccactctccccagcatgcccaggtgggcaggttgagagagaacatggttcaaaagatgaaaggggccaggcaccgtggctcttgcctgcaatctcagcaattgggaagatcttgctcacgtccaggagtttgagattagcctgagcaacatgggaagccgccctctctacagaaaaaagaaaaatatcagccaggcatggtggtgagcatctgcagtcccagttctactcaggaggcggaggtgggaggattgtttgagctcagaaggtttaggctgcagtgagccatgaacatgccactgcactccagcctgaacactagagtgagactctgtttttttttttttttttttttttttagatggcagggcaaagatggagatgtgattcccaggccttagcagccaagaatggaagaggccggaccccggttcagggtttgatacatgccatagacgttctggagaggggaagcaccagccggtgggtctcggagagagggtaacggaaatccagccagttcctaggagtgggagctctctcgtgggggtagcaccctcttgggtaggaaacctgccccgtcccacatcaggggcagagggatggagggaatgacctcccacagctgacctcccccaacccctgtcacgatgctcccagccttgccccttcaaactacctgatccgagtctctgccgcttgagtgaggatgtgctattactcatctctcccgtatccaggccctcagtaggggtcatcacacttggtttcctggacaaagaattgttcattctgcctaagatcttggaggaagcgagggctgtccacatgacattcccactaaaaattcaactcctcctcgggtcgggtgcagtggctcatgtctgtaatcctcgcactttgggaggccgggatgggtggatagcttaagctcaggagttcgagaccagcttgggtaacatagtgagacctccccacctcatctctgccaaaaatacaaaaattagctgggcatggtggcatgcacctgtatcccagctacttggaaggctgaagtgggaggatcacttgagcccaggaggcagaggttgcagtgagctgagattgtgccactgcactccagtctgggtgacagagccagaccctgtctcaaacaaaacaaaacaaacaaaaaaactccatccgaatttgaactcaatcctgtggttcttctgtggtccctgtctctgtgagcagcctccatccacccatgcatccaggctagagctggggtgtcatcccaactccttcctcgcccaccctaagagctgatcaccttgacaacacctctcaaatagctcttctttctattgtcttctctccacctccatgacctccacctgagtcccaggccctggcctctgtggcccgcaccactgcagcatcctctgaaaggtctccctgcttctgctcgggtccctctgccgcccattttctacacagcagccaatcttgaaataggaacctgacccatcacttggctgctgcaaccctgtaatgtcgcttcattgcttctgggggaaaatggaaagtttttaacatagtccaaaagggcttgccagggcctctgtcaccctccaatgtcacctgggccactttttcctggctcactgacctctagtccatcggttctcaaactgtgcgcttaacaatcatctggaaggcttgttaagacacagattcagccgggcgcggtggctcacgcctggaatcccagcactctgggaggctgaggcgggcagatcacaaggtcaggagttcgagaccagcctggccaacatggtaaaaccccgtctctactaaaaatacaaaaattagctgggtgtggtggcatgcacctgtagtcccagctactctggaggctgaggcataagaatggtttgaacctgggaggcagaggttacagtgagccgagatcatgccattgcactccagcctgggtgacagagcgagactctgtctcaaaaaaaaaaaagacacagattcctgggccccaccccagagattctgattcagtgggtctggagtggggcctgagaatttgcagttctatcgagctcccagtgagggtgatgctcatgctgctggtccacggaccacagtttgagtagctgctcctgacgcctggcctcccattcctccaggaggctaaactcttttctctctcagagcctctacttctgcctggactccaccccttcttgggcccagccaacctgtcctgtctttcagacctcagcccagatcctcttgaccaggtcaaataggcccataggtgcactcacactgaccccaggtgcatttgcgcagacacttctgggataacctgtgcctgtctccctgctggactaagctcctggaggttgggttgtgtctttcttgttcactgctgtgtccttagatccccaaacagtgcccgacacatagtgggtctgcagggaatgtttgttcaatgaataaatggctcctcttaagcctaggagctgttttccttccatttcaggtgagccacagcagccaggaacctggggacagatgagcttcatggtcaggtggaaatgcacccaactgggagaatgtgggagctgcagcagattcctcggggaagggaagatggactttcctggccccggggcttgcccctcaagtcaggggtgtgtgtggtggtggtggtgagggtggtgggtgacggtgatggcgaggatggtctttttcccagggcacaggcgctctctctctctgtctttatctccctcttgtgatcatcgctttcattgttccaaaccttctctgttcttcatggaaggattcctggactagaggccatttggtatcatgctgtgctgggtccaggggattcgctggctcacccacccactgactttttcttgttcttttttttttctttttgagatgttgtcttgctctgtcacccaggctggagtgcaatggcgtgatcctggttcactgcaacctctgtctcctgggttcatgtgattctcctgcctcagactcccaagtagctgagactacaggcgtgcgtcaccacacccagctaatttttgtatttttagtagagacagggtttcaccatgttggtcaggctggtcttgaactcctgacctcatgatccacctgcctcagcctcccaaagtgctgggattacaggcgtgagccaccatgcccggctttttttttttttttttttttttgagatgcagtcttgctctgccacccagactggagtgcagtagcgcgatcttggctcgctgcagcctccacctcctgggttcaagttattctcatgcctcagcctcttgagtagctgggaccacaggcacccgccaccacgcctggctaattttttagcccacttactttttcatgttttcctttccttgtttgtctaacgttaagagttgaagcaaggggggatttgattctacttgcactgacaagtgcacctcactctggctgctgtggtgtctgggtttctccctggctgtgtttgtctctcaccccatggctctttccctgtctcctgctcagccctgggcctgggtcagccagagggagttctgggtccccccttaccgtctgctgaagatgagcagctgaggtttctcctgctccagggccctcagttcctgcctcatctcatcactcagagttgtctggtccagcctgaaagcacaaagggagccgggtcctcctgggatcccccatgtggtccccaggtccccagggcccagaatcctgggacctgtcaccttctgaggcagcggccgcagggtgggttccctggaagccaggctctgaggaggagggtacagtgaggagattcattagggtgtgttcttgggtcaatgccagggcaagggaagggagggaatcggggagacgtgggctgtgaggcagtctccaatggaggcctcagccaactctgggagatgatcctttagagctgtttaaaggagttgggttgaggggctgggcctttctaccccaacattggccagtcatcggatgtgggcctccccaggaaggagatgtggccttgggtgaggtggctctcactggcagaggctgtctctacagccggctgccagggatttccccatggcctcaaaatgaccacctcaggcctgggtcctgggattttcttcccagtggtcggaagttttgctgggaagagagagtcctggttccatcctcccaggccttgtggtctggggtttctgccagatgtgagatgctgattgtcttctctgggtctctgtgtcctccatctaccacgtaggatgaatcaatcctgccctgcctgttctgaggcccagacaaggaggcggtgaaaagaccctgtcttctgcgaagggctctgcattcattcccctactgctgttagagctgttctgcccctggggaggagcgcagaccttgaagtagaaggttattcttctcaactaagtcccggctccaggagggaaggaggtggaaacctactcgggactctagagagcaaaccccctcagaagcagcccaggtttgacaggtaagtgttgagctggggcctgaagccatatctgcctgccatggccaagctctggggaaaggctcttcagcataagggaggtagtgatagccaaaaatactcagtggggagcagcaggctggggtgcaaaggtgctgcccccttgggatggagttcccatggttgtagatagccagtgtcagctacaggagaacccaaatgtagactatttatttctgttattctgccttgaccacttctttaggtttgggaggcctggctgaggaaagcccgaggcccaggcttcccggaccccctctgagaaggctctggatgtgggggtttggagcccctgtctgctccctgagatgtggcagggcccctggcaggagccgtgggtaagtgtcaagacagaagccactcatgggcttgctcccagggaggtggaggggagcagaagtggcccagagatagtgtgggggtggctcctcggggaagggcaagaatctctggggcctacgggatgggaaatgagggctgggggctcactccactcagggtccttcagttctccggggctcaagtgcctctttgttctgggcctttccccacaccatccctaggcctagaatactctccccaacttggcctgggtacctattcctccttcagacctcagcctgacgtcactgtctcagggaagtcctccctggccctttgatcaaatcccatcctccctcaatattacattctcataataccctgtactttcctttcactccacagagctcataaatatagacttgtgcatttacaggtgaccagtgtccgtctcttccccactagagtagaagcttcagtagggcagggcccatgtctgtttggtcactattgtaccccaaggcctggtctggtgcttacacacgggaggcactcagtgaatgaatgaatgagtaaatgaatgaatgaagcgctgccctggagtgaggggaacctgagcgtcccctagagcatgcagcctcagtaatagttatcatttgatcatgcccgactctcttcccagcactgtccttgtttttattttatttgtttaattaattaattaatttttgagactgagtctcactctgttgcccaggatggagtgcagtgctgtgatctaagctcactgcaacctctgcctcccaggctcaagtgattctccctgcaagtagctgggattacaggtgcacaccaccatgcccagctagtttttatatttttagtagagatggggtttcagcatgttggccaggctggtctctaactcctgacctcaagtgatccacccgcctcggcctcccaaagtgctgggattacaggcgtgagccaccacgccctgcctgtccttgtttttatatacattttatttcattacaatccatgaagtgggtatgatactcccattccacagatgaggaaacagagtcccagagaattcagcgacttgtccaagtcacacagtgtaagtggtagagctggtaagaaacttgggttggctatgcatttatcagtcctttttccatcccctgtccgatacccccccaaccctcttccctctgcccagaagggacccacagggccttaccccaggcgtatgagtttgcaggcaggatgcctgagcccctcacagagcagtcgcacgccaacgtcatccaggttgttctgctgcaggtctagctccttcaggctggggctggcactaagcacagaggccaggtcctggcagcagtcagacgtgaggccacagctgaccagcctgcaggaaagatacacgccagcccaggtcattgtcctaagggctcgctcttcagggtaactagggtctgatcttccttctcagcatctgtggccttttgagggtctgggatgacatgcagagaagatacaaactttcctggcttgcggtaacctgagagattttcactttcctcttgcagccacggaacccctcaggatgccagcacctaccctttctcaatcctgtgtgattcacactgatccagtcccctcactctgtccacattgatgagtaacttactcaatgtcccacttgtacacctgggtctatctgttttctctttttcttttttcttttgagacgagttctcactctgtgtcccaggcctcccaaagtactgggattacaggggtgagccaccgtgcccggccggtagggcctttttagagggcaaaattagcaacatatcgttttcccagcagttccatttttcggaagttaagctacagataatatgctgggtctcaggacgcactgggggatgttaactgctgccctgtttacagcaaacactggagacaatctggctgctcataataggcgatggataaaaacatgatggtaagtccatgtagtgaaattccatgctgtgattaaaaagaatgatgtgactttgtacgtacggatgtgggaccatctccaagatatattttaactgataaagcaaagtgcagggcagagtttgtgctgtgctaccatttatgccagaaaagggctatgtacctgctgtatgttgtatatatgtaggctctctctgggggttctcctgtctggggatcctctgctcttggggtctcagccctgcttctagaactgttggctctcccagctgggtctgctcagacccagctgcagtccaagcttgtaaatgtcacaaagcattccagggccttcgctaagagagggaacagggagaatggaaaaccaggctttgaggtcagacctggcttcaaatcctggtgcagctacttcctggctatgtggccttgggaaaataatgaatctctccgagatccaatcttgtcttctgtagatgtagcgaggattaaatctgacaagtgttaccgacttcctagccgaccagggatcgccgacccctgatactaggagaggatcctcgttgtctccccttcccatgcccccttcccatcaactcttgatcaggattactgaatggggaagcaggcaatagccttgggaagggcagaggtttggccttgggaagaaggaagggacgtgtgatgtgtgaacaaagatctcgcaaggtgtaaacaaggatatttcagggcttgggcagaaacaaaagaagaccctgaaggcagccccctgagcgggtgcacagaggggtgtgtataactttgtgcatcaagggaggaggcccagcaggaccagggagaggtaactatgcactcttgtttcttttcttttcttttttaagaaggagtctcgctctgttgcccaggctggagtgtaatgaggtgatttcagctcactgcaatgcctaccttctgtgttcaagcaattctcctgcctcaggctccctgagtagctgggattacaggtgcccaccatcacgcctggctactttgtgtagttttagtagagacaaggtttcaccatgttggctaggctggtctggaactcctgacctcaagtgatctgcctgcctcgacctcccaaagtgctgggatgacaggcatgagccagggcgcctcacttgtttctacatggtggcgggggggatggctctgtcccctcggatgagatagtaaatcgaactaagtggacaccagtgatttcagctctccatggcagaaccccatgccaagtaagaggacctgttactaggcagatcacagctcgtgggaacaggagaagaatagaaaaacactgctgcaatcctcatagctctatgaagtgggcacgattatcatcatcctctgtggtagtctgtgaaaatggccacaaattctgccccctgtccccaccttgcattcacgtcccttgactcgacttggcttctcttgctgtatttggagcctggaggccccctccctctgtccaagggtggatgagcttcctcctgagcctctactgcctggctgagatcctgtaggctcctcccactcccacaaagcaggtctcaccttctctctgctcttaccctctgcctgcctcatggtggcaggcagttccctccacctccccctgcccaccaagaacaattactgcagtcgctgtagcttgcagctcggctgtctcagtctctggcaaaggtgtttggctccagcatccgtgagcacattgaagctcaggtccagctcggtcagggtctggttggctctcagcccaaaggcaaggtccttgcagtcctcagctgtgaggccacagccagccaacctgtggaagacacacacccatggtcttcaggttactcacctgttgattcaacagacacccataagcaaccattaatcacctactatgcaccaggcctgtgggccaggcagaggtctagaaaaccctcccaggccccagaaatgcacatggtacttggggatagacatagaaacacataatagttagttttttgatcctttttgattaaaaccctccaatgttttcccacattactcagaatacaattcacggtccttttcctggtctacagggctctggggacttggatcctcatcatctctgtcctcatctctaatctcttttaggtccatagtcactgcccttctctctcttccttcctcaccccaggcacagttccacctaaggtctctgcacctgctgcttctgctgcttcttctgcctggaacaatcttctggtgctgacacctcatggggtgctcctccacttgcgtcaggtctttgctcagaaggaagtcgctttggtgacatcttgcctcgtctctccacttaaaattgcacacccatccccagactccctgctcctttctgctttacttttctctatagctcatgtcactcacaatatattttacttacttatttggcttcttgtcctccctcccaactagaatgtaagctccttgaggaaggaattttgcccatttccctccctccctccctccctctccttccttccttccttcctttcctctttctccttccttcctccctccctccctcctttctttctctctccttcctccctccctccttccctccctcccttccttctttctgtgagatggagtctcgctctttcacccaggctggagtgcagtggcgtgatctcggctcactgcaacctccgcgccctgggttcaagtgattctcctgcctcagcctcctgagtagctgggattacaggtgcctgccaccatgcccggctaatttttgtatttttagtaaagacggggtttcgccatgttggccaggctggtcttcaacccctgacctcaggtgatccacccacctcagcctcccaaagtgttaggattacaggcgtgagccaccgtgcccagccccattttcattactagtcatatcccagtgcccagagcagggtctagcatacagtaggtgcttagtaagtatgtagtaaataaatgaatgaaatagcctcaaaagaggggcaagtcaggtgcagctgaaggcagaggaatgagtgattgccaaggcagggtggaaacggtgaaacttaaatgagtgattcactgaggtgagggcggaggcaggggcacgcgtggctggtagggcagatgtgaaatcacagcacgcggttagtatagtgatgttagcgtaaaggctacccaggtagagagaaagtctgagggtaaagctagaaaatatcaagatagtagtaggtcttggatgtcattataagatgtttagacctatttccctgtggcagtgatgagcccatgaaagttcctgaggccagcagtgatgtggtctctgcattgctttagaaagatccctgagggaggttgtagtgagctgagatcatgccactgcactccagcctgggtgacagagcaggactccatctcaaataaaaaaaaaaaaaatgcaagatccctgaggaagtggaggtggctgggtggggaaaggcaggaggcaaggggtctgtgggggaggatgagcaactgtcagagcagcgacttcgggagatgtttggagcagaccctgtggcactcagtggagtccagggaggcctcaaggttggattcagagtagaagctgctgtcacttactgagaaagcagatgttagaagagtgtcagtttcattggtgtacaaccagggtggttgcacagggccccgtgctcagaaggacccggaactggcaggggtgtgagaaggacccttctagattgggggggttaatgctctgtggtggccatcttgaatttcttaataattttgtctttaaatttgtgttttgtaggtgaagtctgatgggaccatggagcctcagctcataggtgatgccatctcctgccacctccctccctccctctaggggaaatagttcttggtcatcctgcatttgagtgttgtggggcccccactcaacctcagcccagtgattattgccacgctttatctctggtgggggcctggatcaggcatgggtaggttggggtggggcatcttggggtagggcaggtggcagcctttctcgatttgggctggcagcatcatggcacatttggtgatttggtgggggcaaatctcccccaccactgatctagatacctaatgcatcctggcaataccctggagggtctcccatctgctttaggctggggtggtggcccatgggaaggagacatgtctggcttgacattttacccactctggggcatggtgcctggatctggtgacttgtgggagaggcaccctgcatctggtgcaccatgtgcacatgctgagctgtggagaggcctccgagcacctttgagggtctggacaaacactgctagtgtcccagtgcccaagggaatgcattgttaaatagcaaataaaatacactgtgataggttgagagagaaactatggaagaaagaaaaagctctgtatcgtagtacctttaacagcactttcatcctgacttttgagctaggacactgcattttcattttgtattgggtcctgaaaatgatgcagttggttctgagaggaggaacagtttgtttttagttagggaggatagtctaggtaagaataggctgaatttcaggagcctctgggacacctcagaggagggtgttgggtttgggtctggagctgcagatgcagggttggcagacactgtgggagcggccatctgatatgattatgggagcggctgtgtgtgagggggaaggaggctgaaggtggggcctggttatccttctggttggactcaaataccactctccatcctctccaaaaatctctgtctttccttgctctcataagacctacttttcccctttgtttttctctggcttccttctggactttcctatccagccaggaatttaaggtcagctgcattaaacacacatcctggcaaggtgtggtgactcctgcctgtaatccccacacttttggaggccgaggtgggaggatggctcgtatccaggagtttgaggctgcattgagtcatgatcacaccactgcactccagcttaggtgacagagcgaaaccccaattccccctgtctctcttacacacagacacacagacacacacacacacacacacagacacccacacagacacagacacccacacacagacacacacggatacacacacacatacacagacatacacagagacacacactttgacacacagacacacatacagacacacacacagacacacacacacagacacacagacacacacacacatacacacacagacacagacacagacacacacacagacacacacagacacacacacacgactcagtatgtggcattgtagagcacttggattttagagtgcaccaggccctcggtaacgtctccctggacaatcactgtcttccttctctgcttccaaccctgagctgcagagtgtggcccaagaaagtccagacgcagctggcagatgtggctctgtgctcactgcctgtggctggcatctcacagctgagggcctacttcccagatggctgtctcctgccagcccactctctccctgggtggtcggttctacccacctggcttatctgatttcctgcttgttgacaagctcattttcactaggcatgttcctgcccccaggactcatctcagcataaacaaatgtgcctctcttggggctttatttatttttaaacaacttaccattacaagctgtgctgtgtggacttccctcctccaatcctacccactcccaagccccagtgaagacacttggtattggacctctgtgaggaggctgaggccatctgaccttgggcagcagtgaccccagtgggcaggtgaagggcacaggctttggggctagacagagatggattcaaatcttgcctctgtcagttacaagttgaagactatggcagatgtctttaccaagtttcagttcactcatcagtatcatggatctgccatgtctattgtaccagctggctgcaagatccaaggagatcatgtatgccatgttcttagggaagcccctggcagaaggttagtgcttaaaggatgctgctgctgtggaaaccaaaaccctcaatgtccctccacctctccgtcctcagctgcctgtgtcatcacatagtcctttctcttctgttccagaggaggccaagggtccaccctcatgtgtcttcgattccacaccctctgtctggtctctcccctgaccttgctctttccggcattccttttttgagctctccaaccccactcccgccaatttctcctttgtctgcgtaatgtgctcaattttacaggccattagtgacaaaaccccagaattcctgacaccagcttattcaatgcatttcaagataaatccaaaagtgaaataagccagacatagaaagaaaaacactacatggtctcacttgtgggtgaaatattaaaaaagcaaaatacatacaaagaaagaataaatggtggttatcaggggcgaggagggggaggaaatgaggagatgtaggtaaataaaaaaagagaaatacaatagttaggactttgcttgcgggtcttgggtagtctggcatccaagcgtgtgtaaggctgtacactcttccatatggagatgtttttattgtgggaaatattcacatttgcctgatccagattttctttctttttatggtgctacccccagtgagccagaattaatcaggccccggcttacctgatacagaggaggtaggtgttggtgctgggtcttgccctcactgagttgtgtccagctctcccactgctaactatgtgaatttggcaagtcgttaatttctctgagcctcttaggacaacttaggcactaaatacatagcatacatgaccctaaatacacatcatacatgaacctaagtacatagcatacatggtcctaagtacatagcatacatgaccctaaatacatagcatacatgaccctaagtacatagcatacatgtcctaagtacacagcatacataaccctaaatacatagcacacatgaccctaagtacatagcatacatgatctcctttgactttgcagccaccttgtgcaacagacatggtgaatccatgttattaatgagtaaactgaaacttgctaaagaaacctacccatagttttcaatctgtaaccgttagaggcaagatttgaacctgtgtgtgtctggctccagggaatgtccttccccagcccatttctttatatatggaaaatggaaatagttgtccctgctctgccatttttgcagggtgttttttggaaggcccaaggaattaacagatatggagttgtttgggtttgagatagtgaaattttatgccaatgtaaaaagagtacattgaagattggtgtcttcctactggggtgtgaagtttgaggtagaaccaggattccttagtcctgctcaaaagcatttttactggactctggtggttctccttggataggtcttaggagtgggtagagcagcctcataaggatacagaaagtcacagcacgaggctgggcttgcctccttactctgcctgctcaacttctcccactgtaactcctttttaatgaacaatctcttgattgctttcctttcttacaatctcctttctttcaatctcttatcactttcttttcttcaatttccttggaatgtaggttagattccatgatccttcattggcagtatcctgaatttcttaccctctgaccttccatcacattcctctggctaaccctgaattctgctatctttccactctccacccaaactcccacctgtgcaacagggtaggtggctgccatcttgaatcatgaccacgaccctcacatgggccacagcaatgcctgactggcagagatctcacactctactatggccatttgaagatcttgccttttccaaacatccaacacctcaaccctcacactcactcctagcaaacaactcaattcctatttctcagagaaaaatgaagccatcagatgggaacctctcagcttctcagagtgaaacctatgttcctacctctctcttccctgtcctcatctcccctcctgttacagtaaaggagacatttcctccctcttccaaggccaatctttctcctccctcctccctctgaggatagagagccatcaatgactccttctccttcttgtgtcttttatcactcctcctcactgattctcaaactgagatcttttccttcttaaatgcaagtaagcagatggacagacacacacatttactcagcccaccatcccctctgctttagtgctttcctccttttcactatcaaagtctttgaagaaagtatatttgtggtctcattttttacctccttctccctctttaatgcactccagtctgcattctcgcctcttcatgccacataaggtacttctgctgaggttattcatgactttcctatcactaatccaatggacaaatttcagtccttatcttgacctcccagcagcagtagtccctgctgacctccttgagaccctctgctctgttgggttccatgacacctctctctcctggtgtccctttcatctatgtggcccctccttctcaggcttgtttgttggctcttctttggccattaaatactggggtgggggtgttccccaggcttgacatgcaatcttatttttgcccgtgaattttagaatcagcttgtccatttctgcaaaaatggcagctgggattctgctagggattgtgttgaatctatagatcagtttggggggtattgtcattttaataatatcaagtcttccaatctatgaacatgggacatcttttcatttgtttaggtcttacataatttctttcaaccattttttgtagttctctgtatacaagttttcttttgttaaatttattgttttcctaatttaatttttggattgttcattgctagtgtatagcagcacaactaatttttgtatattgatcttgtttcctgaaaccttgctgaaatcattagttttttttttttttctttttcaacagggtctccctttgtcacccaggttggagtgcagtggcacaatctcagctcactgctacctctgcctaccaggctgaagcgattctcccacctcagcctcctgagtagctgggactgtgggcgtgtgccaccacgcccggctaatattttgtagttttggtagagacagggttttgccgtgttgccctggctggtcttgaactccggaactcaagcaatccacccacctcagcctcccaaagtgctgggattacagggcatgagccaccacacctggccctaattttaatatttgtagattccttaggattttctacatacaatgtcatgtcacctgcaaataatagtttaattactttcttttcaatctggaagctgttaatttcattttcttgcttaattactctggatggaaccttgagtacagtgttgaatagaaatggcaagaacagacatctttgtcttattcctaatcttagggggaaagcactcagtcatccaccattaagtataatgttagctgtgggtttttttactggtaacaactttatcaggttgataaagttcccttttatttctagtttgctgagtgtttccaatgtgaaaaggtgttgagggtttgtcaaatgctttttttgtgtctttgagataatcattggtttgtgttctttattctattaacatcttgcattacattgatcaattatcctaggttaaacccaatttgcattcttgggataaatcccatttggtcatggtctacaatcctttttatatgttgccagtattttgttatgtaattttgcatatatattcataaaggatgttggcctgcagatttttttttttctcttgtgatgcttttggttatcttagtctaattttggtatcagggtaatattggtctcatagaacaaattggcacgtgttctcttttctgctatttttggaagagtttgaaaatataagtgttaattcttctttaaatatttggtagaattcactagtaaagccatctgggcctgggctttgtttcatagaaagtttttaacttactaattcaatatctctatttgttataagtctattaagattttgtatttcttattaagtcagtttaggtattcgtgtctttctggaagttggctcatttcatctgggttatctaatttgttggcttacaatatttcataatattcacttataatccttttatttctgtaagttcaattgtgataccccatcttttatttctgattttagtaatctgaatcttcttacattttagttagtctagctaaaaggtgtcaaattttgttggtatttttaaagaactaacttttagtttcattggttttctgtattgttttctattctctgtttcatttatctctactctagtctttattatttctttccccctgcttgcttttggttttgtttgctttttaaaaaaatttctttactaacatgaaagacctaaggaaaacaaattcttaaggtgtaagtttaggttacttatttgagatttctctgcttcttctttttcttcttcttcaatagactttattttttagagtagttttaggttcacagtaaaattgagcaaaaagtacagcgagttcccatatactccctgtccccacatccctcatacaatctttcccactgctgacatgctgtaccacactagtatattgtggtgacatttgttacaattgataaactgacatggacacatcatcacccaaagtccatagtttacattaggggtcactcttggtggtgtacattctatggattttgattgctgtaaaataatatgtatgaacgattacagtatatagaatagtttcactgccctaaaactctactgtgctctattaattcctcccttcccccaagccctggaaaccactaatcttttttactatctccttgtttttgcctcttccagaatgtcatatagttggaagcatacagcatgtagcctttttagattggcttcttttagtaacatgcatttaaagtttctccatatctttgtgtagcttgatagcttatttctttttagcattgaataatagtccattgtctgtttgtaccacaatttatgagtccattcactttctgaagggcagcttgcttccaagttttggcaatgatgaacaaagctgccataaacattcatgtgcaggtttttgtgtggacagaggtattcaactcattttggtaaatatcaaggaatgcgattgctggatcctatggtaaaagtatattttgttttgtagaaaactgctagactgtattccaaaggggctgtctcattttgcattcccaccaacaatgaatgagagttcctgtttttccacatcctcgtcagcatttggtgttgtcagtgttttggattttggccattctgataagtatgtagtggtatcttttctttttttcattaattaaaaaaattttgagtaatttttttagagataaggtctgtctctgttgcccagcttgaagtgcaatggcataatcacagctcactgcagtgttgaactcctgggctcaagtgagactcctgtctcagcctcctaagtagttatgacaacaggcacacatcatcattctcaactaattttttattttatgtttttgtagagacagagtctctctatgttgcccaggctggtctcaaactcctggcctaaggcaattgtcctgccttggccttccaaagatttgggattacaggcatgggccatcatgtctggctctatctttcctttttttttttttttttttttttttttttttaaatagaagtatttataactataaacttccctttaagcactgcattagctgcatccaatacattttggcatgttgtgattttgttttcatccctctcaaagtgttttctaatttcctttgtgatttcttctttgacccttggttatttaggagtgtgtttttaaatttcagtgtatttatgaactcctcaactttccttctattgttgatttctaatttcattttatcatggtcagagaatatactttgtatgatttcagtccttgcagatttgttgagatttgttttatggggcgatcttatctttggatagagctttatttgaaacctatttggcaggtccagttggataccttgaaaggatcttgaaaccagcaagcacgagatcacactcatgacattccaccccccaatcacttttcttttagtattccccatcttgatgaagatgccactatcccatgagttgctttggtcagaaacctaaaatcatccttgatatcttcctcttcctttttttcctaaattcaatccattactgagcccagttgattttacttttatagctctcttacatctagccactttgttccatatccattgccaataccatagtccaagctatgactatctgtgacatttaaaagtactataattttccttagtccaaactattaccatctttgcagggactactgcaattttcttactaattggtttcccagcctctacttttgcactcttccaatccatttttcatgttgcagccagtttctattttgaaaatgtactgatcttgtcaaccttctgcttaaaattccacaccatcaggaaaagacccaaatccaacatggtgcacaagcctggcatagtctacttcctgttggtatctgtagccttatctcaaccctttgctatctgccctccagccacactggcctgctttcagtttcttgactgcctcctcctgccttctccacagagcctttgtacatgctattctcttttcctggaactttttccttcctgctttgcttagttaaatcctctgtattcttcagacctccctcaaacctcacttcatgaaggaattttttttttttatgagcaaaaaatcctatctgtgtttgtttactaaagtcatcccggccagagaaggcctcaacgaatatttgataaatacaaagacaaatccctcagcccagactcagcttctgccttggatctcttccccatccctgcttcagaacagaacccaggccagactcaccgcagggtctccaggaggcagcgagggcgtctcagggtcttacaaagactcttcactgcagagtggctcagcgagtttccacttaggtccagctccttcaggtttctggtgaccttgaggacggagaagagaatctgccaataggcatctgtgactgggacccacctgaacctgagggggagagagaaggacaggagagatgtgatgtgtctggcaggggtttgaggtgcccagccctgcacaacacagttgggctttgtccccctgagcaccaggccacagcgggtagtgccatctccagtactgaccagccctccctgcctgtctgcccgtcacccagggctaggtccctctcctccatgtggctcctcattctacagcccttaccatagcacactgaagtgttcaccttgtgtgtctgtttctgcctcagtctgggagttccttgagggcagggacagacatttgtctttttttttttttttttaaatctgcactgctcagcatagggcctggcctcggtgctgagcactgcagataagaaaaaaattttttaaaaaaatttgacaattttaatttaaaaaaaatttgacagccttcctccctttgatgcagacacacctgtgttcctttggcacagacattctggagtcccagtgcccaggaaagaagacgggaggcagtagcagagcctgggagagatggcctgaggatgttgtgatggaagactgtatatgatcatatgcactgctgtccaggttggctcacatgggaccctatccccttcccaggataacaagagggtctgcaggagagggatggctgtggggagtgccctaggagagaatatttgcagcctgaggggaagagatgacgggctttgtctgagggtgttagagtagactccgactcatggaatttccacccatttaatctgttttcacacactactttagtgacctcatctacctccaaggcttcaactactcaaatctctattccaagtttcagactgagttttctattttctggttggatatccccaccttgacatcccagtaattctttgatctaatttgtcccaacaagtccccaacctgaattcatcttttcccctaagtctgcagagccatgtgggggcaagaagcagaggcaaggagctgcctgcatgtgggctctgcttctctatccctcactccgtctcctccgctgcaaaaagaggacagcaatagcacctgctgcagaggggtatgtgagaattaaaagctactaaagagtatcccaaaagtcctagagcagttttaagttttaataactgtgaaagtacaagtactacaaacatataaaaaaagccagctgagtgcagtggctctagcctgtaatcccagtacttgaggaggtagaggcaggaggatcgattgagcccaggagtttaagaccagcctgggcaacatagtaagatcctgtttctacaaaaaataaaaaaaattaggcaatgtggtggtgtgcacctgtagtcccagctactcaggaggctgaggcaggagaatggcttgaacctgggaggccaaggttgcagtgaggtatggtcatgccactgcactattcctgggagacacagtgagatcccatcacacacacacacacacacacacacacacacacacacacgaaaaaaagccataaatgaaagcttacttgaatttcttttacacttacttagttttgtgaaacttgaaaaatacattttaaattttttatttccgttggcatttgccatccttaatcaaggtgactgaaaaaaaattaaaaatttatacttgaaaatgcacaatgcttaatcacatgccaaacacctggaagctcccatcctgtcatcttcatttctttaatatctctggttggttctcctcttccttcacacagcccttggccaacctccaccctttcttcctgaactttcttgttttttttatagtagcttccttattcttctctctgccttgtctagctgattcagttccttgaaaatttctcctcccacttgtggctgaagcctctgactttcccacggcattctcttaaggctccacttgctcccgcccatcccaaactctcctctctggcctggtgttcttggttccctttgcctatcccagcccccatcccccggccagccaccatctggtctctgcctctagctgcttggaactctttgaagatttcccacctgtccactgctacttgcagtacctgtatccaggtcctttaaagcctacctcacatttataactatgaacaactagaagcagcttaaaatggccaagaacaggagaatggtcaaatcagccatggcactttccctatggaatagcatgtggtcattcaaaatggtgttgtatcagactacttaaaaatatataaagggctggcatggtggctcatgcctgtgatcccagcactttgggaggctgaggcagaaggatcatttgaggtcaggagttcaagaccaacctggccaacatggtgaaaccccgtttctactaagacgacaaaaaattagctgggtgtggtggtgcgtgcctgtaatcccagctactctggaggctgaggcatgagaattgcttgaacctgggaggcagaggttgcagtgagcagagatcgtgccaccgcatgccagcctggtgacagagcaagactctgtctgtctctgtctctgtctctctctctacacacacacacacacacacacacacacacacacacacacacacacatgaagggctgggcatggtggctcacatctgtgatcccagcactttgggaggtcaaggtgagcagcttgcttgagcccaggagtttgagaccagcttggtcaacacagtgaaatctcatctctatacaaaaaatatacaaaaattatcgctgcatgttggcatgctcctgtagtctcagctcctagcggggctgaggtaagaggatcccttaaactcgggtggtccaggctgcagtgagctgtgattgcaccactgcactccagcctaggggacagagcgagactccgtctcagacaacaacaaaccaaaaaaaaaaaaaaataccccacacccactcacaagaagatagccttgatatataaagaaaataaaactgactataaaataaaatgtacaatatggttcgatttcgccatagacatgtgcacagaaaaaagactggggttcttacaattgaccactaattttttttttttttgagactgagttttgctctttttcccaggctggagtgaagtggcacaatctcagctcactgcaacctctgcccctgacctgtcaagtgattctcctgcctcagcctcctgagtagctgggattacaggcgcctgacaccattttcggctaatttatgtatttttagtagagatggggtttcaccatgttgaccaggctggtctcgaactcctgacctcaggtgatccacctgcctcggcctcccaaagtgctgggattacaggtgtgagccaccacacccagccaatttttaatgatggttattacagaatgatggaattcttattgatactatttttcatctttttgcttatctacgttatcttttgtttgtttgttttttgagacggagtctggctctgttgcccaggttggagttcagtatcacgatctcagctcattgcaaactccgtctcccagattcaagtgattctcatgcctcagtctccctaatagctgggattacaggcgtgtgccaccatgcccagataatttttgtattttttggtagagatggggttttgccatgttggccaggctggtctcgaactcctggcctcaagtgatcctcctgcttcagcctcccaaagtactggaattacaggtgtgagctacttcacccagcctacatatctttttttttttcctataatgaacatgaattttattgtgagaaaaagttttaaaaatataaatatgaaggcccacatcaaacatttcttcctctgagaatctttattacccactcgtgtgatcactcccttccttgggccaccacagtaccttgtccatacctctactgttgtagacatcacactctgttgtcattaaatgaatgtttgtcttctcccctattttttgagctccttaaggcacgtattgtgctttttaatctgtgatctgtagggcctggcatagaatcagtgcttaataaatacttatggaatgaatcatctaaagcaggacatagacacataccaatagcatgtgatcgataccacgacagaggtcggggaaccgggatggggaagttctcagtactgccgggctggagaatggttggaggaagctattcttgcacagccagagagtgggtttcaggttgagtgcgtggggcaatggtggcaccacggtcacaaataattatgaagtcagttttgcagggaaaaataggaaactctttttgagagctgatggggaagatctcagggccaatgtcgttgtcatggaaagggttcctgaagcagctggaggagcaatttctccgagagaatgaatgcccagagagaggagcaggggtaggggggctgcctgatccttggggagtgtgggggtagctaaggtcagcaggaaggtgggagcacgtccaggagagaagatggacggtcattctaagggtaggaggagaggtggcagacacggcagggcccagtggcctctccagaagcaagcagggcctgccccacagccgggcactgcagaggagcttaggtagacagagcatggtggtcagattgggcagttagaagtcactggagaccctgatcctttagccacccccacccccggccaggctcagtgagcatgcctctggtgctcaggtcactcgggcttatggactgacagaggagctgcagacatgggtggtttgggtactcacaggactaccatggtggggctccatgttgatctgtgctgcctgccctcaatcagctgaagcttcttcacgtggcggctgaatttaatgcagaaagtgcacactaagagctccatgtctgtttctacacacatgcccatttcttcgaaatgggccatcacttgtgtcaggaacgttttgttccgagtctcgtacaagcagtggagggactccagagagtgtggctgcagcagcagctgcagggacgggacccactgcatcaggttcctcccctgagacagccggcagtgaaagatgttctccatctctctctccccctcatcacttaacaggcccaataggaaacgtgtggttgatgccccaaacaggccatgtattccatatgcttctagcgtcttttccaaatctatgatgcaattagaatgtttacctctccccttctcatcctccaagacataggacattgctgcaaagaactcttggaaacagaggtgaatgaagctgtagctcagagggatggggtgctcttgaagaatacccatcttcaagaaggtggagatgatggccccatctaacccatgcttcctgaggtcatctggactgaaaagggtctttttttgccagatgccctcagcagccagagagcagaggtctctgagctggggtcccaatggctgagcttggagagcctgggcaaggtaatgtagacagagggttgtggtggtcttggaagtcagtgtgagtttttccttccgcttcatctgctgcatcaggcaagtgcaggccagccaggacacccagggcacaagacacagggcccagagctctttgtttgatttgaccaacctaaaggctctaattgcttgcctttcatctgtgaaatatctgtagaaatattccttcctgctggactcagagaaccccaggacctctacccaacgtgcctgctccaaagaaggaatgaggttctgcagagctgtggtccgagccgtgatcaggaaggatgcctcgggaagtatagttttccccagcaaactgcccagcagtgcatccgccggctgtggctggctccagtgcagacagagctcagaactcggctcctgcaagacccatcctggctcatctacaccatcgaggatgaagagcagccgctctggcctagacaggatctgtctaatgggagccggagtggctgtcccatcttttccgatgagctcagcgagactcaccaccttggactgggccagctctctgcagctgaagtagaagacatgctggaagcggtccccatacagctggcctctcccccaggcttccttcacctgcctggccagtgttgacttcccaattccagcagccccctgcagtatgactatgcgaggttcttgggtatccaggcctgggccaaataagtctctgatctcaattaaatgtcctcgattctcctccacataatcaggccagcttctcttgaccaggggatcttggcttctggggtgaggtctttgtagaagtagcagctgtgtgaatttttggttaaaatcctcatttttccagggccatgtggaacagaggctctctctcacagaaggctcccatgggtggtggtggggctgtaggctggtgtgcgcctgtgggggcgttcctaccaccgctgcccatgggggcctgcctttctctgatttctctctctctctttctctgatttctaagtaagggagggaaagaaggaacataaaggtagagaatagaagaattaattaattaattaaacaactgttttaggcacctactccaagccacacactgcgctgtctgcagacactggtatgttcttgccatgcggcggaaggacatgtgctttggggtagaatatcccagttcaagtcttgactcaactaagtcacactccctgaatgactttccttcactgaatatttatcaagggcttactctgtgccaggtgctgctataggggttggggataaagagtgaacaaaacagacacaactctcagtcctcactaagcttatgatgctggccattagcccctatgagcctcagttttctcatctgtaagctgggggttgtaggtcatggaggactggaggagacactggagtgtgtagcagatgctgacagcatcccaagcacctgctattgcagtacctgccaatggtgtccctcggcaacagctgtggtcatctgtctgagggctctttctctgcctgtaagccgggtgggccagaaatactggaggatagttctccagtccaggaggtgcccttagtggatgacaggtggggtcccttgcccccaggacagataacactcaggcatgttctcaccgtctcccagacaaccgcagcagcatggagcctcagttgctcacaaggtaacctgttccataatctacctttcctgggtttccccgcctcaccattctctcttgttgatgagtccaagaaatcacctccccagtaagccacctgcaaccaaatccggtctcaggcttccgggcgagcccgacctgagactgatggaagatacctcatgacctgtgagaagctgaggttatatacaccattgtttcccagggagggacctcaggctcctatcttagtcagattccaaatagaacaacagttacaacctcttctgttcttttcttcacaatatgttcagtgcctctcccttctctccttaggtgaatttcattttattttatttatttttttgaggcagagtttctctcttgtcacccaggctggagtgcagtggcacgatctcggctcaccgcaacctccgcctcccagggtcaagcgattctcctgcctcagcccccagagtagctgggattataagtacccgccatcacgccagctaatttttgtatttttgtagagatggggtttcaccatgttggccatgctggtctcaaactcctgacctcacgtgatctgcccgcctcagcctcccaaagtgctgggattacaggcatgggccactgcacccagcctactatcttgtcttttactcaaacaagttttcctacctttgctcttgatagatcaaaaagcatgccatgtggttttttttttttttttttttttttttttgagacggagtctcgctctgtcgcccaggccggactgcggactgcagtggcgcaatctcagctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccccatgtggtttttatacttgccatgaaactgttctttgggatattattttgttcaggttccccacttggacagcagagggggtgactctgcccatccctgccactggtagccaggcgggcaatgtctgctagcagtctgcttctgtctgaactcagccagcagaggcaaactcccggttccccgagaaacactctgaaggcagggtgggtgactccacccaccaccgcctctcctagccatgcaggccatgtctgctagagcttccagcgcagtggtcctaattctgtctgaatccggctgaggggtgcagcctcctgttactgcccagggaaacacccagatggcagggtgggtgactccaaccacctctgcctgtggtagccagatgggccacacctgctagagcttccagcccagcagtcccgctactctgtgggtgggtgccatcccctgttcctctgggaagcacccagacagctgattacgtgaccccacccacttctgcagatcctagctgagcaggacttgctggtttggacaatgcccaagcagggaagagccctcattctcttatcactgacagaggtgagatgtccgagtttgtaggctggtggaggagtgaggtggaggaggtatgcctctctctgcagggcggacccagcaaggatacggcctgtctgccaaccacggcccctgcctgaaggaaccccgtttaccagaacacccaacaaaagaaatgcaggtgtggagccagtaatcagaagggtcttgtctaaggcccaggagtggactaagtgagaaggtcacccccctgtccccaacacacacagaacactactgccaactgtactgaaacatgaagaaccacgcagcagagtaagagtgtatctcctggtgatcactcttaagcactgcctactggatggcggccccaaaatacaacaccaaaatgttttgcagtattcagtgccatgaaaactaaggcaaaggctcccaccagtgccctgccccagccaacacacacgcaccctgccatgccactgtggctggtgccatgtgtgagtgagcacagatcctgctggcactgccacaaggaagcactttggcctgcacccccactggactgttgaggccagcggactgggaacaccttggcccctctaatgcagcaggttctgaaccccaggaggccagaggaaaaggctggggacccagtaccagccttctagagttagagcaggcagctcaggagtgctgagctgagccttggccacctgaaatcttccagaatcgaagccagttgactgaacccaccttatacgacaatcaaacccccaagggcttcaaacaagataaaaacaaaacaaaaaaaaccccatccaaaggaagacaacttcaaagattaaaggaacatcagcccacacacacgagaaagaaccagctcaagagctctggtaactcaaaaagccacagtgtcttcctatctccagatgtgtgcactagtgcctcagcaatggtattttaacaggctgaaatggctgaaatgacagacatagaattcagaatatgagtaggaatgaagatcattgagattcaggagaaagtcaaaatccagtccaagcaatctaaggaatatgataaaatgatacaggagctgaaagacgaaatggtcattttaggaaagaaccaaactgatctgatagagctggaaatctcactacaagaatttcataatacaatagcaagtattaacaacaggatagaccaagctgaggaaagaatctcagagcctgaagactggttctccaaattaactcagtcagacaaaaataaaaaagaatgaaaacaaatgaacaacacctctgaggaatatgggattttggaaagagaccaaatctatgactcgctggcatccctgaaagagcatgagaaagccagcaacttggaaaacgtatttgaagatattgtccacaaaagtttccccaacctccctagagaagccaacatttaaattcaggaaatgcaaagaatccttgtgagatactatacaagacaatcatccctaaaacacatagttctcagattccccaagtcctcagattctccaaggccaacatgaaagaaaaaacaataaaggcagctagacacagaaggggcaggtcacctaaaaagggaacctcatcaggctaacagtgaacttttcagcagaagccctgcaaggcagaagagattgggggcctatattcagcatccttaaagaaaagaaattccagccaataatttcttttcttttttaaaattttaaaattattttttaaaaattttgtggatatgtagtaggtgtatgtatttatggggatccatgagatggtttgatacaagtaagcactgtaaaataagcacatcatggagaatggggtatgcagctcctcaaacatttaacctttgagttacaaacaatccaactatattctttgttattaaaaagtatacaattaatttattattgactatagtcaccctattgtgctatcaaacagtgggtcttattcattctttctatttttttgtacccactaactatccccacctttccctcttgccccccactacttttctcagcttctggtaaccatccttctgctctctatgtccatgagttcaattgatttgagttttagatcccacaaataagtgagaacatgtgatgtttgtcttcctgtgcctggcttatttcacataacgtaatctccagtttcatccatgtttgttgcaaatgactgggactcattctctttgatggctgaatagtatgtatatgcaccacgttttctatatctgttcatctgctgatggacacttgggttgcttccaatcttggctattataaacagtgctgccacaaacatagaagtgcatgtatctcttcgatattctgatttcctttcttttggatgtataccctgcagtgagattgctcaatttttagtgttttttttttttttttttttttagacagagtcttgctctgttgcccaggctggagtgcagtggcgcaatcttggctcactgcaagctccgcctcctgggttcacaccattctgctgcctcagcctcccgagtagctgggactacaggtgcccgccactgcacctggctaattttttgtgtttttagtagagatggggtttcactgtgttagccaggatggtctcaatctcctgacctcatgatctgcccacctcggcctcccaaagtgctgggattacaggcatgagccactgcgcccagccaatttttagttttttgaggaaactccaaactgttctccatagtggttgtactaatttacgttcccaccaacagtgtatgagagtttccttttctccacaccctcacaagaatttgttcttgcctgtcttttggataaaagccattttagctggggtgaggtgatattgcagttttcatttgcatttctctgactatcagtgatgttgaatgccttttcatatgcctgtttgccatttgtatatcttcttctgagaaacgtctattctaatcttttaactattttttgatcgaattttagattttttcctatagagtcatttgagctccttatatattctggttattaatcccttgtctgaagggtagtttgcaaatactttctcccattctgtgggttgtctcttcactttgtttattgtatccctcactgtgcagaagctttttaacttgacatgatcttgtttgtccatgtttgctttggttgcctatgcttgtgtgttattgctcaagaaatctttgcagaccaatgtcctggagattttccccaatgttttcttgtagtagcttcatagtttgaggtcttagatttaagtttttagtcaattttttgatgtgtttttgtctggttttggtattaaggtaatactggcctcagagaatgagtgtggtaatagtccttcctcctctattttttcggagtagtttcagtaggactgatactagttcttcttaaatgttgggtagaatttcagcagtgaagccatccagtccttggcttttcttcactgtaaggctttttattacggcttccatgttgttacttgttattggtctgtttaggttttggatttcttcctagttcagtcttggtaggctgtatgtatctagagatttgtccatttcttctagattttccaatttattggcatataattgctcatagcagccactaatgatcccttgaatttctgcagtatcagctgaaatgtttcctttttcatttctgattttatttatttagatcttctctctttttttcttagcttggctaaaggtttgtcgattttaacttttcaaaaaatcaactttttgtttcattgatcttttgtattttttctttttaatttcatttatttctgctctgatctttgttatttcttttcatctactaatagtgggtttggtttgttcctgcttttctctctttaagatgcatcattagattgtttatttgaagtttttcctcttttttgatataggcacttatagctataaacttctctcttaatatatcccataggttttggtatattgtgtttccatgatcatttgtttcaagaaatttttctttctttattttgttcttaatttcttcattgacccactggtcactcaggagcatattgtttaattttcatgtatttatgtagttttctaaattcctcttattattaatttctaattttattgcattgtggtcagagaagatgcttgatattatttcaattttttgaatgttttaagacttgttttgtgagctaatatatggtgtatccttgggaatgatccatgtgctgaggaaaagaatgtgtattctgcagctcttggatggaatgttctgtaaatatctattagatccatttggtctgtaatgcagattaagtttcatgtttctttgctgattttctgtctggaagatacgtccaatgctaaaagtggggtgttaaagtctccagctattattgtattgaggcctatctctctctttagctctaataatatttcctttacatatctgggtgttcctgtgttgggtgcatatatatttaaaattgttatatcctcttgctgaattgactccattatcattatatagtgaccttctttgtctctctttgtatagtttttgttttgaaatctattttgtctgatacaagtatagtgacttctgctcttttttgttttccactggcatgtaatatatttttccatcacttcattttctgtttatgtgtgtctttataggtgaaatgtgtttcttgtagggaacagatcattggttcttgttttttcattcattcagccagtctatgtcttttgattggatagtttaatccatttacattacttattattgataagtaaggacttactcttgccattttattatttgttttctgcttgttttgtgatcttctcttctttcttttattcctgtcttcctctagtgaagatgattttctctggtgatataatttggtttcttgatttttattttttgtgtatccattttatgttttttggtttgaggttaccatgaggcttgcaaataccatcttataatctattattttaatctgataacaacactatttggataaacaaataaacaaacaggcagaaagaaaactaataaaaacttaacttcatttcccagctttttaaactttttgttgtttctatttatatattattttactgactgtgtcttgaaaagttgttgtagttattatttttgattggttcatcatctagtctgtctacttagggtaagagaggttatacaccacagttacagtgtaaaaatattctgtgtttttcggtgtacttactattatgagtaagtttcttaccttcaggtgatgattgctcattaatgttcttctctttctgattgaagtactccttttagcatttcttgtaggatgggtttggtattgatgaaatccttcagcttttgtttgggaaaatctttatttctccttcatgtttgaaagatattttcaccagatatactatttagggtaaaagttttctttccttcagaactttaaatatgtcatgccactctctcctggcctgtaaggtttccatgaaaagtctgcggccagatgtattggaactccatagtatgttacttgtttcttttctcttgctgcttttaaaatcctttctttatccttgacctttgggagtttgattattaaatgccttgaggtagtctactttgggttaaatctactcggtgttctaaaaccttcttgtacttggatatctttccctaggtttgggaaattttctcttatccctttgaataaaacttctactcctatttctttcactacctcctccttaaggccaataactcttagatttgccattttgaggctattttctagatcctgcaggtgtgtttcattgttttttttattcttttttcttttgtcccttctgtgtattttcaattatagcctgtcttcaagctcactaattctttcttctgctggatccattctgctatgaaaggactctgatgcattcttcagtatgcaaattgaattttttcagctccagaatttctgtttgattatttttaattatttcaatctctttattacatttatctgctagaattctgaattccttctctgtgttatcttgagtttctttgaatttcctcaacacagctattttgaattctgtctgaaaggtcacatatctctctttctccagaattggtccctgatgccttatggtgaggtcatgttttcctggatggtgttaatgctagtagatgttcttcagtgtctgggcattgaagagttgagcatttattgtagtcttcactgtccaggcttatttataggcagcctttttggaaaggctttccagatttgaaaggacttgagttttgtgatctaaggcatttctgctttagagggcaccctaagcccagtaatgctgtggttcttgcacagtcatagaggtaccaccttaatagtcttagacaaaatctggttgaattatctaggttaccaggcagagactcttgttctctttccttactttctgccaaacatacagtctctgtctcttctaagccacctaaagccacctttaacctcattagaaagtgacacaagcacccccgtggccacctaccactatgactgtgctccaaccaagaatttcatatacagccaaactaagccttataagcgaaggagaaataagatccttttcagacaagcaaatgctaagggaatttattaccaccagacctgccttacaagaggttcttaagggagtgctaaatatggaaacaaaagaccatcactggccaccataaaacacactaaagtacacagtccactgatactatcaagcaactacaaaatcaagtctgcaaaataatcagctaacaacatgatgacaggattaaactcacacatatcgatattaatccaaatgtaaatgggctaaatgctcccattaaaaggcacagagtggcaagttcaataaagaagcatggcccaactggatactgtcttcaagagatccatctcacatgcaatgacattcataggctcaaagtaaagggatggggaaaaatctaccaagcaaatggaaaacaaacaaaagcacggattgccattctaatttcacacaaaacagacttcaaatcaacatcaatcaaaaaagacaaagaaaggcatcacataataataaagggttcaattcaacaagaagacttaactgtcaggaatatatatgcatccaatacaggagcacccagattcataagacgagttcttagagactgatgaagagacttagataaccatatagtaataatgggagacttcacccactgacagtattgaacagatcatcaaggcagaatactaacaaagatatttgggacctaaattcgacacttgaccaaatgggcctaagagacatctacagaactctccaccccaaacaacagaatatatattcttctcatttgcacatggcatatactgtaaaatcaaccacacaatctgccataaaaagttctcagcaaattttaaaaaacccaaatcataccagccacactcttggaccactgcacaattaaaaaaaatcaatactaagaagatagctcagaaccatacaattcatggaaattaaacaacctgctcctgagtggcttttgggtaaacaatgaaattaaggcagaaataaagaaattctttgaaaccaattagaacaaagatacaatatgccaattctctgggacacagataaagcagtggaaagtttatagcagtaaatgcccatatcaaaaagttagaaaaatctcaaattagcaacctaacatcacaaatagaagaattagaaaaacaagagcaagatcaatcccaaagctagcagaagacaagaaataaccaaaatcagagctgaactgaataaaattgagatggaaaaaaccatacaaaagatcaacaaaaccaaaagttcattctttggaagaataaataagatcgatagaccactagctagactaataaagaaaaaaaaaagacagaagatccaaataaacacaaccagaaatgacaaagaggacattaccattgaccccgtggaaatataaaaaaccctcagagactattacgaacacctctatatacagaaactagaaaaacctacaagaaataaattcctaggactgaaccaggaagaaattaaaactctgaacagagcaataacgagttctaaaattgaatcagtaataaaaattctaacaaccagaaaaaggccaggaccagagagattcacagctgaattctaccagacacataaagaagagctcgtacaatttctactgaaactattccaaaaaattgaggaggaggggactcctctctaactcattctatgagttaggtatcattctatgagtttggtatcattctgataccgaaacctggcagagacacaacaaaagaagaaaacttaaggacaatatctgtgatgaacatagctgcaaaaatcttcagcaaaatactagcaaactgaatccagcagcacgtcaaaaagcgaattcaccacaaccagataggttttatctctgggatgcatgtttgattcaacatatgcaaatcaataaatgtgatctatcacataaatagaagtaaaaaagcccccacatgatcatctcaatagatgcagaaaaagcatttgataaaattcaacatccttcaatgttaaaactctcaacaaactagacattgaaggagcatacctcaaaataataagggccatttatgacaaaaccacagccaacatcacactgaatgggcaaaagctggaagtattctccttgagaaccagaacaagacaaggatgctcattctcaccatctattcaacatagtactagaagtcctacccagagcaatcaggtaagagaaagaagtaaaagacatccaaataggaggagaggaagtcaaagtatctctgtttgcagatgttatgattttatacctagaaaacctcctagtctctgtcccaaatctgctagatctaataaacaacttcagcaaagtttcaggatacaaaatcaatttcttctattgggtagtaagtattatgtaacattgtgcaataagcaccaaatcaagaatgcaatcccattcacaatagccacaaaaaagtacctaggaatacatctaaccaggattgtgaaagatctctatagcaagaactacaaaacactgctgaaagaaatcagagatgatacacacacaaatggaaaacattccatgctcatgaataggaataatcaatattgttaaaatcgccatactactccaagcaatttacagattcaatgctattcctagcaagcaaccaatgacattcttcacataatgagaaagaaattctaaaattaatatggaaccaaaaaacagcccaaatagccaaagcaattctaagtaaaaaataacaaatctggaggcatcacattacctatttttaaactatactacaaggcaacagtaaccaaaacggcatgctactggtacaaaaacagacacatagaccaatggaacagaataaaatgcccagaaataaagctgtatatctacaaccatctgatctttgataatgttgacaaaaacaagcaatggggaaagcattccctattcaatacgtgatgctgagataactggctagccatatgcagaagactgaaactggaccccttcctgatactatatacaaagatcaatggaagatggatgaaagtcttaaacgtaaaacctagaactttaaaaacccttgaagaaaacttaggaaatactattctgaacataggtcctggcaaaaatttcatgaggaagatgccaaaaacaattgcaatgaaaacaaaaattgacaaatgggacctaattaaactagagaacttctgcacagcaaaagaaactacccacaaagtaaatagacaacccacagaatgggagaaaatatttgcaaactacccatctgacaaagttggaatatccagaatctataaggaacttaaacacattaataagccaaaaacaatcccattaaaaagtggacaaatggccaggcatggtggctcatgcctgtaatcctaccactttggggactgaggtggacagatcacttgaggtgaggaattcgagaccagcctggccaacagaccatctctactaaaaaatacaaaaattagctgggcgtagtggtgcacacctgtaatcccagctacttgggagggtgaggcaggagaatcccttgagcccgtgaggtggaggttgcaatgagcagagatctcaccactgcattccagcttggatgacagtgtgatactttgtctcagaaaaaaaaaaaaaaaaaagtggacaaaggacaccaatagactcttcaaaagaagacatacacatggccaacagcatatgaaaaaatgctcaacatcacttattattagcaaaatgcaaattggggtggttccaagatggccgaataggaacagctccggtctacaactcccagggtgagcagcgcagaagacaggtgatttctgtatttccaactgaggtaccaggttcatctcactggggcttgtcagacagtgggtgcaggacagtgggtgcagcccaccgagcataagccaaagcagggcgaggcattgcctcacctgggaagtgcaaggggtcagggaattccctttcctagccaagggaagctgtgacagatggcacctggaaaattgggtcactcccaccctaatactgcacttttccaacggtctttgcaaacggcacaccaggagattatatcccgtgcctggctcagagggtcctgtacccacggagcctcacttattgctagccagcagtctgagattgaacagcaaggcggcagtgaggcggggggaggggtgcccaccattgctgaggcttgagtaggtaaacaaagcagctgggaagcttgaactgggtggagcccaccgcagctcaaggaggcctgcctgcctctgtagactccacctctgggggcagggcatagccaaacaaaaggcagcagaaacctctgcagacttaaatgtccctgtttgacagctttgaagagagcagcggttctcccagcatggagtttgagatctgagaacagacagactgcctcctcaggtgggtccctgacccccgagtagcctaactgggaagcacccccaagtaggggcagactgacacctcacacagccgtctacctctctgagacgaagcttccagaggaaggatcaggcagcaacatttgctgtttagcaatattcgctgttcttcagcctctgctgctgatacccaggcaaacaaggtctggagtggacctccagcaaactccaacagacctgcagctgagggtcctgactgttagaaggaaaactaacaaacataaaggacatccacaccaaaaccccatctttatgtcaaagaccaaaggtagataaaaccacaaagatggggaaaaaactgaccagaaaagctgaaaattctaaaaatcagagcgcctctccccctccaaaggaacatagctcctcgccagcaatggaacaaagctggacggagaatgactttgatgagttgagagaagaaggcttcagaagatcaaacttctccgagctaaaggaggaagttcgaatccatcacaaagaagctaaaaaccttgaaaaaagattagacaaatggctaactaaaataaccagtgtagagaagtccttaaatgacctgatggagctgaaaaccatggcacgagaactacgtgaagaatgcacaagcttcagtagccaattcgatcaactggaagaaagggtatcagtgattgaagaccaaatgaatgaaatgaaggaagaagagaagtttagagaaaaaagagtaaaaagaaacgaacaaagcctccaagaaatatgggactatgtgaaaagaccaaatctacatctgattggtgtacctgaaagtgacggggagaatggaaccaagttggaaatcattctgcaggatattatccaggagaacttccccaacctagcaaggcaggccaacattcaaattcaggagctacagagaacaccacaaagatactccttaagaagagcaactccaagacacataattgtcagattcaccaaagctgaaatgaaggaaaaaatgttaagggcagccagagagaaaggtcgggttacccacaaagggaagcccatcagactaacagtggatctctcggcagaaactctacaagccagaagagagtgggggccaatattcaacattctttttttttttttttttttgagatggagtctcgctctgtcacccaggctggagtgcagtggcataacctcggctcactgcaagctccgcctcccaggttcatgccattctcctgccttagcctcctgagcagctgggactataggtgcccgccatcacgcccggctaattttttttgtattttttagtagagatggggtttcaccatgttagccaggacggtctcgatctcctgacctcatggtctgcccatctcggcctcccaaaatgctgggattacaggtgtgagccaccacgcctggcaatattcaactttcttaaagaaaagaattttcaacccagaatttcatatccagccaaactaagcttcataagtgaaggagaaataaaatcctttacagacaagcaaatgctgagagattttgtcaccaccaggcctgccctaaaagagttcctgaaggaagcactaaacatggaaaggaacaaccggtatcagccactgcaaaaacatgccaaactgtaaagaccaccaatgctaggaagaaactgcatcaactcatgagcaaaataaccagctaacatcataatgacaggatcaaattcacacataacaatattaaccttaaatgtaaatgggctaaatgctccgattaaaagacacagacagggaaatgggataaagagtcaagacccatcagtgtgctgtattcaggaaacccatctcacgtgcaaagacacacataggctcaaaataaagggatggaggaagatctaccaagcaaatggaaaacaaaaaaaggcaggggttgcaatcctagtctctgataaaacagactttaaaccaacaaagactaaaagagacaaagaaggccattacataatggtaaagggatcaattcaacaagaagagctaactatcctaaatatatatgcacccaatacaggatcacccagattcataaagcaagaccttagagacctacaaagagacttaagactcccacacaataataatgggagactttaacacccccctgtcaacattagacagatcaacgagacagaaagttaaaaaggatatccaggaattgaactcagctctgcaccaagggacctaatagacatctacagaactctccaccccaaatcaacagaatatatattcttctcagcacacattgcgcttattccaaaattgaccacatagttggaagtaaagcactcctcagcaaatgtaaaaggacagaaattataacaaactgtctctcagaccattcagtgcaatcaaactagaactcaggattaagaaactcactcaaaaccgctcaactacatggaaactgaacaacctgctcctgaatgactactgggtacataacgaaatgaaggcagaaataaagatgttctttgaaaccaatgagaacaaagacacaacataccagaatctctgggacacatttaaagctgtgtgtagagggaaatttatagcactaaatgcccacaagagaaagcaggaaagatctaaaattgacaccctaacatcacaatagaaagaactagaaaagcaagagcaaacacattcaaaagctagcagaaggcaagaaataactaagatcagagcagaactgaaggagacagagacacaaaaaacctttcaaaaaatcaatgaatccaggagctggttttttgaaaagatcaacaaaattgatagaccgctagcaagacgaataaagaagaaaagagagaagaatcaaatagatgcaataagaaatgataaaggggatatcaccaccgatcctacagaaatacaaactaccatcagagaatactataaacacctctacacaaataaactagaaaatctagaagaaatggacacattcctggacacatacacccttccaagactaaaccaggaagaagttgaatccctgaatagaccaataacaggctctgaaattgaggcaataattaatagcctaccaatccagacggattcacagccaaattctaccagacgtacaaggaggagctggtaccattccttctgaaactattccaatcaatagaaaaagaaggaatcctccctaactcattttacgaggcaagcatcatcctgataccaaagcctggcagagacacaacaaaaaaaaaggaattttagaccaatatccctgatgaacattgatgcaaaaatcctcaataaaatactggcaaaccgaatccagcagcacatcaaaaagcttatccagcatgatcaagtgggcttcatccctgggatgctaaggctggttcaacatacgcaaatcaataaatgcaatccagcatataaacacaaccaaagacaaaaaccacatgattatctcaatagatgcagaaaaggcctttgaaaaaattcaacagccctacatgctaaaaaccctcaataaattaggtattgatgggatgtatctcaaaataataagagctatttatggcaaaccgacagccaatatcatactgaatgggcaaaaactgcaagcattccctttgaaaactggcacaagacagggatgccctctctcatcactcctattcaacatagtgttggaagttctggccagggcaatcaggcaggagaaagaaataaagcgtattcaattaggaaaagaggaagtcaaattgtccctgtttgcagatgacatgactgaatatttagaaaaccccatcgtctcagcccaaaatctccttaagctgataagcaacttcagcgaagtctcaggatacaaaatcaatgtgcaaaagtcacaagcattcttacacaccaataacagacagagaaccaaatcttgagtgaacttgcattcacaattgcttcaaagagaataaaatacctagcaatccaacttacaaaggatgtgaaggacctcttcaaggagaactacaaaccactgctcaatgaaataaaagaggacacaaacaaatggaagaacattccatgctcatggataggaagaatcaatatcatgaaaatggccatactgcccaaggtaatttatagatttaatgccatccccatcaagctaccaatgactttcttcacagaattggaaaaaacgacttaaaagttcatatggaaccaaaaaagagcccgcactgccaagacaatcctaagccaaaagaacaaagctggaggcatcatgctatctgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaagaaatggggaaaggattccctatttaataaatggtgctgggaaaactggttagccatatgtagaaagctgaaactggatcccttccttacaccttatacaaaaattaattcaagatggattaaagacttaaatgtcagacctaaaaccataaaaaccctagaagaaaacctaggcaataccattcaggacataggcatgggcaaggacttcatgtctaaaacattcaaagcaatggcaacaaaagccaaaattgacatatgagatctaattaaactaaagagcttctgcacagcaaaagaaactaccatcagagtgaacaggcaacctacagaatgggacaaaatttttgcaatctactcatctaacaaagggctaatatccagaatctacaaagaactcaaacaaatttacaagaaaaaaacaaacaactccatcaaaaagtgggtgaaggatatgaacagacacttctcaaaagaagacatttatgtagccaacagacatatgaaaaaatgctcatcatcactggccattagagaaatgcaaatcaaaaccacaatgggataccatctcatacaagttagaatggtgaatattaaaaagtcaggaaacaacaggtgctggagaggatgtggagaaataggaacacttttacactgttggtgggactgtaaactggttcaaccattgtggaagacagtgtggcaattcctcaaggatctagaactagaaataccatttgacccagccatcccattactgggtatatacccaaaggattataaatcatgctgctataaagacacatgcacacgtatgtttattgtggcactatttacaatagcaaagacttggaaccaacccaaatgtccatcaatgatagactggattaagaaaaagtggcacatatacaccatggaatactatgcagccataaaaaaggatgagttcatgtcctttgtagggaaatggatgaagctggaaaccatcattctcagcaaactatcgcagggacaaacaaccaaacaccgcatgttctcactcataggtgggaaatgaacaatgagaacacctggacacaggaagggcaacatcacacaccagggcctgtcgtggggttggaggaggggggagggatagcattaggagatatacctaatgtaaatgatgagttaatgggtgcagcacaccagcatggcacatgcatacacatgtaacaaacctgcatgttgtgcacatgtaccctagaacttaaagtattaaaaaaaaaaaaaataagatcaccctccctgatgtgggtggctctcattccatcagttgaaggccagaatagaataaaaaaagagaccttctctggaaaaaaagaaaaatgcaaatcaaacccataatgaggtactattctacaccagtcagaatggctataatttaaaagtcaaaaaataacagatattggtgagattgcagagaaacaggaacacttatacactgctggtaagaatgtaaattagttcagccactgtggaaaggaatttcgcgatttgccaaagaactctgaactatcattcaatctagcaatcccattattgggtatatacccaaaggaatgtagagcattctaccataaagatgcatgtacatgtatgtttattgcagcactagtcacaatagcaccagtatggaatcaaccatactgctaaagaaaatgtgggacatttacacatggaatactacacagccataaaaatgaatgaggtcatgcctttgcagcaacttgaatggagttggagagcattataagtgaactaacacaggaacagacaatgaaataccgcatgttctcattcataagttagaggtaaacattgcgtacacatggacacataaaaggaacaatagacactgggaccttttgagagtgaagagtgggagaagggtaaggattaaaaaactaccgggccgggcgcggtggctcacacctgtaatcctagcactttgggtggctgaggtgggtggatcacctcggatcaggagttcgagaccagcctgactaacatggtgaaaccccatctctactaaaaatacaaaaaattagcagggcttcgtggcgggcacctgtagtcccagcgactcgggaggctgaggcaggagaatggcgtgaacccgggaggcagagcttgcagtgagtggagatcacgccactgcactccagcctgggtgaccgagcaagactctgtctcaaaacaaaacacaacaaaaaacaaaaaacaacaaacaaaaaacaaaaacaaaaacaaacaaaaaacccaacctaacaggtaccatgcttattacctgggcgacaagataatctgtacaccaaacacttgtgacacataacttacctatataacaaacctgcacatgtgtttctgaaactaaaataaaagtttgttgttgttttttttttaagttccctatttgaagaattcccttagaatttagaatcagggaaaaatgttatttcccttgcattggtcttttctattgagtaacaggtattgtgtaacccattatatttccccttttgccagtgttgctagaatgcccacaattgatggaaactttatttatagcaatgaggtagtctttgtggttttcatacttgtttttttcacttttaaagttactgcatttttatgcttctatagatggctctgatatgtctttatattcttcctatcttccttcttttctgtttttcagttttaattgtctttattgtttggattttttaattcacaaaataattctgagaaaaagttatctttgtgattctcaaatatagaaagaaacaacttaaagtattagaatcttcctttcttgactttctgttttccttagtttaactcgaatgttgatctttccttatataccctatcaagatttttaaaacatgagtttatttattttttattttagactcacgcggtatatgtgcaggtttgttacatggcttctttttttgaatggcaagtggtgtgagtaattaagtaaactgatatactttgagcctaggccatatacgaccacaaaatctacaagttcactccttgctgggtgcagaagaaatccttttaacttaaaacctctcagatttcaaaggaggcatcctccggcattgagaggcagcatggttcagtggttaaggaacctgtggcatcaggagcctctgtacctgtggctttagtatgactgtccttattgcccagatgagggcactccctgtgtaagagttaaaagtgtggattgctgcgtgagagagagtgaaggctgaattccatctttgctagtactaactgtgagactatctttttaatccttggttttctcatctccagggtatgataatagcaatatttatctcacggagtggttgtaaaatttaagtccaatgtacacgtaaagccctggacatggtctaacccagagagtgtccagtgagcactgatgggcatgggactagctgtaggccacttgtggggtgaggagctcagtggaaattgaacccagctctcctgaccccaggccagtgccctgtccagtaaaccaggtgatgtgtaaccccatccaggctcccctctccttgctctgttgtcccccagatgtgctgggtaacacatctgtattttaatgtccaggtgcctcctggaaacagtgccttggaccagtggagaggctccaagggtgggatttcctgagggaaatttcagatgttttccagaacctctgcttagcctgccaacctggtccccaggggactctttgtccatacatttgcctctcccacctcaccaccccgccaggagctcagtagggtctcacctgtgtagtaaattcctgacgtttcatccagaggccattgggtcccaggagcctcctgctctctgggtgctaggctgggctgaggtggggatccccagctccccagcactgctgtggatgtgggggcgttgggtgactcctggcttggagactcatggtctggggagcttggaagagcttggtagaggagtgaggcagagatttctggggggaatgaaaagaaaaataaccatttactgaacatttattttcttttaggtgcatatattttaaactctcacaacagtcctgagagatgggtcttaataatattattttgaaaaccatgttgaagtagaggggcaattttattctcttagtagtgaagagagaagtcatgtgagggagctggcttgggccgaggactaagcctagcctcttcttggggtctgtctggaaaacagagtcctccttggaacttctggaccaccctgaccctaaggatcttcagagcccatcaatattatgagctgagttctcgggcaaggaccatgtcacgagttgggcacccagttggggaagactcattgcctgacccacatgggtctcagcttccccatctgccacatggggagggatgcaatctcagcaccggaaggtccctgaaagatcaatttcaggcctacctctcacagcccatcctggctcccctatccttcctctgctgtcccccatgtcaggtccccatgcacagacatgatcctctgggtggggcccaccagctgattcacagctccacccagggctgtcagcctgcctcagcaagcctcacctctccagcggcgtccagatgtgtcaggcagctgtctcaaaacccttctctctgagccctgggtgcaccccgccggcaattcatggatccagggcattagcactgcggtggaggtgggttggctgggagaccccaggtggggttcacttgggctgtaggggaatgagggagagtggcctacaggaaagagacaaagaggttggagacacatcagaggggcaggggcaaggtgccagggaactgagctggtctcctctctcaaccaagagaggtcaggatacaccagtgaacccgctgcagccctctacaacttcctctagaggcttgtctgaagaatgatgttcttatagatactgctaggcaaaaaatcctcatctaggatcaggaaatttgcatatctgtcttggtcctgactatctccctgtgtaaatcactactcctactgagcctcagctgtgctttattgggccaacggcatctgcaacccagggtggctaatagtaataataacagcagcagcagcagcagcaacaacagcaatgggagatcttatttattgagcacttactgtatatcagactctgtgctaaatgtttaacctggatgatctcttttaaccctcacacagcccagggaggcgggctctcactctcccattttgcagacagagaaataggcagagagcagtgaagtgattggcccagggtgatagtgccaggactggtgatagtgcctgactcccaagtccgtgctcataactacaatgccaggcgagtaccgggaatgcacttgaatagaagagggtgtggggctctgaggtgcagcaagggcccccccagcaagcctcctggctccagcatagtctggggcctggatccccctttgagagggcagttccatgtcactgctcagaggaaggcctggcagggagggctcagtggtggggtcccaagagggcagggcaggcatgagggccaggggatgtcccgcgggcagtggggtcctctgtccactcacctgccccttcctgggcttgggcgcacagtgacctcagccccatctgctcccaggtatggagggctaggtcccaggcccgctgctccccatactgagccaccaggtacgaggccacctccatgccactcgtcttctctggctgagcgggtgtctcacccgaagagctcctggagtgcgctttattggcgagcagaagctggaactccttcagctcctccttcttcaggaactccaagtaacaggccaggcggccccaggctccgccagccatctctgtcccggagttaagagggtgtctgggggatgttcccaggtggtgagggtatcaggcaggcagagaacagtgctgtcctttgccttggctcttaccgtctcttattcagcattcggaacccagttttataaatcccagggcacctacagatagacgccgatagagggggagtggtaggaaaagccaggggagggaggagcccagaggggcctgcaagacactggaagaagtcagctgatagggaggtcctgggatggggtccagggccaggcagggagggtgagggtgaggggagatgtggtgacgggagatggggtgtgggcaacgctcactgttctgtgttcctcagattcttccctctcctgggtcctggactcctgagatcaacccttgagctgcaaggctgagaagaggtggggtgggaggagccgcagagcagggaatgggctttcagaacccagagtggagccccgggctgctggctcccaggtttcttcagacctctccaggccctggggcaccagccagcaagaacagcgcctagtcaacaag

SEQ ID NO: 2635 - DNA, 70395 bp, Homo sapiens; identical to SEQ ID NO: 2634
  source 1..70395: mol_type = genomic DNA

SEQ ID NO: 2636 - DNA, 70395 bp, Homo sapiens; identical to SEQ ID NO: 2634
  source 1..70395: mol_type = genomic DNA

SEQ ID NO: 2637 - DNA, 70395 bp, Homo sapiens; identical to SEQ ID NO: 2634
  source 1..70395: mol_type = genomic DNA

SEQ ID NO: 2638 - DNA, 35859 bp, Homo sapiens
  source 1..35859: mol_type = genomic DNA
aatcacagggctgcggccgagaaagaagccttaatagagctttctcaacctgcagccctcatctccgccggcgagtagggccaggtgttgggaggtgagtagctctccggcagctctgcaacttcatttctttatttctccattccacagttggtaaaatttctccttttatttcatatattttttttctgagacggagtctcgctctgtcgcccaggctggagtgcagtggcgcgatctctgctcactgcaagctccgcctcccgggttcacgccattctcctgcctcagcctcccgagtagctgggactacaggcgcccgccaccacgcccggctaattttttgtatttttagtaggtggctcacgcctgtaatcccagcactttaggaggctgaggctggcagatcacctgaggtcgggagtttgagaccagcctggccagcatggcaaaaccccgtctctattgaaaaaaatacaaaaattaaccaggcgttgtggcgcatgcttgtaatctcagctactcgggaggctgaggcaggggaatcacttgaagccggcaggcggaggctgcggggagccgagatcgtgccgttgcactccagcctggggaacagagcaagactccattaaaaataaaataataataatactgtgaatgtgaaactgatgaacttggtgcttttcatgcgtctcatagttgacgtgtcattgatatttcacttgaaatacggttggatttttattaataatatacctggggtgatgggagaaggtagccaatcacagctgaggcttctaagcggtgattctcagcctcggccgcaatcacagttatctgggactctcgaaagaactccagggtctgggcagtcccagtgtaaccaatcaagcagaatctctaggcgttcgtgctttgaaatgaggctccacataggtaagtttaacaggcagtcaagatggaggaccacaggtggagatccggaagctcaggtgaaggaccgccccccaacaccccccgcccccaaaagacctctcagtaattccggtggatacaggaagtgctcagcaacgattacgccccgagggccaatcacagggctgcggccgagagagaagccttattagagctttctcaacctgcagccctcatctccgccggcgagtagggccaggtgttgggaggtgagtagctctccggcagctctgcaacttcatttctttatttctccattccacagttggtaaaatttctccttttatttcatatattttttttctgagacggagtctcgctctgtcgcccaggctggagtgcggtggcgcgatctcggctcactgcaagctccgcctcccgggttcaggccattctcctgcctcagcctcccgagtagctgagactacaggcacctgccactatgcccagctaatttttttgtatttttagtagagacggggtttcaccatgttggccaggctggtctcagtccgcctcggcctcccaaggtgccgggattacaggcgtgagccaccgcgcccagccttttttttttttttttttttttttttcttctcttttttgagggtcttactctgtttcccaggctggagcgctgtggcaggatctcggctcactgaacccttgacctctcaggttcaagcagtcctcacgcctcagcctttgaagtagctgggaccgtgggagggtgccaccacatctgttctggctaataatattattattaccactgtttgcagagactcactagatgtagggtcttaatatgttgccgaagctggtctctaactcctgggctcaagcgatcttcctgcctcagactcccaaaattctgggattataggcaggtgccaccgcgcccggcctaaatcttttcttctgttagaaattaagtggttctgcctgtctcagtggctcacgcctgtaatcgcagcgctttgggaggccgaggcgggaggatcacctgaggtcgggagttcgagaccagcctgaccaacatgtagaaaccccatctctactaaaaatataaaattaggtgggcgtggtagcgcatacttgtaatcctagctactcaggaggctgaggcaggagaatcacttgaacccgggaagcggaggttgcggggagcctagatcataccattgctctccagcctgcgcagcaagagagaaactgtctcaaaaaataaaataaaataaaattcagtggttctgactggggaaagagtagcagatgcttagatctagagagactctagttaaggttggctcataagaggatagttgtgtgtgcttttatttctgttctcttgggggatttaggatagagctatagagagctccaaaaaaaaaaatatattggaacaggtcagatgctgtggttgctgtgtgtggagtcctgggcagtgctaaggttttgtgtctaatgagtcctcttaacaagaaggtattgttttttattcactgaggtgagggagcctcttagcatcattctagtccagcttccggacctgagtcttatgcaaatacctatgccagttgccattctcacgctattcacagctatcatataaagaggtgttataccctttctgtaaagtttttgttgctactgctatttttttttttttttttttgagacaaagtctagctctgtttcccaggctggagtacagtggcgctatctcagctcactgcaacttccacctcccaggttcaagcaattctcgtgcctcagccttctaagtagctgggactacagccgcctgtcaccaacctggctaattttcgtatttttagtcgatatagggtttcactatgttggccaggctggtctcaagctccagacctcaggtgatcctcccaccttggactcccaaagtgctgtgattacaggcgtgagccaccgcacccggccctgttgtttttaaaatagagacagggtcttaagttgccaggctggtctggaacttctggactggagtgatcacccacctgagcttcccaaagtgcggggattgcaagcgtcagccaccacccccagtgttgtgtttttgtttgttttaccaggctggagtgcagtggtgcgatcacagctcactgcagccttaacttccctggctcaggtgatcctcccacctcagcctcctcagtagctgggactacaggtgcatgccactatgcccagcacaattttttttttttttgtatttttttgtagagacagggttttgccatgttgcccaggctggtctcaaactccaagcaatcctcccaccttggcttcccaaagtgtttggggttccaggtgtgagccatggccccccggccagcttcagtaaagtaaaagccacacacctgtgtcctgagaccaggctccaccactaagttatctttaagccttttttttttttgagacagtttcactcttgtcgccccaggctggagtgcagtggcgccatgtcagctcaccacaacctctgcctcccactcccaggttcaagcgattctcctgcctcagcctcccaagtagctggaactacaggcacctgccaccacgcccggctaattttttgtatttttagtagagacggggtttcactgtgttagccaggatggtctcgatctcctgacctcacgatccgcccgcctcggcctcccaaagtgctgggattgcaggcgtgagccaccgcgcccggctgtgtgtttgcattatcatattcagcccagttttcacgaagtttcttgtctcctgggtgatccacgtagctccccacttccttatctgatctatgcttgtcctttcattgttgtgttactactttgctataatgagagagtgttttcgctttataggttaacttttagaacctgagcagcccctcagggaaaaccctgacagtagctggttattttgcaattagaaaaactagctgggcactgaggcaggtgaatcacgaggtcaggagttcgagaccagcctggccaacttggtgaaaccccccatctctactaaaaatacaaaaaaattagctgggcacagtggtgaatgcctgtaatcccagctacttgggaggctgaggcaggagaattgcttgaatccgggaggcagaggttgtagtgagccgagattgcagcactgcactccagccagggtgacaaagtgagactccgtctcaaaaaaaaaaaaaaaaaaaatacaaaaagtagctgagcgtggtggtgggtgcccataatcccagctagtcgggaggctgaggcaggagaactgtttgaacctgggaggcagaggttgcagtgagctgagatcgtactactgtactccagcctgggctgcagagtgaaactatctcaaaaataagtaaataaaagtaaaatgagttgaggtcttgctctgttgcccagatgggagtgcagtggcacaatcaaggctcactgcagtttcagtctcccaggctcaagcaatcctcccactgcagcctcctgagtagctgggactacaggcatgtaccaccacccactgctaacttatttttcatggagatgggggtctcactatgttgcccaggctgggagtttgttcttgaagaagcagggtagatggtgagtgtccttgttcgtggcacagcaggaactggcatttgagacaggagtgctaatcaccatccctctccactcctcccttgattgtcatcacagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagaggtgagtggaaatcggtccacactgtgtcctaggaggaagcaggcgtcctctccaggactttagaaattcagaaggccaggcgcgctggctcacgcctgtcgtcccagccctttgggaggctgaggcggttggaccacctgagggtcaggagtttgagaccagcctgaccaacatggtgatgaaacagcatctctactaaaaatacaaaaatttgctggacgtggtggcagacacctgtaatcccagctactccgggaggctgaggcaggagaatcacttaaatctaggaggcgggggttgctatgagccgagatcacgccattgcaccccagcctgggcaacaagagcaaaattctgtctcaaaaaaaaaaagaaatggcattgaggcttggagagggactgcttgttctgaatgcaggtgctggatcttcataaaccctggtgtctgtcctggtccttattttctacctacttctttttttttttttttttgtccttttatttttttattttttattttattattattattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatgttccccttcctgtgtccatgtgatctcattgttcaattcccacctatgagtgagaatatgcggtgtttggttttttgttcttgtgatagtttactgagaatgatggtttccaatttcatccatgtccctacaaaggacatgaactcatcattttttatggctgcattgtattccatggtatatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatccccacaccgacttccacaatggttgaactagtttacagtcccaccaacagtgtgaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtgttttttggctgcataaatgtcttcttttgagaagtgtctgttcatgtcgttcgcccactttttgatggggttgtttgtttttttcttgtaaattattttctacctatttctatcgctttcaggtatcgtacagttggcctaacatatctgtggatttaaccaatcctagatcaaaaataatgggggcaaagacaattaaaaataacaatacaataaaatgcacatgaactatggttatttaactcttcttgagagaggatctcactctgtcacccaggctggaatttagcagcacgatctcggctcactgcaacctccgcctcccgggttcaagcgattctcctgcctcagcctcccgagtagccgggattacaagcatgtcccaccatgcctggctgattttttttttttttttttttgtattctaaatagagatggggtttcaccatgttagccaggatagtctcgatgtcgtgacctcatgatctgcccgcctcggcctcccaaagtgttgggattacaggcgtgagccaccgcacccagccagcaagtgcatttagaactactctactttctaccccataacttttttttttgtttgtttgagacaagtctcactctgtcacccaggatggagtgcagcagcacaatctcagcttattgcaactcccgccccctgggttcaagtgtttctcctgcatcagcctcttgaatagctaggattatacaggcacctgccactgtgcctggctaaattttgtattttaatagagatggggtttcactatgttggccaggctggtcttgaactcctgaccacgtgatcaacccgcctcagcctcccaatgtgctggaattacaggtgtgagccgccatgcccagctacacttttttttgaaacggggtctcgttttcttgctcaggctggagtacaatggggcaatcacagctcactgcagccttgacctcccagacttgagcaatcctaccactatggcctcccaccacacctcgctcattcttgtatatatatatatttttgtagagatagggtttcaccatgttgcccaggctggtctcgaacttctgtgggctcaaccgatcctcctgccttggcttcccacagtcctgggatcagaaacatgagccacagtgcctggccagtgcagctttatttacagtaaccaagatatagagtcagtctaagtgaccatcagtggatgaataaaaaatgtgcccgttgggtaccctgcctactgcctgggttatgagattgttgggaccccaagccttaaaaaggaaacatggtaggccgggcacagtggctcacgcctgtaatcacagcactttgggaggccaaggcgggtggatcacttgaggccaggagtttgagaccagtcaggccaatgtggtgaaaccctgtctctactaaaaatataaaaaaatcagccgggcgtggtggcacactcctgtagtcccagctacttgggaggctgaggcaggaggattgcttgaaccagagagtcagaggttgcagtgagccaagatcgtgccactgcgctccagcctgggtgacagcaagactccatctcaaaaaaaaaaaacaaacaaacatggtattaattacacaatggaatactcctcaaccttaaggaactcctatctttttatttaaaaattgccagttttatttcagctagagatcactttttagcataatgtttcctgtctttaacaatgggtgagggtttttttttttttttttttggtttggtttggattttggttttgcttttgagtcgaagtttcactcttgtctcccaggctagagtgcaatggcgcgatctcggctcactgtgacctcctcctcccaggtttaagtgattctcctgcctcagcctccagagtagctgggattacaggcgcctaccaccatgcccgctaatttttgtattttagtagagacagggttttaccatgttgaccagactggtctcgaactcccgacctcaggtgatctgcccacctcagcctcccagagtgctgggattacaggtgtgagcaaccatgcccggccaagggtttttaactttagctgacctccggaggttacaagtttgaaaacggcaggaggaaacccagagagttgtaaacttacgaaggtctgggctctgaaaaagatacaaattttctttccatgccaatagcgctcacacagacatggtgaatgttcctgaaacccgccggactttctgtaagaagtgtggcaagcaccacccccacaaagtgacacaaggcaaggattcttggtatgcccaggggaagtagtgttatgacaggaagcagagtggctatggtgggcagactaagccgattttccggaaaaaggctaaaactacaaagaagattgtgctaaggcttgagtgccttgagcccaactgcagatctaagaatgctggctattaaaagatacaagcagccaagcgcggtggctcacgcctgtaatcccaacactttgggaggccgaggtgggcggatcacaaggtcaggagtctgagaccagcctggccaaaatggtgaaaccccatctctactaaaaatacaaaacttagctgggcatggtggtgtatgcctatagtcccagctactcaggaagctgaggcaggagaatcgcttgaacctgggaggcagaggttgcagtgagccaagattgtgccactccagcctgggcaacagagtgacactctgtctcaaaaaaaaaagatgcaagcattttgaactggaaggagataagagaaaggaacaagtgatccagttctaagtgtcatcttttcttttatgaaggcaataaaatcttgagcttatggtaaaatgcaaaattttccccccttctcctttttcagaagcagctttgaaatcctttaataaaaggaagcctctatcattaggtaagttacctcatttataacttttattcttcatgtgagatctggggactcgggcctttgttttaaggagaatgtgctgagcactaagaatgcaaagaaatgccggacttagcatccctgctcccagggcggagctggtctcgcaggtgcgtagcagtaagacctgggaagctgaaacacgatcgcgtttgttggaaatctataaatacatacaaagcggggaagggtaagcttggcctttgaatctggataaggtagagacttttcttttttgagatggaggcttgctctgtcacctaggctgaagtgcagtggtacgacctcggctgactgcaacctctacctcctgggttcaagcagttctcctgcctcagcctctagaatagctgggattacaggtacctgccaccaggcccggctaattttttgtggtgtttgtagagatggggtttcaccatgatggccaggctggtcttgaactcctgacctcaagtgatctgcccacctcagcgtcccaaaatgctgggattatgggcatgagccaccaccacacccggttttgtttttttttttttttttttttttttttttttttttttgaaacagggcttcactctgtcacttaggctggagtggtgcaatcatggttcactgcagccttgacctcccaagctctggtgatcctcctgcctcagcctcctgagtagctgggaccacaggcacttgccaccatgcctggctaatttttttcactttttgtagagacagggtcttgctatgttgcccaggctggcctcgaattactaaactcaatcagtcctcctgcctcaccctcccaaactgctggggtacaggtgtgagccatgacacctggcccttaccagctacttatatcctgaagattattattattttttttttttttgagatagagtctctctctgttgcccaggctggagtgcagtggcgtgatctcggctcactgcaagctccgcctcccgggttcatgccattctcctgcctcagcctcccgagtagctgggactacaggcgcccaccaccacgcctggctaatttttttgtgtttttagtagagacggggtttcaccgtgttagccaggatggtctcgatctcctgaccttgtgatccgcccgcctcggcctcccaaagtgctgggattacaggcgtgagccaccgcgcccggcccctgaagattgtgttttgagatggggtcttgctgtgttgctccggcttgattgcagtggcacagtcatagctcattgcagcctcaaccttccaggctccagagatcctcttacctcagcctcctgagtagctgggactacaggtgtgcactgccacacctgactaatatttgtatttttggtagggacagtttcactatgttgccagatatggtgtcaaactcctggtctcaagtgatcctcccaccttggcctcccaaagtgctgggattacagacatgattcaccacacctggccatgaagactttttttttttggacaaagtctcactctgttgcccaggatggaatgcagtggcatgatctcagctcactgcaacctctgacctccgcctcccggttcaagtgattctcttgcctcagcctcccgagtagctgggattataggtgtctgccaccaagcccagctaatttttgtaattttagtagagatggggtttcaccatgttggccaggctggtcttgaactcctgacctcgtgatccacgtgcctcagcctcccaaagtgttgggattacaggtgtgagtcactgcgcctggtctcatgaagaccttttttgagacagagtcttgctctgtcacccaggctggagtgcagtggtacaatctcactgcagcctccgcctcccaggttcaagtgattctcctgccttagcctcccaagtagctgggattacaggcgcctaccaccacgtctggctaatttttgtatttttagtagagacagggtttcaccatgttggccaggctggtctcaaactgctgacctcaaatgaactgtctgcctcagcctcacaaagtactgggattacaggcatgagccacctcacctggtggtgaagactctaaaggctcttctcagatcagcctttgtcctgaatttcacatgcccgtgtccagttccctccccagcatcttttcaggagttccatggactcacctcttcattatccagggttaagctgcagatattgttattaggattccaccttgttctctctctttttttttttttttttgatacggagtctcgcttgctcttttgccaggctgaagtgcagtggagcgatcttggctcactgcaatctccgcctcctgggttcaagcaattcccttgcctcagcctcgcaagtagctgggacttacaggtaacacaccaccatgcccggctaattttttgttttagtagagacggggcttcaccatgttggccgggatggtctcgatctcctgacctcatgatccgcctgccttggcctcccaaagtgttgggttacaggcatgagccaccatgcccggctgattccaccttgttcttacattctttcccagttcattttaaatttatctacctcatcagaaactagggggttaggcctggcaggcagatcacctgaggttgggagttcgagaccagcctgaccaacgtagagaaaccctgtctgtactaaaaatacaaaattagccaggtatggtggcacattcctgtaatcccagctactccggaggccgaggcaggagaatcacttgaacccaggaggcggaggttgcagtgagccgacatcacaccattgcattccagcctgggcaacaagagcaaaactacatctcaaaaaaaaagaaaaactaggcagttaatcctcaaagcctttccagtggccttatgcgtgagtagtttgtgtgtgtgtgtgtgtgtgtgtgtgtgtgtgtgtgtctttcacaccatgtgttctgaactacttaggaattctcaccagaaaggcacataaacctgggatcatggcctaatgtactttcacttttacatccagtaccttatcaacgtcctttttagtacctaatctaggcttcactactgagactcaggggtccaacttgagccatcttggagtcccactgccagcacagcaacaggcctgtaatgccgccctttttctccagggataacacggaaagaacgaccacctctagacgtggacgaaatgctggagcgcttcaaaacagaagcacaaggtgggtgtcaggacctccaatgttggagtcagctgaggaagccccccgttcttgctgctatctcctgttcctttgaagaaccccatctctctccaatcttttcctccactattcttaatgtgcccactgtctcctggagaatgccaacctcccttccgtaagaatagagggaagaacgaacgttgcagagaattagaactcagtttgtagaaagttaggagcacagcgcagagagtttttgtttttgtttttgttttgagacagtttctctgttggccaggttggaatgcaatggcgcgatctcggctcactgtaacctccacctcccaggttcaagcgattctcctgattctcctgactcagcctcctgagtagctgggattataggcacctgccaccacacccagctaatttttttttttttttttgagacgaagtcttgttcttgtcacccaggctggagtatagtggcaccatccctgttcactgcaacctccgcctcccagattcaagtgattgtcctgtctcagcctcctgagtagctgggactacaggtgcatgccaccacgcccagctaatttttttttgtacttttagtagagacaggtttcaccatctcattcagggtggtctcaaactcctgacctcaagagatctgctccacccacccccaagtctcccgaagtgctgggattacaggcgagagccaccgtacccggccttctttaaattatttaaaagttgacaggtggccaggtgtggtggctctcacctataatctcccagcactttgggaggctgaggcgggtggatcaagagatcgagaccatcctggccaacatggtgaaacccaactctactaaaaacacaaaaattagccgggtgtggtggcacccgcctgtagtcccagctactcaggaggctgaggcaggagaatcgcttgaacccgggaggtggaggttgcagtgagccaagattgtgccactgcactccagcctggcaacagtgcgagactccatcttaaaaaaaaaaaaaaaaaattgacaggcataaatgtatttatggtacattgctcagacaactttaatataaacaacttacagagaaaattgagtcttttgggtaggtgacttgcctgagctgactttgtgataggttttttctgttttttttgtttttgaaatagagtctcactctgtcatgcaggctggagtgcagtggccccatcttggctcactgcaatctctgcctcctgggttcaaggggtcttcctgccacagcctccccaggtgctgggactataggtgcccaccactatgcctggctaacttttgtgtttttagtacagatggggtttcaacagggtagccaggttggtctagaactcctgacctcaagtgatccacctacctcggtctcctaaagtgctgggattacagctgtgaaccaccgcacctagcctgtgatcagtttcagatcagccttgcttactccacattccctcttatcttcctggtagcatttttgttttttcttgagaaagagttttgcccttgtcgcccaggctagagtgcaatggtgtgatctcggctcgccacaacctccacctcccaggttcaagtgattctgcctcagcctcccgagtagctgggatcataggcgcccaccaccacatctggctaatttttgcatttgttagttttatttttagtagacagggtttcaccatgttgggcaggctggtcttgaactcctgacctcaggtgatccacccacttcggcctcccaaagtgctgggattacaggcatgagccaccgtacctagcccacattgacttttgatacagcaagtatttcttgctatggctctgtataatagaggtgagtaacttggttgaaggaattgtttgccctgttcatctctctagacacggccaatgtcattcctggcacacaatctttttttttcttgagatggagtctcactctgttgcccagactggagtgcagtggtgcaatcttggcccactgcaacctctgctacccaggttcaagcgattctcctgcctcagcctcccaaatagctgggagtacaggtgtgtgccaccacgcccagctaattttttgtattttagtagagacagggtttcaccgtgttagtcaggatggtctggatctcctaacctcgtgatccgtccgcctcagcctcccaaagtgctgggatgacaggcgtgagccactgtgcccagcctagcacacaatcttgacaaagaatttcggtgcgacttggggtactgtggtgcctgctctatcatcatgcttcagcaggaaatgtgggtgaatagtgcctggtggcatggcaggtaaagaaatgttttgttttgtttttttttttgagacagtcttgctctgtcacccaagctggagtgcagtggcgcaatctcggctcactgcaagctccatctcccgggttcacgccattctgcctcagcctccccagtagctgggactacaggcgcccgccacacgcccggctaattttttgtatttgtagtagagacagggtttcaccgtgttagccaggatggtctcgatctcctgaccttatgatccacccgccttggcctcccaaagtgctgggattacaggcgtgagccaccgcgcccagccgcgggtaaagaaatttatgaagacaatcgtaggtaaaggaaggcagatttattggagaaagtaggaaaagacattggcagagagaccccagcgggcaggttgtcatgagtagctcactgccaggagaccaaagcttcctgcagattttatagaatagggcttgggctgattgataatgtcaacagggggtttaacttgcggtcttctttcagcagaagtgtttgataaactgaggcgtttcatggcaaacagggagtttgtgagctctgtgtgtgatctggccaggaaggccaaacatcttgggccgtatctcctggaccataaaagcagacctggcccagtgcagtggttcatgcctgcaatcccagcactttgggaggctgaggtgggtggatcatctgaggtcagcagttttagactggcctggccaacatggcgaaaccccatctctactaaaaatacaaaaattagcctagacgcagtggcacatgcctgtaattccagttacttgggaagctgaggcaggagaatcgcttgaacccgggaggcggaggttgcagtgagctgagattgcgccactgcactccagcctgggcaacagagtgagactgtctcaaacagacctatagctgacctgtttcctcttgtttgtatgccctgaaccatggaggaaagcttatttatttattttattgagatggagtcttgctctgttgcccagggtggagtgcagtagtgcgatctcttactacaacctccatctcccaggttcaagcaattctcgagcctcttggcctcccaagtagctgagattacaggcatgcgccaccacgcctggctaatttttgcatttttagtagagatggggtttctgtgttggccaggctggtctcgaactcctgagctcaagtgatccaccccacctcagcctcccaaagttctgggattataggcatgagccaccacacctggccggaaaacacatttgtagcttatttgctttatctgatcccgtgccccccctcccccccgccccatcagcctgcctccttttctctaattgggactccacaggaaatacacctgattttgtgtcaatctcacatgagtttgtattttgtagcgtttacagaaacgaaaggaaatgtcatctgcctgggtaaagaagtctttaaaggaaaaaagccaggtctgtaccatatcttcctgcagggagcttgggatcagatttctctttataaacttgaagtcctcttaactttcctatgtaacacaaagcatttatttatgtatgtatgtatcgagacggagttttgctcttgttgcccaggctggagtgccgtggcgtgatctcgactcactgcaacctccgcctcccaggttcaagcaattctcctgcctcagcctcccgagtagctgggattacaggcatgcgccaccatgactggctaattttttatttttagtagagacaaggtttcttcatgttggtcaggctggtgttgaactcccaatgtcaggtgatctgcctgcctcgacctcccaaagggctgggattacaggcatgagccactgtgcccggccaacacaaggcattttgttattttggttttccctatgggtaactgattgcatcctctctcccttccctcctcaccaatgataaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagaggtgagaaccgtttcactctaccagtcgttccatctttagcctcatcccatgcccccttaggaagaggccagagcctcctatgcactgtggcttagggtcaggaattccctcttgttggactctttgtttgtttttgttttgagatggagtcttgctctgtcgctcaggctggagcgcagtggcgcgatcttggctccctgcaacctccgcctcccgggttcaagtgattcttctgcctcagcctcctgagtagctgggactacaggcgcctgccaccttgcccggctaatttttatattttcattagagacgggatctcagcatgttggccagtctggtcttgaactccgcctgacctcaggtgatccacctgcctcagcctccaaagtgggattacaggcatgattcaccatgcccggcccaaatatatttttttaagacagggtcttgctgtgttgctcaggctggagtacagtggtgaaatcagctcactgcatcctcaaacttctgggttcaagtgatgttcctgagtacctgggatgacaggtattaagtgtgcaccatcatgtccagctaacttaagtgggggtttttttttgtgtttttttttttttttttttttttggaaagacaaaatctcactatgttgtccaggctggtcttgaactcccaaagcactgagattacaggcatgagttaccacacgccctgcctgaatatttcttattgatatgtatagatatgtatattcccaatctttttttttttttttgagacggagtttcactctttttcccaggtcggagtgaagtggctcgatctcggctcactgcaacctccgccccaccaggttcaatgattctcctgcctcagcctcatgagtagctgggattacagccacccacgaccatgcccagctaatttttgtacttttagtagagacggggtttcaccatgttggccaggcaggtctcgaactcccgacctcaggtgatccacccgcctcagcctcacaaagtgctaggattataggcgtgagtcaccgtgcccggtctatattctctatcttttatcaatgatgtgcttagcattttaacttatttttaccctctattggatttttgtctaagaagaataggttctttctcctgtgatgcttcttgggtgttgagttgtctgatggtggtgctaataagtgattacatggtccagctttcaattgtactcatttgtcaggggtatatgcccagagaaaccctaaatacttcagccgtgatggacacacatttggtgtaaccctttcttctcttccctatagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgtaagtagaaactaattcatgaactcaaatccttagggtatgaaaatggtacaatgttaacatcggagcaatattcagattcctgtactagactcttaagtgctcgagacacagggaattgagagagtcctgtccttaaatttattttgtgggataatcgtataaagtaatttctaggggctgggcatggtggttcacacttgtaattccaacacttcgggaggccgaggcagacagatcacttgaggtcaggagttcgagaccagcctggccaacgtgacaaaaccctgcctctactaaaaatacaaaaattatccaggcgtggtggcaggcacctgtaatatcagctacttgggaggctgaggcaggagaattacttgaacccaggaggcggaggttgcagtgaaccaagatcctgccactggactccagtctgagtgacagagcgagactgcgtctcaaaaaaaaaaaaaaaaaaaaagaaaaagaaaaaaagggccgggcacaatggctcacgcctgtagtcccagcactttgggggcccaaggtggggggatcacttgaggtcaggagttcaagaccagcctggccaagatggtgcaagaccctgtctctacgaaaaatacaaaaatttgccaggtgtcgtggcaggtgcctataatcccagctactccggatgctgagggtaggagtcgcttgaatccgggaggcagagtttgctttgcagtgagccgagatcgcgccactgcactccagcctgggcaacagagtgagactccatctcaaagaaaaaaaaaatctgtaaagatggacaaaaatttaaacatggaaaaaatagttcctaaagtttaaatatatcgagcccctggtttccatttaagtacgatacaggtgtacacactaaagatttcactttcgttctcttttccctaggttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggtatatctcttaatcattaaaatccttcatcatacaaacataagctaccacaagcttatgtggcaattttgtgtaaataagaaaaagttcgttattctgactagaaacagtactaagggcagatgacccaggatgcagcatgggctgaacttgagtttctacttgccttgaacagtaaacaccctggacaaccatacgtgaggaccctgaatccaaagaaactcccagaatctttatcatctttttttttttttttatgaagtcttgctctgttgcccaggccaaagtgcaatggcacgatcttggctcactgcaacctctgtctcctgggttcaagtaattctgctgcctcagcctcccaagttgctgggattacaggcacccgccaccacgcccggctaatttttgtgcatttagtggagctggtttcgccacattgccaggctggtctcgaactcatgacctcaggtgacctgccctcctcaggctcccaaagtgctgggattataggcatgagccaccatgcccagccagagtccttatgttttggttttggttttggttttttctttttcttttttctttttgagatggagtctcgctctgtcacccaggctggagtgcgttggtatgatctcaggtcactgcagcctccacctcccaggttcaagtgattctcctgcctcagcctcctgagtagctgggattacaggtgcacaccaccacacctggttaatttttgtattattagtagagatggagttttaccacattggccaggctggtctcgaactcatgacctcaggtgatctacccccccacccccaccccaccccgccgtcggcctcccaaagtgaggcatgagccaccgtgcccagcccagaatctttatcttctatcagagatcattcactcatggttcatgcttctcctgtatgatgattcagaataccagctattgacatttttcaagcaagaacccttcaggaacatcaagttgccccttttctgttagtcctctggtttgagagctctccccttgggaagctgtccagtggctgcccaggcgatgagaacctacatgcatcatggggttccatgaagcctcacttggccacactggtgtagtaggtggtcattggcctcaaattattgccctgggccaggcgcagtggctcacgcctgggaggccgaggtgggtggatcacttgaggtcaggagttcaagaccggcctggtcaacatggtgaaactctgtctctactaataatacaaaaattagctgggcatgttggcgcacgcctgtagtcccagctactcaggaggctgaggcaggagcatcatttgaacctgagaggcggaggttgcagtgagctgagatcacaccaccgcactccagtctgggcaacagtgtgagactgtctcaaaaaaaaaaaaaaaaatcttggctgggtgcggtagctcatgcctgtaatcccagcactttgggaggccaaggcaggtggatcacaaggtcaggagttcaagaccagcctggccaacatggtgaaaccccacgtctactaaaaatacaaaaacattagctgggcatggtggcgcgtgcctgtaatcccagctactcatggaggctgatgcaagagaattgcttgaacctaggaggcagaggtagcagtgagccaagatcacgccattgcactccagcctgggcaacagagcaaaactccatctcgaggacagaaaaaaaattgattgctctggctctactgatacaatcttaggctgcttaatgggatcttagttgaataggatgctgtacatcttacaggtattggaaggttgaatgaaaccaagcccatgcattcaatagtggctgctatcattactaaccgttgcaattaccctcttttctttttgcctgagaataatgggatgcagggtgagggggaatattgggtgaattaaagatttgggtcactaatttctttctttttttctcaagatatagtcttgctctgtctcctaggctggagtgcagtgccacaatcttggttcactgcaacctctgcctcccgggttcaagtgattcttctccgtcaacctcccaagtagctgggattacaggcacccacctgtatttttgtatttctagtattttgtatttctagtagagacagggttacgccatgctggtggccagggtggtctcaaactcctgacctcgggcaatccaccacacccagctaatttttggtatatttagtagagccggggtttcaccgtgttggctgggctggtctcgaactcctgacctcaagtgacatccatcttccaaaatgctgggattacagccatgtgccaccacgcccagctaattcttgtatttttaggagaaatggggtttcatcatgttgttccggctggtcttaaactcctggcctcatgatccacctgccttggcctgccaaagtcctgggattacaggcatgagccactgtgcccagccactcatttcttatgaatttattctaacacattttccggatgaacagggcaccttgaaacataggttagtgggctgggtatggtggctcctgcctgtaatcccagtactttgggaggcctaggctggtgtatcgcttgaagtcaggagttttttgttttgagacggagtcttgctctgtcgcccaggctagagtgcagtggagtgatctcggcttactgcaacctccgcctcctgggttcaagtgattctcttgcctcagcctcctgagtagctgggactacaggcacgtgtcgccacgcccatctaacttttgtatgtttagtagagccggggtttcaccatgttggccaggatggtctcaaactcctgacctcctgatctgcccacctcggcctcccaaagtgctgggattacaggcatgagccattgccccggccaaagttaggagtttgagaccagcctggccaacatggtaaaaccccatctctactaaaaaatacaaaaattagccaggcaagatggcatttgcctgtaatcccagctactcaggaggctgaggcgggagaatctcttgaatctgggaggcagaggttgctgtgagctgagatcgcgccactacactccagccagggcgacagagcataaataactccctttcaaaaaaccaaacaatgaaacataggttagcggagtctgcatccaacattagagtcagattgactaagttctgtatttccagctgattcctgggcgatgttggtgccactggtctgaccaccctttgacaactgctgctccagataattcaagtcggggtataacacaaccagtgagatgtaaaccaaagacgattccacggttagattctcaagaatgacttgttctgccgggcgcggtggctcacgcctgtcatcccagcactctgggaggccgaggtgggcagatcacctgagattgggagtttgagaccagcctgaccaacatggagagacccccacctctactgaaaatacaaaattagctgggcatgttggtgcatggtgcatgcctgcagtcccagctactcgggaggctgaggcaggagaatcacttgaacccaggaggcggaggttgctgtgagccgagattgcgccacctgggcaacaagagtgagactcagtctcaaaaaaaaaaaaaaaatgacgtggtcctatttctcccacaggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgtaagtctctcctctcttacagagcagctgtgctttcgatctggggccacagacgagcaatggtcatgcctgacttggctgtatggaacctctcgctgatgtgaacacctgttcccatgtttagatccaggccgatggcctgtgaattttgttcttctctcattcctattccttcataggatcaccagtgcatgatagaaggtggggagttcacaagaaggggcttttggatgctggcacttgtggagctagccgggaaggttgaagttggacctgtcaaccgtgttgccatttgtgattcttttgtaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgtaagtccgtgctggctgcctgtgtgcgtgggtgtatatgcacacgccccccacctccgggtttgagtagggtggttatgagaacacttaattcctctaaaagttccaagcatgatgctaatgacaactggtaagacctgggtagatgatggtaggaaaaaagtataagtagtagtagagtagtagtaatattctatagggatttggggaatgtagctggttttcgggttttttttttcctctttatgtatgtatgtattttagagatgggatctcgccgtgttgcctaggctggtctcaaactcctgagctcaagagatctgcctgccttggcctcccaaagtgctagaattacaggcatgagccatgtcaccccatgctgtgttttctcttaatctgtgttcttagaactataactgtaacataaattgcatgcaattggttgtaaatggaattcatttacttattttttaatgaatgatttgcaaatcaggtagtcttctgggccagtgtacgctcagactcccaatggaagctattggaagctacatgctcaatgtgatcctccttttaatactaaaatcacaggacacgtggcctggcatagtggctcacgcctataatcccatcaccttgggaggccgaagcaaggcagatcccttgagggcaggagttcaagaccagcctgcccaacatggtgaaacattgtctctctactaaaaatacaaaaattagtcacgcatggtgggacatgcctgtaatcccagttactcaggaggctaaggcaggagaatcacttgaacttcggaggtggaggttgcagtgagctgagatggcaccactgaagtccagtctggccaatagagcaagactctctcaaaaaaaaaaaattataggacaaatctttagaaaggaattggggcctggcatggtggctcatgcctgtaatctcagcactttaggaggcgggcagaacacctgaggtcaggagtttgagaccagcctggctgatgcagtgaaaccctgtctctactaaaaatacaaaaattagctaggcgtggtggtatggtcctgtaatcccagctacttgggaggctgaggcaggagaatcgcttgaagtcgggaggttgcagtgagccgagatcgtgccagcctgggtgacagaacgagattgtctcaaaaaaaaaaaaaaattgtatctgcactgatggtttctgttcagagattcgattttatgttaacatctctggtattttttttttttttttttaagatggagttttactcttgcccacgctggcaatggcatgatctaggctcactgcaacctccggcttcaaggaggttgattctcctgcctcagcctcctgagtagctgggattacaggcactcaccaccacgccgggctaatttttatatttttagtagagatgggatttcaccatgttggccaggttggtctcgaactgacctcatgatccgcccgcctcagccttccaaagtgctaggatttacaggcatgagccactgcgtccagccatacatatctctggtattctttgtctctaacatcacctccaacagttaggaactgtcctcttcctatgaagtaactaatctaggatatgtacctggcatctgaaaactacccacttaaatttaatgacatattcagttcatggctggagacgatgagtagaaggaaaggattcttcccacacccactatatctaggccctgaaacattaaaaaagaagtcccacaagcagtgagatgtcaccgactcactaactgtatcttcaaatgaatgtctagtttttttggttgtgtgtgtgtgtggtgtgtggtgtgtgtggtatttttttgggggggggggggttttcttttttttttttttttggttttttttttttgatagtcttgctctgtcgcccaggctggaatgcagtggctccatctcagctcactgcaacctccacctcctgagttcaggtgtgattctcctgcctcagcctcccagggattaaggtgcatgccaccacgcccagctaacttctttatttttagtagagacgagttttcaccatgttggtcaagctggtctcgaattcctgacctcaggtgatccacccacctcagcctcccaaagtgctgggattacaggtgtgagccaccgtgccggccccctcaattcaactttttgatccatgcccctattttgctaagttgtcaacttccctttagtcttatgtgggttttcctccattacagtcatggaagtttctagaaggccgggtagggtctttgagaggccgaggcaggtggatcatgaggtcaggagttcaagaccagcctggccaacatggtgaaaccctgtctttactaaaaatacaaaaattagccaggcgtggtgtcggagcctgtaatcccagcttacttgggagggtgaggcagagaattgcttgaacctgggaggcggaagttgcagtgagctgagattgtgccactgtactccagcctgggtgtcagagcgagactgtctcaaaaaaaaaaaaaaaaaagtttctatacattcataaagtttcaagatttgggggtgtgttttcacttctccatcgtcatggactccaatctgccatctatttccaaggcccttccaggtcctgtgtccctcagctagtggtatgcttcacttgggacccagagatacatgggcattatagttcaaattataattaagtttagaactctattgagacagaagaaagaaaacagagctaaggtgaaatatctctgataatctgtgttggttaatatctaggatcctagtaccagatatgttggagtgtgagctggtgtcttctgcctgtaagacactacctctctagcaactgaatttagcaaatacaatcgtaatcccagcatgttagggaggccagggtgggcagatcatctgaggtcgggagttcaagaccagcctggccaacatggggaaaccctgtctctactaaaaatacaaaacttagctgggtgtggtggcacgcgcatgtgtgtacacacacacacccccctgtaatcccagctactcggaaggctggggcacaagaatcgcgtgaaaccaggaggcggaggttgaagtgagccaccgtgccagctgagaatcctttttacttctccaacttctgttggccacctgcattccttggcttgtggcccttcctccaacttcggcagagcatcttcaaacgttgccctggctcccttatcacgtcacctcctgctggctttgactctcagctccctcttatgaggatccctgtgattgctggacctacccaaataaaccaggatataaaccatcttaagatgctcagtcacctctacgaggtcccttttgctcgcaggtgccaggagttgggacttggacatctttaggggaggccattcttctgtccaccacaccaccccatgattccatttccatgtcaccactgtctctaagtgtgtctaacccacggctcaagagtcaaaggtgcatcacagcagtgagaactcacaggttcgggtttgctttcttcctgtggttgatttctaggctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggtgagttaacttataagttcaacttcctatacttacaccttactgaatctgtggctagtgtaaaataatcagtgaagccgacttcccaagttatataattgagaggacctttatagagtcgatcgagcatttactaggatggttaaaggaataagttctagtctatgtctaagtttttgtttttttttttcttgaagttttgctcttgtcacataggctggagtgcagtggcgtgatcttggctcactgcaacctccgcctcccaggttcaagcaattctcttgcttcagcttcccgagtagctgggattacaggcgcccgccaccatgcccagctaattcttgtatttttagtagagacagggtttcgccatgttgaaggttcatctcaaactcctgacctcaggtgatccgcccatctcggcctcccaaagtgctgggattacaggcgtgagccactgcgccaggccctatgtctaagttctagtctgtgtcatgcaaagaacacctgtgaaattttaaggatacagtgcctcaagccattcagccaaaagccactgcccagcaccccacattcagagaggtgggaattgggccaggcacagtggctcatacctgtaatcccagcacttcgggaggccgaagcgggcggatcacttaaggtcaggagctcaagaccagcctggccaacttgaaactccatctctactaaaatataaaaattagccgagcatagtagtgggtgcctcttttttttttttttttttttttgagatagtttcactcttgttgcccaggctgtagtgtaatggcgcgatctcagctcactgcaacctccacctcctgggttcaagtgattctcctgccttagcctcccacatagctgcaaataaacaggcatgtgccaccatgcctggctaattttgtatttttagtatagacggggtttctccatgttggtcaggctggtctcgacctccggacctcaggtgagagccaccgtgcccagccagtaggtgcctttaatcccagctacttgggaggctgaggcaggagaatcacttgaaccctggaggcagaggttgcagtgagctgagatcctgtcactacactccatcctgggctacaagagcaagactccatctcaggaaaaaataaaaaagaggtaggaattagatatcgtgccagaaaatgctggctctatcagcaggtgagtggtctcaacttggctatcttacaaataccttgtgagttagctacaatcagatgcacttgaacctggaatcctatctgggaggcaatcttaaaagaatttgactcgggatgggcaaggtggctcatgcctgtaatcctggcattttgggagtccaaggcaggtagattgcttgaggccaagaatttaaaaacagcctggccaacacaatgaagccctgtctctactgaaagtacaaaaatccgctgagcatggctgtgtacctctgctcccagttactcaggaggctgaggtgggaggatcacttgagcctgggaggaagaagttacagcgaattgagatcacgtcacctcactccagcctgggtgacagtgagatcctgtctcaaaaaaaaaaaaaaaacaaaaaaaacaaaggcgcctttttaatcactcactgacacgtgtagaggagcaaaaagtttgagttgctggttggcccaggaggtcaaggctgcagtgagccaagatggcgttaccacactccagcctgggcaaccgagtgagaccgtgtttcaaaaaataaagtggcagggtgcagtggctcatgcctgtaattccagcactttgggaggccgaggcaggtggatcacctaaggtcaggagttcgtagaccagcctgtctctactaaagagacaggtgaaaccctgtctctctaaaaccacaaaaatcaggcaggcatggtggcacatagctataatctcatctacttggaggcacgagaactgcttgaatccaggaggcagaggctacagtgagccgagatcatgccacagcactccagccctggcgagagagcaagactgtctcaaagaataacttcaaagatggaagttatttaacctctctgctcaaaagcctcagtgcttccctatgtcaatccaggtaaaatcctatattgacgatggcttcagggtcttctgtgagctggccactgcttacctatgacctcatcttgacaatcctccctgtctcactcatgcccgctgcctggatgttctattttacgtgtcagtcacatgtatcttcagggcctctgcacaagctatttctctgcctggagaactcccccccgagctctatgactcggtctcttcaccccctcacctccaaccattgtagccagaacccccagttattccctgtaccccttgcccttcagaacccctcatcgcctccatattttcctgttagcagatgagccctgagggcggagacgttttgtttgttttttgagaccggagtctcactctgtcacccaggctggagtgcaatggcgcgatctcggctcactgcaacctccgcctcctgggttcaagcgattctcctgccccagcctcctgagtagctgggattacaggtgcctgtcaccacgcccagctaacttctgtatatttagtagagacacggttttaccatgttaggttggtcttgaactccttgacctcaggtgatccatccacctcggcctcccaaagtgctgggattacaggcgtgaaccaccgtgcccggcctgagacttctgttggtcatgcagatccccaacacacgagggtgggcttggcttgccggagggcatcgatcagcactggctgcattaacgtgttgatttctgtgtttccccaggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggtatgatccatttacttccccatcaggctttctccagagtggtaggtttaggggaagcataatgacatggacctgctgtaggagactgatctggtagctggattacaggttcccgccatcacacccagccaatttctgtatttcacttggagaaacggggtttcaccatgttggtcaggctggtctcaaactcctgacctcaggtgatccgcccgcctcggcctcccaaagtgctgggattacaggcgtgagcaaccgcacccggccaccttttttttttttttcctttgaggcaagaactcactatgttccccaggctggagtccagcagcacaatgatggctcgctgcaggctcgctccagctcctgggctcaagcaatcctgcctcagttcctgagtaggtaggtttataagcatgaaccattgcacccagccacggctgccgtctacctgctcatgatagccatttgtcactgggctgtgttttgtttgttgcattttgtcagggttttggggttttgttttgttttttctttctttttttttttttttttctgagatggagtctcactctgttgcccaggctggggtgcagtggttgctaactgcaacctccacctcccaggttccagctattctcatgcttcagcctcccaagtagctgggattacaggcatgcaccaccacacctaggtaatttttgtatttttagtagagacagggttttgccatgttggccagggtggtctcaaactcctgacctccgtgatttgcccacctcagcatcccaaagtgctgggattacaggcatgagccaccgcacccggcctgagttgtattttgataccatggcatcaaagaaccaagaagccccttcctaggaatgtgggaacttcagaaattctcacaagcaatatactctactgctggcttaaaataatctttatgtagaagaaacatagattacttgtttatttaacatgaaactcagcctaagatactttgtaagtcaaaagacatatggacactaagggtttttttaagctttaagtttgtttgtttgtttatttattatttattttggagacagttttactcttttttttggggtgcatcttttttcttttttttttttttttttcctttttttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaacgagcgtgctgccttcaggatctgtttaacaaagcatatcttgcaccgcccttaatccgtttaactctgagtggacacagcacatgtttcagagagcacggggttgggggtaaggtcacagatcaacaggatcccaaggcagaagaatttttcttagtacagaacaaaatggggggctgacccccccacctccctcccggacagggcggctggccggttagaggggctcctcacttcccattaggggcggccgggcagaggcgcccctcacctcccggacagggcggctggctgggcggggggctgacccccccacctccccgcccggccagagttttactcttgttgtccagcctggagcgcaatggcgctatctcggcttactgcaacctccgcctcccgggttcaagaggttctcctccctcagcctcccaagtagctgggactacaggcatgtgccaccacacctggctaatcttgtatttttaatagagacagggtttctccatattggtcaggctggtctcgaactcctgacttcaggtgacccgcctgcctcagcctcccaaagtgctaagattacaggcgtgagccaccatgcctggcctgcatctcctctgtttaactggtactccggggtccactgagtagaagttgccaaagtgggtgatagagcgggtaagcaggtattagagctatagcccagctgtactcagcaattccattttctgtgtatgataatcaacaagcatctcaaactgcacaatggctatataccattacaaggttaacctgatgttatgtttttctctatcagatcaacatggttgagaataagaggaatgaaaaaaaggattaaaaagagaaatgaaagtctttaatattacattttattatttacttcatttattttttagacaaaaatctcactctattgctcaggctggagtgcaggggcccgatctcagctcactgtaacctccgcctcccaggttcaagtgattctcctgtgtcagcttcctgagtagctgggattatagggatgcaccatcacacccaactaacttttatatttttagtagagatggactttcaccatcttgcctaggctggtctcaaactcctgacctcaagtgatctgcccacctcactctcccaaagtgctggcattacaggcatgacccaccacatctggcctcattttatatttaaaaataaaaaataagcaaatcaagccaggtacagtttaggcaacatggtaaaaccccaactctactaaaaatacaaaaattagctgagcatggtggcaggtgcctgtagtcccagctactcgggaggcagaggataggatggcttgaacccaagaggcacaggttgcagtgagctgagatggtaccactgcactccagcttgggcaacagagagactgtctttttttttttttttttttttttttttttttttttttttgagatcgcccaggctggagtacagtggcacgatctcggctcactgcaagctccgcctcccgggttcacaccattctcctgcctcagcctcctgagtagctgggactacaggcgtccgccaccacgcccggctaattttttgtatttttttagtagagacagggtttcaccgtgttagccaggatggtcttgatctgctgacctcgtgatccacccgcctcagcctcctaaagtgctgggaattacaggcgtgagccatcacgccccacctgagactgtcttttaaaaaaaaaaaaaaaaaatcaatgtggaacactcctttgccacctagaataatcaggaaaggtgacccatgccctgtgcctccttaacagactttcaggtacttgggaatttgaaacaaatctccttgatgcacaaagtaaccttttcttcccccattgtaccccaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatgaa

SEQ ID NO: 2639 - DNA, 34800 bp, Homo sapiens
  source 1..34800: mol_type = genomic DNA
agtgctcagcaacgattacgccccgagggccaatcacagggctgcggccgagagagaagccttattagagctttctcaacctgcagccctcatctccgccggcgagtagggccaggtgttgggaggtgagtagctctccggcagctctgcaacttcatttctttatttctccattccacagttggtaaaatttctccttttatttcatatattttttttctgagacggagtctcgctctgtcgcccaggctggagtgcggtggcgcgatctcggctcactgcaagctccgcctcccgggttcaggccattctcctgcctcagcctcccgagtagctgagactacaggcacctgccactatgcccagctaatttttttgtatttttagtagagacggggtttcaccatgttggccaggctggtctcagtccgcctcggcctcccaaggtgccgggattacaggcgtgagccaccgcgcccagccttttttttttttttttttttttttttcttctcttttttgagggtcttactctgtttcccaggctggagcgctgtggcaggatctcggctcactgaacccttgacctctcaggttcaagcagtcctcacgcctcagcctttgaagtagctgggaccgtgggagggtgccaccacatctgttctggctaataatattattattaccactgtttgcagagactcactagatgtagggtcttaatatgttgccgaagctggtctctaactcctgggctcaagcgatcttcctgcctcagactcccaaaattctgggattataggcaggtgccaccgcgcccggcctaaatcttttcttctgttagaaattaagtggttctgcctgtctcagtggctcacgcctgtaatcgcagcgctttgggaggccgaggcgggaggatcacctgaggtcgggagttcgagaccagcctgaccaacatgtagaaaccccatctctactaaaaatataaaattaggtgggcgtggtagcgcatacttgtaatcctagctactcaggaggctgaggcaggagaatcacttgaacccgggaagcggaggttgcggggagcctagatcataccattgctctccagcctgcgcagcaagagagaaactgtctcaaaaaataaaataaaataaaattcagtggttctgactggggaaagagtagcagatgcttagatctagagagactctagttaaggttggctcataagaggatagttgtgtgtgcttttatttctgttctcttgggggatttaggatagagctatagagagctccaaaaaaaaaaatatattggaacaggtcagatgctgtggttgctgtgtgtggagtcctgggcagtgctaaggttttgtgtctaatgagtcctcttaacaagaaggtattgttttttattcactgaggtgagggagcctcttagcatcattctagtccagcttccggacctgagtcttatgcaaatacctatgccagttgccattctcacgctattcacagctatcatataaagaggtgttataccctttctgtaaagtttttgttgctactgctatttttttttttttttttttgagacaaagtctagctctgtttcccaggctggagtacagtggcgctatctcagctcactgcaacttccacctcccaggttcaagcaattctcgtgcctcagccttctaagtagctgggactacagccgcctgtcaccaacctggctaattttcgtatttttagtcgatatagggtttcactatgttggccaggctggtctcaagctccagacctcaggtgatcctcccaccttggactcccaaagtgctgtgattacaggcgtgagccaccgcacccggccctgttgtttttaaaatagagacagggtcttaagttgccaggctggtctggaacttctggactggagtgatcacccacctgagcttcccaaagtgcggggattgcaagcgtcagccaccacccccagtgttgtgtttttgtttgttttaccaggctggagtgcagtggtgcgatcacagctcactgcagccttaacttccctggctcaggtgatcctcccacctcagcctcctcagtagctgggactacaggtgcatgccactatgcccagcacaattttttttttttttgtatttttttgtagagacagggttttgccatgttgcccaggctggtctcaaactccaagcaatcctcccaccttggcttcccaaagtgtttggggttccaggtgtgagccatggccccccggccagcttcagtaaagtaaaagccacacacctgtgtcctgagaccaggctccaccactaagttatctttaagccttttttttttttgagacagtttcactcttgtcgccccaggctggagtgcagtggcgccatgtcagctcaccacaacctctgcctcccactcccaggttcaagcgattctcctgcctcagcctcccaagtagctggaactacaggcacctgccaccacgcccggctaattttttgtatttttagtagagacggggtttcactgtgttagccaggatggtctcgatctcctgacctcacgatccgcccgcctcggcctcccaaagtgctgggattgcaggcgtgagccaccgcgcccggctgtgtgtttgcattatcatattcagcccagttttcacgaagtttcttgtctcctgggtgatccacgtagctccccacttccttatctgatctatgcttgtcctttcattgttgtgttactactttgctataatgagagagtgttttcgctttataggttaacttttagaacctgagcagcccctcagggaaaaccctgacagtagctggttattttgcaattagaaaaactagctgggcactgaggcaggtgaatcacgaggtcaggagttcgagaccagcctggccaacttggtgaaaccccccatctctactaaaaatacaaaaaaattagctgggcacagtggtgaatgcctgtaatcccagctacttgggaggctgaggcaggagaattgcttgaatccgggaggcagaggttgtagtgagccgagattgcagcactgcactccagccagggtgacaaagtgagactccgtctcaaaaaaaaaaaaaaaaaaaatacaaaaagtagctgagcgtggtggtgggtgcccataatcccagctagtcgggaggctgaggcaggagaactgtttgaacctgggaggcagaggttgcagtgagctgagatcgtactactgtactccagcctgggctgcagagtgaaactatctcaaaaataagtaaataaaagtaaaatgagttgaggtcttgctctgttgcccagatgggagtgcagtggcacaatcaaggctcactgcagtttcagtctcccaggctcaagcaatcctcccactgcagcctcctgagtagctgggactacaggcatgtaccaccacccactgctaacttatttttcatggagatgggggtctcactatgttgcccaggctgggagtttgttcttgaagaagcagggtagatggtgagtgtccttgttcgtggcacagcaggaactggcatttgagacaggagtgctaatcaccatccctctccactcctcccttgattgtcatcacagctcccacgtgggacaagatggtgtcttcggcgcagatgggcttcaacctgcaggctctcctggagcagctcagccaggatgagttgagcaagttcaagtatctgatcacgaccttctccctggcacacgagctccagaagatcccccacaaggaggtagacaaggctgatgggaagcaactggtagaaatcctcaccacccattgtgacagctactgggtggagatggcgagcctccaggtctttgaaaagatgcaccgaatggatctgtctgagagagcaaaggatgaagtcagaggtgagtggaaatcggtccacactgtgtcctaggaggaagcaggcgtcctctccaggactttagaaattcagaaggccaggcgcgctggctcacgcctgtcgtcccagccctttgggaggctgaggcggttggaccacctgagggtcaggagtttgagaccagcctgaccaacatggtgatgaaacagcatctctactaaaaatacaaaaatttgctggacgtggtggcagacacctgtaatcccagctactccgggaggctgaggcaggagaatcacttaaatctaggaggcgggggttgctatgagccgagatcacgccattgcaccccagcctgggcaacaagagcaaaattctgtctcaaaaaaaaaaagaaatggcattgaggcttggagagggactgcttgttctgaatgcaggtgctggatcttcataaaccctggtgtctgtcctggtccttattttctacctacttctttttttttttttttttgtccttttatttttttattttttattttattattattattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatgttccccttcctgtgtccatgtgatctcattgttcaattcccacctatgagtgagaatatgcggtgtttggttttttgttcttgtgatagtttactgagaatgatggtttccaatttcatccatgtccctacaaaggacatgaactcatcattttttatggctgcattgtattccatggtatatatgtgccacattttcttaatccagtctatcattgttggacatttgggttggttccaagtctttgctattgtgaataatgctgcaataaacatacgtgtgcatgtgtctttatagcagcatgatttatagtcatttgggtatatacccagtaatgggatggctgggtcaaatggtatttctagttctagatccctgaggaatccccacaccgacttccacaatggttgaactagtttacagtcccaccaacagtgtgaaagtgttcctatttctccacatcctctccagcacctgttgtttcctgactttttaatgatcgccattctaactggtgtgagatgatatctcatagtggttttgatttgcatttctctgatggccagtgatgatgagcattttttcatgtgttttttggctgcataaatgtcttcttttgagaagtgtctgttcatgtcgttcgcccactttttgatggggttgtttgtttttttcttgtaaattattttctacctatttctatcgctttcaggtatcgtacagttggcctaacatatctgtggatttaaccaatcctagatcaaaaataatgggggcaaagacaattaaaaataacaatacaataaaatgcacatgaactatggttatttaactcttcttgagagaggatctcactctgtcacccaggctggaatttagcagcacgatctcggctcactgcaacctccgcctcccgggttcaagcgattctcctgcctcagcctcccgagtagccgggattacaagcatgtcccaccatgcctggctgattttttttttttttttttttgtattctaaatagagatggggtttcaccatgttagccaggatagtctcgatgtcgtgacctcatgatctgcccgcctcggcctcccaaagtgttgggattacaggcgtgagccaccgcacccagccagcaagtgcatttagaactactctactttctaccccataacttttttttttgtttgtttgagacaagtctcactctgtcacccaggatggagtgcagcagcacaatctcagcttattgcaactcccgccccctgggttcaagtgtttctcctgcatcagcctcttgaatagctaggattatacaggcacctgccactgtgcctggctaaattttgtattttaatagagatggggtttcactatgttggccaggctggtcttgaactcctgaccacgtgatcaacccgcctcagcctcccaatgtgctggaattacaggtgtgagccgccatgcccagctacacttttttttgaaacggggtctcgttttcttgctcaggctggagtacaatggggcaatcacagctcactgcagccttgacctcccagacttgagcaatcctaccactatggcctcccaccacacctcgctcattcttgtatatatatatatttttgtagagatagggtttcaccatgttgcccaggctggtctcgaacttctgtgggctcaaccgatcctcctgccttggcttcccacagtcctgggatcagaaacatgagccacagtgcctggccagtgcagctttatttacagtaaccaagatatagagtcagtctaagtgaccatcagtggatgaataaaaaatgtgcccgttgggtaccctgcctactgcctgggttatgagattgttgggaccccaagccttaaaaaggaaacatggtaggccgggcacagtggctcacgcctgtaatcacagcactttgggaggccaaggcgggtggatcacttgaggccaggagtttgagaccagtcaggccaatgtggtgaaaccctgtctctactaaaaatataaaaaaatcagccgggcgtggtggcacactcctgtagtcccagctacttgggaggctgaggcaggaggattgcttgaaccagagagtcagaggttgcagtgagccaagatcgtgccactgcgctccagcctgggtgacagcaagactccatctcaaaaaaaaaaaacaaacaaacatggtattaattacacaatggaatactcctcaaccttaaggaactcctatctttttatttaaaaattgccagttttatttcagctagagatcactttttagcataatgtttcctgtctttaacaatgggtgagggtttttttttttttttttttggtttggtttggattttggttttgcttttgagtcgaagtttcactcttgtctcccaggctagagtgcaatggcgcgatctcggctcactgtgacctcctcctcccaggtttaagtgattctcctgcctcagcctccagagtagctgggattacaggcgcctaccaccatgcccgctaatttttgtattttagtagagacagggttttaccatgttgaccagactggtctcgaactcccgacctcaggtgatctgcccacctcagcctcccagagtgctgggattacaggtgtgagcaaccatgcccggccaagggtttttaactttagctgacctccggaggttacaagtttgaaaacggcaggaggaaacccagagagttgtaaacttacgaaggtctgggctctgaaaaagatacaaattttctttccatgccaatagcgctcacacagacatggtgaatgttcctgaaacccgccggactttctgtaagaagtgtggcaagcaccacccccacaaagtgacacaaggcaaggattcttggtatgcccaggggaagtagtgttatgacaggaagcagagtggctatggtgggcagactaagccgattttccggaaaaaggctaaaactacaaagaagattgtgctaaggcttgagtgccttgagcccaactgcagatctaagaatgctggctattaaaagatacaagcagccaagcgcggtggctcacgcctgtaatcccaacactttgggaggccgaggtgggcggatcacaaggtcaggagtctgagaccagcctggccaaaatggtgaaaccccatctctactaaaaatacaaaacttagctgggcatggtggtgtatgcctatagtcccagctactcaggaagctgaggcaggagaatcgcttgaacctgggaggcagaggttgcagtgagccaagattgtgccactccagcctgggcaacagagtgacactctgtctcaaaaaaaaaagatgcaagcattttgaactggaaggagataagagaaaggaacaagtgatccagttctaagtgtcatcttttcttttatgaaggcaataaaatcttgagcttatggtaaaatgcaaaattttccccccttctcctttttcagaagcagctttgaaatcctttaataaaaggaagcctctatcattaggtaagttacctcatttataacttttattcttcatgtgagatctggggactcgggcctttgttttaaggagaatgtgctgagcactaagaatgcaaagaaatgccggacttagcatccctgctcccagggcggagctggtctcgcaggtgcgtagcagtaagacctgggaagctgaaacacgatcgcgtttgttggaaatctataaatacatacaaagcggggaagggtaagcttggcctttgaatctggataaggtagagacttttcttttttgagatggaggcttgctctgtcacctaggctgaagtgcagtggtacgacctcggctgactgcaacctctacctcctgggttcaagcagttctcctgcctcagcctctagaatagctgggattacaggtacctgccaccaggcccggctaattttttgtggtgtttgtagagatggggtttcaccatgatggccaggctggtcttgaactcctgacctcaagtgatctgcccacctcagcgtcccaaaatgctgggattatgggcatgagccaccaccacacccggttttgtttttttttttttttttttttttttttttttttttttgaaacagggcttcactctgtcacttaggctggagtggtgcaatcatggttcactgcagccttgacctcccaagctctggtgatcctcctgcctcagcctcctgagtagctgggaccacaggcacttgccaccatgcctggctaatttttttcactttttgtagagacagggtcttgctatgttgcccaggctggcctcgaattactaaactcaatcagtcctcctgcctcaccctcccaaactgctggggtacaggtgtgagccatgacacctggcccttaccagctacttatatcctgaagattattattattttttttttttttgagatagagtctctctctgttgcccaggctggagtgcagtggcgtgatctcggctcactgcaagctccgcctcccgggttcatgccattctcctgcctcagcctcccgagtagctgggactacaggcgcccaccaccacgcctggctaatttttttgtgtttttagtagagacggggtttcaccgtgttagccaggatggtctcgatctcctgaccttgtgatccgcccgcctcggcctcccaaagtgctgggattacaggcgtgagccaccgcgcccggcccctgaagattgtgttttgagatggggtcttgctgtgttgctccggcttgattgcagtggcacagtcatagctcattgcagcctcaaccttccaggctccagagatcctcttacctcagcctcctgagtagctgggactacaggtgtgcactgccacacctgactaatatttgtatttttggtagggacagtttcactatgttgccagatatggtgtcaaactcctggtctcaagtgatcctcccaccttggcctcccaaagtgctgggattacagacatgattcaccacacctggccatgaagactttttttttttggacaaagtctcactctgttgcccaggatggaatgcagtggcatgatctcagctcactgcaacctctgacctccgcctcccggttcaagtgattctcttgcctcagcctcccgagtagctgggattataggtgtctgccaccaagcccagctaatttttgtaattttagtagagatggggtttcaccatgttggccaggctggtcttgaactcctgacctcgtgatccacgtgcctcagcctcccaaagtgttgggattacaggtgtgagtcactgcgcctggtctcatgaagaccttttttgagacagagtcttgctctgtcacccaggctggagtgcagtggtacaatctcactgcagcctccgcctcccaggttcaagtgattctcctgccttagcctcccaagtagctgggattacaggcgcctaccaccacgtctggctaatttttgtatttttagtagagacagggtttcaccatgttggccaggctggtctcaaactgctgacctcaaatgaactgtctgcctcagcctcacaaagtactgggattacaggcatgagccacctcacctggtggtgaagactctaaaggctcttctcagatcagcctttgtcctgaatttcacatgcccgtgtccagttccctccccagcatcttttcaggagttccatggactcacctcttcattatccagggttaagctgcagatattgttattaggattccaccttgttctctctctttttttttttttttttgatacggagtctcgcttgctcttttgccaggctgaagtgcagtggagcgatcttggctcactgcaatctccgcctcctgggttcaagcaattcccttgcctcagcctcgcaagtagctgggacttacaggtaacacaccaccatgcccggctaattttttgttttagtagagacggggcttcaccatgttggccgggatggtctcgatctcctgacctcatgatccgcctgccttggcctcccaaagtgttgggttacaggcatgagccaccatgcccggctgattccaccttgttcttacattctttcccagttcattttaaatttatctacctcatcagaaactagggggttaggcctggcaggcagatcacctgaggttgggagttcgagaccagcctgaccaacgtagagaaaccctgtctgtactaaaaatacaaaattagccaggtatggtggcacattcctgtaatcccagctactccggaggccgaggcaggagaatcacttgaacccaggaggcggaggttgcagtgagccgacatcacaccattgcattccagcctgggcaacaagagcaaaactacatctcaaaaaaaaagaaaaactaggcagttaatcctcaaagcctttccagtggccttatgcgtgagtagtttgtgtgtgtgtgtgtgtgtgtgtgtgtgtgtgtgtgtctttcacaccatgtgttctgaactacttaggaattctcaccagaaaggcacataaacctgggatcatggcctaatgtactttcacttttacatccagtaccttatcaacgtcctttttagtacctaatctaggcttcactactgagactcaggggtccaacttgagccatcttggagtcccactgccagcacagcaacaggcctgtaatgccgccctttttctccagggataacacggaaagaacgaccacctctagacgtggacgaaatgctggagcgcttcaaaacagaagcacaaggtgggtgtcaggacctccaatgttggagtcagctgaggaagccccccgttcttgctgctatctcctgttcctttgaagaaccccatctctctccaatcttttcctccactattcttaatgtgcccactgtctcctggagaatgccaacctcccttccgtaagaatagagggaagaacgaacgttgcagagaattagaactcagtttgtagaaagttaggagcacagcgcagagagtttttgtttttgtttttgttttgagacagtttctctgttggccaggttggaatgcaatggcgcgatctcggctcactgtaacctccacctcccaggttcaagcgattctcctgattctcctgactcagcctcctgagtagctgggattataggcacctgccaccacacccagctaatttttttttttttttttgagacgaagtcttgttcttgtcacccaggctggagtatagtggcaccatccctgttcactgcaacctccgcctcccagattcaagtgattgtcctgtctcagcctcctgagtagctgggactacaggtgcatgccaccacgcccagctaatttttttttgtacttttagtagagacaggtttcaccatctcattcagggtggtctcaaactcctgacctcaagagatctgctccacccacccccaagtctcccgaagtgctgggattacaggcgagagccaccgtacccggccttctttaaattatttaaaagttgacaggtggccaggtgtggtggctctcacctataatctcccagcactttgggaggctgaggcgggtggatcaagagatcgagaccatcctggccaacatggtgaaacccaactctactaaaaacacaaaaattagccgggtgtggtggcacccgcctgtagtcccagctactcaggaggctgaggcaggagaatcgcttgaacccgggaggtggaggttgcagtgagccaagattgtgccactgcactccagcctggcaacagtgcgagactccatcttaaaaaaaaaaaaaaaaaattgacaggcataaatgtatttatggtacattgctcagacaactttaatataaacaacttacagagaaaattgagtcttttgggtaggtgacttgcctgagctgactttgtgataggttttttctgttttttttgtttttgaaatagagtctcactctgtcatgcaggctggagtgcagtggccccatcttggctcactgcaatctctgcctcctgggttcaaggggtcttcctgccacagcctccccaggtgctgggactataggtgcccaccactatgcctggctaacttttgtgtttttagtacagatggggtttcaacagggtagccaggttggtctagaactcctgacctcaagtgatccacctacctcggtctcctaaagtgctgggattacagctgtgaaccaccgcacctagcctgtgatcagtttcagatcagccttgcttactccacattccctcttatcttcctggtagcatttttgttttttcttgagaaagagttttgcccttgtcgcccaggctagagtgcaatggtgtgatctcggctcgccacaacctccacctcccaggttcaagtgattctgcctcagcctcccgagtagctgggatcataggcgcccaccaccacatctggctaatttttgcatttgttagttttatttttagtagacagggtttcaccatgttgggcaggctggtcttgaactcctgacctcaggtgatccacccacttcggcctcccaaagtgctgggattacaggcatgagccaccgtacctagcccacattgacttttgatacagcaagtatttcttgctatggctctgtataatagaggtgagtaacttggttgaaggaattgtttgccctgttcatctctctagacacggccaatgtcattcctggcacacaatctttttttttcttgagatggagtctcactctgttgcccagactggagtgcagtggtgcaatcttggcccactgcaacctctgctacccaggttcaagcgattctcctgcctcagcctcccaaatagctgggagtacaggtgtgtgccaccacgcccagctaattttttgtattttagtagagacagggtttcaccgtgttagtcaggatggtctggatctcctaacctcgtgatccgtccgcctcagcctcccaaagtgctgggatgacaggcgtgagccactgtgcccagcctagcacacaatcttgacaaagaatttcggtgcgacttggggtactgtggtgcctgctctatcatcatgcttcagcaggaaatgtgggtgaatagtgcctggtggcatggcaggtaaagaaatgttttgttttgtttttttttttgagacagtcttgctctgtcacccaagctggagtgcagtggcgcaatctcggctcactgcaagctccatctcccgggttcacgccattctgcctcagcctccccagtagctgggactacaggcgcccgccacacgcccggctaattttttgtatttgtagtagagacagggtttcaccgtgttagccaggatggtctcgatctcctgaccttatgatccacccgccttggcctcccaaagtgctgggattacaggcgtgagccaccgcgcccagccgcgggtaaagaaatttatgaagacaatcgtaggtaaaggaaggcagatttattggagaaagtaggaaaagacattggcagagagaccccagcgggcaggttgtcatgagtagctcactgccaggagaccaaagcttcctgcagattttatagaatagggcttgggctgattgataatgtcaacagggggtttaacttgcggtcttctttcagcagaagtgtttgataaactgaggcgtttcatggcaaacagggagtttgtgagctctgtgtgtgatctggccaggaaggccaaacatcttgggccgtatctcctggaccataaaagcagacctggcccagtgcagtggttcatgcctgcaatcccagcactttgggaggctgaggtgggtggatcatctgaggtcagcagttttagactggcctggccaacatggcgaaaccccatctctactaaaaatacaaaaattagcctagacgcagtggcacatgcctgtaattccagttacttgggaagctgaggcaggagaatcgcttgaacccgggaggcggaggttgcagtgagctgagattgcgccactgcactccagcctgggcaacagagtgagactgtctcaaacagacctatagctgacctgtttcctcttgtttgtatgccctgaaccatggaggaaagcttatttatttattttattgagatggagtcttgctctgttgcccagggtggagtgcagtagtgcgatctcttactacaacctccatctcccaggttcaagcaattctcgagcctcttggcctcccaagtagctgagattacaggcatgcgccaccacgcctggctaatttttgcatttttagtagagatggggtttctgtgttggccaggctggtctcgaactcctgagctcaagtgatccaccccacctcagcctcccaaagttctgggattataggcatgagccaccacacctggccggaaaacacatttgtagcttatttgctttatctgatcccgtgccccccctcccccccgccccatcagcctgcctccttttctctaattgggactccacaggaaatacacctgattttgtgtcaatctcacatgagtttgtattttgtagcgtttacagaaacgaaaggaaatgtcatctgcctgggtaaagaagtctttaaaggaaaaaagccaggtctgtaccatatcttcctgcagggagcttgggatcagatttctctttataaacttgaagtcctcttaactttcctatgtaacacaaagcatttatttatgtatgtatgtatcgagacggagttttgctcttgttgcccaggctggagtgccgtggcgtgatctcgactcactgcaacctccgcctcccaggttcaagcaattctcctgcctcagcctcccgagtagctgggattacaggcatgcgccaccatgactggctaattttttatttttagtagagacaaggtttcttcatgttggtcaggctggtgttgaactcccaatgtcaggtgatctgcctgcctcgacctcccaaagggctgggattacaggcatgagccactgtgcccggccaacacaaggcattttgttattttggttttccctatgggtaactgattgcatcctctctcccttccctcctcaccaatgataaagacaaagacaataggtgcaggtatatattgaagacgaagttccgggagatgtggaagagctggcctggagatagcaaagaggtccaggttatggctgagagatacaagatgctgatcccattcagcaaccccagggtgcttcccgggcccttctcatacacggtggtgctgtatggtcctgcaggccttgggaaaaccacgctggcccagaaactaatgctagactgggcagaggacaacctcatccacaaattcaaatatgcgttctacctcagctgcagggagctcagccgcctgggcccgtgcagttttgcagagctggtcttcagggactggcctgaattgcaggatgacattccacacatcctagcccaagcacggaaaatcttgttcgtgattgacggctttgatgagctgggagccgcacctggggcgctgatcgaggacatctgcggggactgggagaagaagaagccggtgcccgtcctcctggggagtttgctgaacagggtgatgttacccaaggccgccctgctggtcaccacgcggcccagggccctgagggacctccggatcctggcggaggagccgatctacataagggtggagggcttcctggaggaggacaggagggcctatttcctgagacactttggagacgaggaccaagccatgcgtgcctttgagctaatgaggagcaacgcggccctgttccagctgggctcggcccccgcggtgtgctggatcgtgtgcacgactctgaagctgcagatggagaagggggaggacccggtccccacctgcctcacccgcacggggctgttcctgcgtttcctctgcagccggttcccgcagggcgcacagctgcggggcgcgctgcggacgctgagcctcctggccgcgcagggcctgtgggcgcagacgtccgtgcttcaccgagaggatctggaaaggctcggggtgcaggagtccgacctccgtctgttcctggacggagacatcctccgccaggacagagtctccaaaggctgctactccttcatccacctcagcttccagcagtttctcactgccctgttctacaccctggagaaggaggaggaagaggatagggacggccacacctgggacattggggacgtacagaagctgctttccggagtagaaagactcaggaaccccgacctgatccaagcaggctactactcctttggcctcgctaacgagaagagagccaaggagttggaggccacttttggctgccggatgtcaccggacatcaaacaggaattgctgcgatgcgacataagttgtaagggtggacattcaacggtgacagacctgcaggagctcctcggctgtctgtacgagtctcaggaggaggagctggtgaaggaggtgatggctcagttcaaagaaatatccctgcacttaaatgcagtagacgttgtgccatcttcattctgcgtcaagcactgtcgaaacctgcagaaaatgtcactgcaggtaataaaggagaatctcccggagaatgtcactgcgtctgaatcagacgccgaggttgagaggtgagaaccgtttcactctaccagtcgttccatctttagcctcatcccatgcccccttaggaagaggccagagcctcctatgcactgtggcttagggtcaggaattccctcttgttggactctttgtttgtttttgttttgagatggagtcttgctctgtcgctcaggctggagcgcagtggcgcgatcttggctccctgcaacctccgcctcccgggttcaagtgattcttctgcctcagcctcctgagtagctgggactacaggcgcctgccaccttgcccggctaatttttatattttcattagagacgggatctcagcatgttggccagtctggtcttgaactccgcctgacctcaggtgatccacctgcctcagcctccaaagtgggattacaggcatgattcaccatgcccggcccaaatatatttttttaagacagggtcttgctgtgttgctcaggctggagtacagtggtgaaatcagctcactgcatcctcaaacttctgggttcaagtgatgttcctgagtacctgggatgacaggtattaagtgtgcaccatcatgtccagctaacttaagtgggggtttttttttgtgtttttttttttttttttttttttggaaagacaaaatctcactatgttgtccaggctggtcttgaactcccaaagcactgagattacaggcatgagttaccacacgccctgcctgaatatttcttattgatatgtatagatatgtatattcccaatctttttttttttttttgagacggagtttcactctttttcccaggtcggagtgaagtggctcgatctcggctcactgcaacctccgccccaccaggttcaatgattctcctgcctcagcctcatgagtagctgggattacagccacccacgaccatgcccagctaatttttgtacttttagtagagacggggtttcaccatgttggccaggcaggtctcgaactcccgacctcaggtgatccacccgcctcagcctcacaaagtgctaggattataggcgtgagtcaccgtgcccggtctatattctctatcttttatcaatgatgtgcttagcattttaacttatttttaccctctattggatttttgtctaagaagaataggttctttctcctgtgatgcttcttgggtgttgagttgtctgatggtggtgctaataagtgattacatggtccagctttcaattgtactcatttgtcaggggtatatgcccagagaaaccctaaatacttcagccgtgatggacacacatttggtgtaaccctttcttctcttccctatagatcccaggatgatcagcacatgcttcctttctggacggacctttgttccatatttggatcaaataaggatctgatgggtctagcaatcaatgatagctttctcagtgcctccctagtaaggatcctgtgtgaacaaatagcctctgacacctgtcatctccagagagtggtgtaagtagaaactaattcatgaactcaaatccttagggtatgaaaatggtacaatgttaacatcggagcaatattcagattcctgtactagactcttaagtgctcgagacacagggaattgagagagtcctgtccttaaatttattttgtgggataatcgtataaagtaatttctaggggctgggcatggtggttcacacttgtaattccaacacttcgggaggccgaggcagacagatcacttgaggtcaggagttcgagaccagcctggccaacgtgacaaaaccctgcctctactaaaaatacaaaaattatccaggcgtggtggcaggcacctgtaatatcagctacttgggaggctgaggcaggagaattacttgaacccaggaggcggaggttgcagtgaaccaagatcctgccactggactccagtctgagtgacagagcgagactgcgtctcaaaaaaaaaaaaaaaaaaaaagaaaaagaaaaaaagggccgggcacaatggctcacgcctgtagtcccagcactttgggggcccaaggtggggggatcacttgaggtcaggagttcaagaccagcctggccaagatggtgcaagaccctgtctctacgaaaaatacaaaaatttgccaggtgtcgtggcaggtgcctataatcccagctactccggatgctgagggtaggagtcgcttgaatccgggaggcagagtttgctttgcagtgagccgagatcgcgccactgcactccagcctgggcaacagagtgagactccatctcaaagaaaaaaaaaatctgtaaagatggacaaaaatttaaacatggaaaaaatagttcctaaagtttaaatatatcgagcccctggtttccatttaagtacgatacaggtgtacacactaaagatttcactttcgttctcttttccctaggttcaaaaacatttccccagctgatgctcatcggaacctctgcctagctcttcgaggtcacaagactgtaacgtatctgacccttcaaggcaatgaccaggatgatatgtttcccgcattgtgtgaggtcttgagacatccagaatgtaacctgcgatatctcgggtatatctcttaatcattaaaatccttcatcatacaaacataagctaccacaagcttatgtggcaattttgtgtaaataagaaaaagttcgttattctgactagaaacagtactaagggcagatgacccaggatgcagcatgggctgaacttgagtttctacttgccttgaacagtaaacaccctggacaaccatacgtgaggaccctgaatccaaagaaactcccagaatctttatcatctttttttttttttttatgaagtcttgctctgttgcccaggccaaagtgcaatggcacgatcttggctcactgcaacctctgtctcctgggttcaagtaattctgctgcctcagcctcccaagttgctgggattacaggcacccgccaccacgcccggctaatttttgtgcatttagtggagctggtttcgccacattgccaggctggtctcgaactcatgacctcaggtgacctgccctcctcaggctcccaaagtgctgggattataggcatgagccaccatgcccagccagagtccttatgttttggttttggttttggttttttctttttcttttttctttttgagatggagtctcgctctgtcacccaggctggagtgcgttggtatgatctcaggtcactgcagcctccacctcccaggttcaagtgattctcctgcctcagcctcctgagtagctgggattacaggtgcacaccaccacacctggttaatttttgtattattagtagagatggagttttaccacattggccaggctggtctcgaactcatgacctcaggtgatctacccccccacccccaccccaccccgccgtcggcctcccaaagtgaggcatgagccaccgtgcccagcccagaatctttatcttctatcagagatcattcactcatggttcatgcttctcctgtatgatgattcagaataccagctattgacatttttcaagcaagaacccttcaggaacatcaagttgccccttttctgttagtcctctggtttgagagctctccccttgggaagctgtccagtggctgcccaggcgatgagaacctacatgcatcatggggttccatgaagcctcacttggccacactggtgtagtaggtggtcattggcctcaaattattgccctgggccaggcgcagtggctcacgcctgggaggccgaggtgggtggatcacttgaggtcaggagttcaagaccggcctggtcaacatggtgaaactctgtctctactaataatacaaaaattagctgggcatgttggcgcacgcctgtagtcccagctactcaggaggctgaggcaggagcatcatttgaacctgagaggcggaggttgcagtgagctgagatcacaccaccgcactccagtctgggcaacagtgtgagactgtctcaaaaaaaaaaaaaaaaatcttggctgggtgcggtagctcatgcctgtaatcccagcactttgggaggccaaggcaggtggatcacaaggtcaggagttcaagaccagcctggccaacatggtgaaaccccacgtctactaaaaatacaaaaacattagctgggcatggtggcgcgtgcctgtaatcccagctactcatggaggctgatgcaagagaattgcttgaacctaggaggcagaggtagcagtgagccaagatcacgccattgcactccagcctgggcaacagagcaaaactccatctcgaggacagaaaaaaaattgattgctctggctctactgatacaatcttaggctgcttaatgggatcttagttgaataggatgctgtacatcttacaggtattggaaggttgaatgaaaccaagcccatgcattcaatagtggctgctatcattactaaccgttgcaattaccctcttttctttttgcctgagaataatgggatgcagggtgagggggaatattgggtgaattaaagatttgggtcactaatttctttctttttttctcaagatatagtcttgctctgtctcctaggctggagtgcagtgccacaatcttggttcactgcaacctctgcctcccgggttcaagtgattcttctccgtcaacctcccaagtagctgggattacaggcacccacctgtatttttgtatttctagtattttgtatttctagtagagacagggttacgccatgctggtggccagggtggtctcaaactcctgacctcgggcaatccaccacacccagctaatttttggtatatttagtagagccggggtttcaccgtgttggctgggctggtctcgaactcctgacctcaagtgacatccatcttccaaaatgctgggattacagccatgtgccaccacgcccagctaattcttgtatttttaggagaaatggggtttcatcatgttgttccggctggtcttaaactcctggcctcatgatccacctgccttggcctgccaaagtcctgggattacaggcatgagccactgtgcccagccactcatttcttatgaatttattctaacacattttccggatgaacagggcaccttgaaacataggttagtgggctgggtatggtggctcctgcctgtaatcccagtactttgggaggcctaggctggtgtatcgcttgaagtcaggagttttttgttttgagacggagtcttgctctgtcgcccaggctagagtgcagtggagtgatctcggcttactgcaacctccgcctcctgggttcaagtgattctcttgcctcagcctcctgagtagctgggactacaggcacgtgtcgccacgcccatctaacttttgtatgtttagtagagccggggtttcaccatgttggccaggatggtctcaaactcctgacctcctgatctgcccacctcggcctcccaaagtgctgggattacaggcatgagccattgccccggccaaagttaggagtttgagaccagcctggccaacatggtaaaaccccatctctactaaaaaatacaaaaattagccaggcaagatggcatttgcctgtaatcccagctactcaggaggctgaggcgggagaatctcttgaatctgggaggcagaggttgctgtgagctgagatcgcgccactacactccagccagggcgacagagcataaataactccctttcaaaaaaccaaacaatgaaacataggttagcggagtctgcatccaacattagagtcagattgactaagttctgtatttccagctgattcctgggcgatgttggtgccactggtctgaccaccctttgacaactgctgctccagataattcaagtcggggtataacacaaccagtgagatgtaaaccaaagacgattccacggttagattctcaagaatgacttgttctgccgggcgcggtggctcacgcctgtcatcccagcactctgggaggccgaggtgggcagatcacctgagattgggagtttgagaccagcctgaccaacatggagagacccccacctctactgaaaatacaaaattagctgggcatgttggtgcatggtgcatgcctgcagtcccagctactcgggaggctgaggcaggagaatcacttgaacccaggaggcggaggttgctgtgagccgagattgcgccacctgggcaacaagagtgagactcagtctcaaaaaaaaaaaaaaaatgacgtggtcctatttctcccacaggttggtgtcttgttccgctaccactcagcagtgggctgatctctccttggcccttgaagtcaaccagtccctgacgtgcgtaaacctctccgacaatgagcttctggatgagggtgctaagttgctgtacacaactttgagacaccccaagtgctttctgcagaggttgtcgtaagtctctcctctcttacagagcagctgtgctttcgatctggggccacagacgagcaatggtcatgcctgacttggctgtatggaacctctcgctgatgtgaacacctgttcccatgtttagatccaggccgatggcctgtgaattttgttcttctctcattcctattccttcataggatcaccagtgcatgatagaaggtggggagttcacaagaaggggcttttggatgctggcacttgtggagctagccgggaaggttgaagttggacctgtcaaccgtgttgccatttgtgattcttttgtaggttggaaaactgtcaccttacagaagccaattgcaaggaccttgctgctgtgttggttgtcagccgggagctgacacacctgtgcttggccaagaaccccattgggaatacaggggtgaagtttctgtgtgagggcttgaggtaccccgagtgtaaactgcagaccttggtgtaagtccgtgctggctgcctgtgtgcgtgggtgtatatgcacacgccccccacctccgggtttgagtagggtggttatgagaacacttaattcctctaaaagttccaagcatgatgctaatgacaactggtaagacctgggtagatgatggtaggaaaaaagtataagtagtagtagagtagtagtaatattctatagggatttggggaatgtagctggttttcgggttttttttttcctctttatgtatgtatgtattttagagatgggatctcgccgtgttgcctaggctggtctcaaactcctgagctcaagagatctgcctgccttggcctcccaaagtgctagaattacaggcatgagccatgtcaccccatgctgtgttttctcttaatctgtgttcttagaactataactgtaacataaattgcatgcaattggttgtaaatggaattcatttacttattttttaatgaatgatttgcaaatcaggtagtcttctgggccagtgtacgctcagactcccaatggaagctattggaagctacatgctcaatgtgatcctccttttaatactaaaatcacaggacacgtggcctggcatagtggctcacgcctataatcccatcaccttgggaggccgaagcaaggcagatcccttgagggcaggagttcaagaccagcctgcccaacatggtgaaacattgtctctctactaaaaatacaaaaattagtcacgcatggtgggacatgcctgtaatcccagttactcaggaggctaaggcaggagaatcacttgaacttcggaggtggaggttgcagtgagctgagatggcaccactgaagtccagtctggccaatagagcaagactctctcaaaaaaaaaaaattataggacaaatctttagaaaggaattggggcctggcatggtggctcatgcctgtaatctcagcactttaggaggcgggcagaacacctgaggtcaggagtttgagaccagcctggctgatgcagtgaaaccctgtctctactaaaaatacaaaaattagctaggcgtggtggtatggtcctgtaatcccagctacttgggaggctgaggcaggagaatcgcttgaagtcgggaggttgcagtgagccgagatcgtgccagcctgggtgacagaacgagattgtctcaaaaaaaaaaaaaaattgtatctgcactgatggtttctgttcagagattcgattttatgttaacatctctggtattttttttttttttttttaagatggagttttactcttgcccacgctggcaatggcatgatctaggctcactgcaacctccggcttcaaggaggttgattctcctgcctcagcctcctgagtagctgggattacaggcactcaccaccacgccgggctaatttttatatttttagtagagatgggatttcaccatgttggccaggttggtctcgaactgacctcatgatccgcccgcctcagccttccaaagtgctaggatttacaggcatgagccactgcgtccagccatacatatctctggtattctttgtctctaacatcacctccaacagttaggaactgtcctcttcctatgaagtaactaatctaggatatgtacctggcatctgaaaactacccacttaaatttaatgacatattcagttcatggctggagacgatgagtagaaggaaaggattcttcccacacccactatatctaggccctgaaacattaaaaaagaagtcccacaagcagtgagatgtcaccgactcactaactgtatcttcaaatgaatgtctagtttttttggttgtgtgtgtgtgtggtgtgtggtgtgtgtggtatttttttgggggggggggggttttcttttttttttttttttggttttttttttttgatagtcttgctctgtcgcccaggctggaatgcagtggctccatctcagctcactgcaacctccacctcctgagttcaggtgtgattctcctgcctcagcctcccagggattaaggtgcatgccaccacgcccagctaacttctttatttttagtagagacgagttttcaccatgttggtcaagctggtctcgaattcctgacctcaggtgatccacccacctcagcctcccaaagtgctgggattacaggtgtgagccaccgtgccggccccctcaattcaactttttgatccatgcccctattttgctaagttgtcaacttccctttagtcttatgtgggttttcctccattacagtcatggaagtttctagaaggccgggtagggtctttgagaggccgaggcaggtggatcatgaggtcaggagttcaagaccagcctggccaacatggtgaaaccctgtctttactaaaaatacaaaaattagccaggcgtggtgtcggagcctgtaatcccagcttacttgggagggtgaggcagagaattgcttgaacctgggaggcggaagttgcagtgagctgagattgtgccactgtactccagcctgggtgtcagagcgagactgtctcaaaaaaaaaaaaaaaaaagtttctatacattcataaagtttcaagatttgggggtgtgttttcacttctccatcgtcatggactccaatctgccatctatttccaaggcccttccaggtcctgtgtccctcagctagtggtatgcttcacttgggacccagagatacatgggcattatagttcaaattataattaagtttagaactctattgagacagaagaaagaaaacagagctaaggtgaaatatctctgataatctgtgttggttaatatctaggatcctagtaccagatatgttggagtgtgagctggtgtcttctgcctgtaagacactacctctctagcaactgaatttagcaaatacaatcgtaatcccagcatgttagggaggccagggtgggcagatcatctgaggtcgggagttcaagaccagcctggccaacatggggaaaccctgtctctactaaaaatacaaaacttagctgggtgtggtggcacgcgcatgtgtgtacacacacacacccccctgtaatcccagctactcggaaggctggggcacaagaatcgcgtgaaaccaggaggcggaggttgaagtgagccaccgtgccagctgagaatcctttttacttctccaacttctgttggccacctgcattccttggcttgtggcccttcctccaacttcggcagagcatcttcaaacgttgccctggctcccttatcacgtcacctcctgctggctttgactctcagctccctcttatgaggatccctgtgattgctggacctacccaaataaaccaggatataaaccatcttaagatgctcagtcacctctacgaggtcccttttgctcgcaggtgccaggagttgggacttggacatctttaggggaggccattcttctgtccaccacaccaccccatgattccatttccatgtcaccactgtctctaagtgtgtctaacccacggctcaagagtcaaaggtgcatcacagcagtgagaactcacaggttcgggtttgctttcttcctgtggttgatttctaggctttggaactgcgacataactagcgatggctgctgcgatctcacaaagcttctccaagaaaaatcaagcctgttgtgtttggatctggggctgaatcacataggagttaagggaatgaagttcctgtgtgaggctttgaggaaaccactgtgcaacttgagatgtctgtggtgagttaacttataagttcaacttcctatacttacaccttactgaatctgtggctagtgtaaaataatcagtgaagccgacttcccaagttatataattgagaggacctttatagagtcgatcgagcatttactaggatggttaaaggaataagttctagtctatgtctaagtttttgtttttttttttcttgaagttttgctcttgtcacataggctggagtgcagtggcgtgatcttggctcactgcaacctccgcctcccaggttcaagcaattctcttgcttcagcttcccgagtagctgggattacaggcgcccgccaccatgcccagctaattcttgtatttttagtagagacagggtttcgccatgttgaaggttcatctcaaactcctgacctcaggtgatccgcccatctcggcctcccaaagtgctgggattacaggcgtgagccactgcgccaggccctatgtctaagttctagtctgtgtcatgcaaagaacacctgtgaaattttaaggatacagtgcctcaagccattcagccaaaagccactgcccagcaccccacattcagagaggtgggaattgggccaggcacagtggctcatacctgtaatcccagcacttcgggaggccgaagcgggcggatcacttaaggtcaggagctcaagaccagcctggccaacttgaaactccatctctactaaaatataaaaattagccgagcatagtagtgggtgcctcttttttttttttttttttttttgagatagtttcactcttgttgcccaggctgtagtgtaatggcgcgatctcagctcactgcaacctccacctcctgggttcaagtgattctcctgccttagcctcccacatagctgcaaataaacaggcatgtgccaccatgcctggctaattttgtatttttagtatagacggggtttctccatgttggtcaggctggtctcgacctccggacctcaggtgagagccaccgtgcccagccagtaggtgcctttaatcccagctacttgggaggctgaggcaggagaatcacttgaaccctggaggcagaggttgcagtgagctgagatcctgtcactacactccatcctgggctacaagagcaagactccatctcaggaaaaaataaaaaagaggtaggaattagatatcgtgccagaaaatgctggctctatcagcaggtgagtggtctcaacttggctatcttacaaataccttgtgagttagctacaatcagatgcacttgaacctggaatcctatctgggaggcaatcttaaaagaatttgactcgggatgggcaaggtggctcatgcctgtaatcctggcattttgggagtccaaggcaggtagattgcttgaggccaagaatttaaaaacagcctggccaacacaatgaagccctgtctctactgaaagtacaaaaatccgctgagcatggctgtgtacctctgctcccagttactcaggaggctgaggtgggaggatcacttgagcctgggaggaagaagttacagcgaattgagatcacgtcacctcactccagcctgggtgacagtgagatcctgtctcaaaaaaaaaaaaaaaacaaaaaaaacaaaggcgcctttttaatcactcactgacacgtgtagaggagcaaaaagtttgagttgctggttggcccaggaggtcaaggctgcagtgagccaagatggcgttaccacactccagcctgggcaaccgagtgagaccgtgtttcaaaaaataaagtggcagggtgcagtggctcatgcctgtaattccagcactttgggaggccgaggcaggtggatcacctaaggtcaggagttcgtagaccagcctgtctctactaaagagacaggtgaaaccctgtctctctaaaaccacaaaaatcaggcaggcatggtggcacatagctataatctcatctacttggaggcacgagaactgcttgaatccaggaggcagaggctacagtgagccgagatcatgccacagcactccagccctggcgagagagcaagactgtctcaaagaataacttcaaagatggaagttatttaacctctctgctcaaaagcctcagtgcttccctatgtcaatccaggtaaaatcctatattgacgatggcttcagggtcttctgtgagctggccactgcttacctatgacctcatcttgacaatcctccctgtctcactcatgcccgctgcctggatgttctattttacgtgtcagtcacatgtatcttcagggcctctgcacaagctatttctctgcctggagaactcccccccgagctctatgactcggtctcttcaccccctcacctccaaccattgtagccagaacccccagttattccctgtaccccttgcccttcagaacccctcatcgcctccatattttcctgttagcagatgagccctgagggcggagacgttttgtttgttttttgagaccggagtctcactctgtcacccaggctggagtgcaatggcgcgatctcggctcactgcaacctccgcctcctgggttcaagcgattctcctgccccagcctcctgagtagctgggattacaggtgcctgtcaccacgcccagctaacttctgtatatttagtagagacacggttttaccatgttaggttggtcttgaactccttgacctcaggtgatccatccacctcggcctcccaaagtgctgggattacaggcgtgaaccaccgtgcccggcctgagacttctgttggtcatgcagatccccaacacacgagggtgggcttggcttgccggagggcatcgatcagcactggctgcattaacgtgttgatttctgtgtttccccaggttgtggggatgttccatccctccgttcagttgtgaagacctctgctctgccctcagctgcaaccagagcctcgtcactctggacctgggtcagaatcccttggggtctagtggagtgaagatgctgtttgaaaccttgacatgttccagtggcaccctccggacactcaggtatgatccatttacttccccatcaggctttctccagagtggtaggtttaggggaagcataatgacatggacctgctgtaggagactgatctggtagctggattacaggttcccgccatcacacccagccaatttctgtatttcacttggagaaacggggtttcaccatgttggtcaggctggtctcaaactcctgacctcaggtgatccgcccgcctcggcctcccaaagtgctgggattacaggcgtgagcaaccgcacccggccaccttttttttttttttcctttgaggcaagaactcactatgttccccaggctggagtccagcagcacaatgatggctcgctgcaggctcgctccagctcctgggctcaagcaatcctgcctcagttcctgagtaggtaggtttataagcatgaaccattgcacccagccacggctgccgtctacctgctcatgatagccatttgtcactgggctgtgttttgtttgttgcattttgtcagggttttggggttttgttttgttttttctttctttttttttttttttttctgagatggagtctcactctgttgcccaggctggggtgcagtggttgctaactgcaacctccacctcccaggttccagctattctcatgcttcagcctcccaagtagctgggattacaggcatgcaccaccacacctaggtaatttttgtatttttagtagagacagggttttgccatgttggccagggtggtctcaaactcctgacctccgtgatttgcccacctcagcatcccaaagtgctgggattacaggcatgagccaccgcacccggcctgagttgtattttgataccatggcatcaaagaaccaagaagccccttcctaggaatgtgggaacttcagaaattctcacaagcaatatactctactgctggcttaaaataatctttatgtagaagaaacatagattacttgtttatttaacatgaaactcagcctaagatactttgtaagtcaaaagacatatggacactaagggtttttttaagctttaagtttgtttgtttgtttatttattatttattttggagacagttttactcttttttttggggtgcatcttttttcttttttttttttttttttcctttttttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagcgtttgtgtccctgggtacttgagattagggagtggtgatgactcttaacgagcgtgctgccttcaggatctgtttaacaaagcatatcttgcaccgcccttaatccgtttaactctgagtggacacagcacatgtttcagagagcacggggttgggggtaaggtcacagatcaacaggatcccaaggcagaagaatttttcttagtacagaacaaaatggggggctgacccccccacctccctcccggacagggcggctggccggttagaggggctcctcacttcccattaggggcggccgggcagaggcgcccctcacctcccggacagggcggctggctgggcggggggctgacccccccacctccccgcccggccagagttttactcttgttgtccagcctggagcgcaatggcgctatctcggcttactgcaacctccgcctcccgggttcaagaggttctcctccctcagcctcccaagtagctgggactacaggcatgtgccaccacacctggctaatcttgtatttttaatagagacagggtttctccatattggtcaggctggtctcgaactcctgacttcaggtgacccgcctgcctcagcctcccaaagtgctaagattacaggcgtgagccaccatgcctggcctgcatctcctctgtttaactggtactccggggtccactgagtagaagttgccaaagtgggtgatagagcgggtaagcaggtattagagctatagcccagctgtactcagcaattccattttctgtgtatgataatcaacaagcatctcaaactgcacaatggctatataccattacaaggttaacctgatgttatgtttttctctatcagatcaacatggttgagaataagaggaatgaaaaaaaggattaaaaagagaaatgaaagtctttaatattacattttattatttacttcatttattttttagacaaaaatctcactctattgctcaggctggagtgcaggggcccgatctcagctcactgtaacctccgcctcccaggttcaagtgattctcctgtgtcagcttcctgagtagctgggattatagggatgcaccatcacacccaactaacttttatatttttagtagagatggactttcaccatcttgcctaggctggtctcaaactcctgacctcaagtgatctgcccacctcactctcccaaagtgctggcattacaggcatgacccaccacatctggcctcattttatatttaaaaataaaaaataagcaaatcaagccaggtacagtttaggcaacatggtaaaaccccaactctactaaaaatacaaaaattagctgagcatggtggcaggtgcctgtagtcccagctactcgggaggcagaggataggatggcttgaacccaagaggcacaggttgcagtgagctgagatggtaccactgcactccagcttgggcaacagagagactgtctttttttttttttttttttttttttttttttttttttttgagatcgcccaggctggagtacagtggcacgatctcggctcactgcaagctccgcctcccgggttcacaccattctcctgcctcagcctcctgagtagctgggactacaggcgtccgccaccacgcccggctaattttttgtatttttttagtagagacagggtttcaccgtgttagccaggatggtcttgatctgctgacctcgtgatccacccgcctcagcctcctaaagtgctgggaattacaggcgtgagccatcacgccccacctgagactgtcttttaaaaaaaaaaaaaaaaaatcaatgtggaacactcctttgccacctagaataatcaggaaaggtgacccatgccctgtgcctccttaacagactttcaggtacttgggaatttgaaacaaatctccttgatgcacaaagtaaccttttcttcccccattgtaccccaggttgaaaatcgatgactttaatgatgaactcaataagctgctggaagaaatagaagaaaaaaacccacaactgattattgatactgagaaacatcatccctgggcagaaaggccttcttctcatgacttcatgatctgaatccccccgagtcattcattctccatgaagtcatcgattttccaggtgttggtgaactgcctgtgactcctctcctccccggcccctacccctcagggataatgagttcattgctgggctagatgttttagccatgattctgcctctgttttatacctgcacacatccttatctttgttacatatgaaatatctgtatcacgggtatattgagagaaataaaggtgagagcattcacaaatgaa

SEQ ID NO: 2640 - DNA, 34800 bp, Homo sapiens; identical to SEQ ID NO: 2639
  source 1..34800: mol_type = genomic DNA

SEQ ID NO: 2641 - DNA, 34800 bp, Homo sapiens; identical to SEQ ID NO: 2639
  source 1..34800: mol_type = genomic DNA

SEQ ID NO: 2642 - DNA, 15287 bp, Homo sapiens
  source 1..15287: mol_type = genomic DNA
cgcggggatggaggcagggaggggggacgatggcgggacgggtggcgccggggttccagccctgcgcctgctccggagcaccgggcccctctcgctgaccccctcgtcccaggaccccgcaggcccgagtgcctgggctcgtcctctttcgcgcccgctgccaggtgccagggccgcgcaggcgggcggaggtgggcaggaagcgccacgccgaggagccggggactctgggagctagcgggagacgccggcgtccgcccagccgacccctctgggccgcggccgacggctcccggaactgggcagccgcgggtaaaggcctagcgggcttgataacccctgcgccctggctgggaggccgcgctgagcggggggcagggcgggccgggggaggaggctgtgcaagggccgcggggagatcccggccgagaacgagagggacggagctgggcgctgaatggcgggcgttctggcaagtctccccctgcgttcccgaggccacccgaaagtaggagagctgtttgggacccagtttggtggaggagctctggacctgtaggaacaccgcccctgtacgtttcctgcagtgccccctccttttctcattgccctggagacctgggtgatcaccggagaactgccctcggccccgcaagtcccgtcttgactcagtggccctagatccgaggttaaaccggaacctaggctttctcaggcttctggagccctctcttaacccttccgcagcccctgggacgggccagcacccagccagctcctccgctggttggccctgctaaggcaggtggcccaatgcagccagttctccttaagcgtaccctgcccaagaagccccgatctcagtggaggagaccaggtgccaaataggggcacattccatttaagtgagttcagaggcctcagaaaagacttcccagggacggagacttttgagcaggatcttaaaagattggttggggcccgagtggtggctcgcgcctgcagtccccgcactttgggagggcaaggcgggcggatcacttgagcccaggagttcgagaccaccctgggcaacaatggtgaaaaccccgtctctacaaaaaccaaagccaaaaattagccaggtgtggtggcacaccactttagtcctagctactcaggaggctgaagcaggaggatggcttgagcccaggaggtagaggttgctgtgagctgagatcgtactactgcactccagcctgggcaacagagcgagagaccctgtctcaggaaaaaaaaaaaaaaaaaaaaaaaaaaaaaaaaaattggttgggactctaacagaggaaaaaggtcattccaaactgggaagagtgtatgaacaaatttaggacagcaagagcaagaatccggtgagcctggggtataaggcacaggctgggacaaactcagaaaaatagcttgtgggagcccagtgtttggactctataagtaaccttggacttttcgggaggtgcttggtgcttggggtgagggattagaatgggatgagactgaaggcagaaaggctggtgaggagatcgggtccaataaatgctggtcggggcagcaactggctggcaaagcagtggggaggaattgctaggactcttcacactgcctaaaggagcaagggaagaaagatttgaagagagaggtcaggtttctaatgtaaggcgtgggtgggaagatttgcagcaaggtaaatgacaagaggaggggaatgatgagttcagttttacatgggagaagtttgaagcagtggcaggttgtccatctggagatgtcaagtgagaagttcattcatttatttattatttatgtcagcctcaaaggctgcttacataaaagtcacagagaacataaaatgatgaagccattaaaactcagctaaaaggatctgatatctgcggaagaaaggcagagtggggtggataattattactggaaaatctaggcacagaaaagccactgaaaatgaacacaggactcctatctgagcttgctggtggccaagaaggaaaaaggacacctaaataaagcagtttaccagggtggaactcagggaaaggtgttcgtgaagcttcaggggagaggcaagacgtggcaggaaggccaggtgtgatggctcacacttgtaatcccagcactttgcaaggccaaggcaggcagattacctgaggtcagaagttcaagaccagcttaaccaacatggtaaaccccgtctctactaaaaatacaaaaattagcccagtgtggtggtgggcgcctgtaatcccagctacttgggaggctgaggcaggagaatcgcttgggcccgggaggcataggcttcaatgagccacaatcatgcctgggcaacagaggggcactccatctcaaaaaagaaaaaagaaaaaaaaggtggtaggagataaaatgggattcctcaagctggagtttgggagagggacgagagctgaaaaccaggccagggcttcagcagggccaacatttgaggaagggctgatcctctcctgggaggaaggtccctccttggctggaatggggttaggggtgcaggggaggagtggtggcagtgatccattcgtactattcttcttgcaggacagaagtcggtcctaggccccccaggctctgaccttctttcccaggatgaggtggggccaccatttgcccagggcctcttggggctctggttttagaagagcactccagcgaccaggtgagcaggaagcaggggtttctgtttttacctctttcttgctttccagggtccacatgatgcctccaagacagcagggatccagacaccaggtgcactagtctcagctccgtggttctctagctgttgaccttgagcatgtcgcttcaccttcctcagctgcctttttcccaacctaaaataagggagttggacttggccaggtgcggtggctcatgcctgtaatcctagcactttggaaggccgaggcaggcggatcacaagatcaggagtttgagaccagcctggcaacatggtgaaaccctgtctctattaaaactacaaaaaaaaaaattaaccaggtgtagtggtgcacacctgtaatcccagctagttgggaggctgaggcaggagaatcatttgaaccgggaggcagaagttgcagtgagctgagatcgcaccattgcactccagcctggacaatagagtaagactctgtctcaaaaaaaaaaaaagagagttggactagatcatcttcgagagtctcttgtagctacataagtctaggaacttgtctgattttactttacatacaacagagatttactgagtgcctgccgtaccgcagacctggtgttaagttctaagtaaataattgtgaacaaaaacagacgtaaaggggacaaaaaaattttaaaacacccaaatgtgatccctctcatggaggagagaggaatgaatgttaatcgaataatcacacaatgaaatataaaattgcaaaataactgctgcaaaggggcagtacatgctgctatgagagcaaatactggggggtttgatgtagacatgggttctgtgtattgcatgggatctgcagatgctatttcttccttctctctgtagatgatcgtatccccttcctgatccactggagttggccccttcaaggggagcgtccctttgggccccctaggtgaggcctgggtgtcataccttaggactagtctgggcacaacagagcagactgggaagggtcaggacttggggctagcttgatctcttggggaccttggggaggggcttggtcctttgggggtgggaggacagtggcagctccaaggcctgagaggaagttggcttagatcatctgtggtagaaggcatagtagtcagtggagggaggaccctgtgggaagtgggtggagcctcacatggccagcctgagttccaggcgggcagtcagcagtggggtctggagggctagggctaaggcctcagcacctgggaagggtgtgagagtcagacaagcctctaaacttgggggtccagtgtggggcctttatctcaggaaaccagaagtctagcagtgcagataggcttggacccagagcctgtgaaggggctgatccaagttacaagtcccagctcatcccctctccttgttcccagggcctttatacgccaccacggaagctcggtagatagcgctcccccacccgggaggcatggacggctgttccccagcgcctctgcaactggtaaagggactggctgggaccctggtcagggggtgtggtgggcagacggggctggaaggagaagcagggtgagggaggcatagaggatccactgccatcttccatcggtggtccctcctcctctctctctctccctcccatccgtctatgtatcccttcctgcaatactcttgcaatgcacacttatatgtacaaagcgctaggagagccataccatccctatgctcaacaaagttgggtcaagcaggttaagacggcacataggtcactgtgaaaccagtttgtccagtggcttcccactttctgacataggggttccagactttctggacagtctatattttctcagggagtcttgtgtgcccaccattgtgggccccagcatctatgccgtgatgtcccagcctgacctcaccaccgccctgattggccctaagctacatctccaggcccctttccctgacacatttcccttatcttcccactcagaagctatacagcggcaccgccggaacctggctgagtggttcagccggctgcccagggaggagcgccagtttggcccaacctttgccctagacacggtccacgttgaccctgtgatccgcgagagtacccctgatgagctacttcgcccacccgcggagctggccctggagcatcagccaccccaggccgggctccccccactggccttgtctcagctctttaacccggatgcctgtgggcgccgggtgcagacagtggtgctgtatgggacagtgggcacaggcaagagcacgctggtgcgcaagatggttctggactggtgttatgggcggctgccggccttcgagctgctcatccccttctcctgtgaggacctgtcatccctgggccctgccccagcctccctgtgccaacttgtggcccagcgctacacgcccctgaaggaggttctgcccctgatggctgctgctgggtcccacctcctctttgtgctccatggcttagagcatctcaacctcgacttccggctggcaggcacgggactttgtagtgacccggaggaaccgcaggaaccagctgctatcatcgtcaacctgctgcgcaaatacatgctgcctcaggtgggtggccctttaccccaggttatcactgctgcccgttgactcgccccctaggtcctgggttactttaactcctggtcccttcacttcccagtggtgcgaccctgagcaagtcagtaacttccccagccttctgttcctttctttttgagttgctctgatcaaatggggtactgcatataatattagcacagcggcctggatcacagcaggtgttcagtaattgctagttataactgttatcctcatcaatgtcttcatccttggacactccgtcttcaggggtcccctgggaatagaagcagtcaacaggacactaaggtctttcttaactctcaaccatgctcttcccaggccagcattctggtgaccactcggccctctgccattggccgtatccccagcaagtacgtgggccgctatggtgagatctgcggtttctctgataccaacctgcagaagctctacttccagctccgcctcaaccagccgtactgcgggtatgccgttggcggttcaggtgtctctgccacaccagctcagcgtgaccacctggtgcagatgctctcccggaacctggaggggcaccaccagatagccgctgcctgcttcctgccgtcctattgctggctcgtttgtgccaccttgcacttcctgcatgcccccacgcctgctgggcagacccttacaagcatctataccagcttcctgcgcctcaacttcagcggggaaaccctggacagcactgacccctccaatttgtccctgatggcctatgcagcccgaaccatgggcaagttggcctatgagggggtgtcctcccgcaagacctacttctctgaagaggatgtctgtggctgcctggaggctggcatcaggacggaggaggagtttcagctgctgcacatcttccgtcgggatgccctgaggtttttcctggccccatgtgtggagccagggcgtgcaggcaccttcgtgttcaccgtgcccgccatgcaggaatacctggctgccctctacattgtgctgggtttgcgcaagacgaccctgcaaaaggtgggcaaggaagtggctgagctcgtgggccgtgttggggaggacgtcagcctggtactgggcatcatggccaagctgctgcctctgcgggctctgcctctgctcttcaacctgatcaaggtaacatcccgatcaaggtaaccccccaacctgctccttccctccccagcaccccaagccgcccacgcccccacatggttccctgttcaccccttgctcctctcccagcaggaaactgctgcttcctgcaaaggtatgaatcttctccctggatctggtttcagctctgagcattttggcttttagtgggattgcagagagagaagccacaaggctggggaaggcttggtggctggggaagggaacctggggacgtggggactttaataataatgctacatggattcctaaaaatggtttcctttttgtgtctttcctcctaggaggcaggcctatcctctgctttgcaggtccagaaactcgattgtgtctgctcctccagaggtgattaggctctgagagtgatgactcatcctaactaaatcaccagagacgggtttataaagcagatgccattttattcatttatactaggaagataaatggcattggtaattggcttaggggagtcatcatgagggcaggtccactccagaaaccaaattacagacctgaggactgtgctgtgagtggcacagctgagcgaggtctttgagggctggaaggagccactctgtgtgatgtgtgccaggcgcgttatcagtgttcatccttttgtttttcacattactcctggaaaggaaatactattatgatcccttttatagatgaataaactgaggctcagagaggtaaagtaacttgtccaagatcactcaaatagtaagtttaaaagcccagggctttgtgattctgaatcctgtgctctttctgccaaactatactggtgcattacggatatgtctgtcgagctgtgggaccttgctaggtaacctttgttttctctaggaatgtttcagcaacgcattttgaggaggcagagtgctggttagtgctggcagaatttcaacactttttaaaaatttaaatgtatttttatttttattttttgagacagagtcttactctgttgcccaggcctagagtgcagtggtgcaatcatagctcactgcagcttcgaccttctgggctcaagcaatcctcccacctcaacttcactgagtagctgggacctcaggcatgtgccaccatccccagctaatttttaaaattttaattttgtagccgggtgcagtggctcacgcctgtaatcccagcactttgagaggcgaggcaggtagatcacctgaggtcaggagtttgagaccaacctggccaacatggttaaccaagtgtggtgccgggtgcctgtaatcccagctacttgggaggctgagacgggagaattgcttgagcctgggaggcagaggttgcagtgagccaagattgcgccactgcactccagcctgagcaacagagactccctctcaaaaataaaaaaataataataacaaaattaaattaaattaaaaaataaaaaatttttaattttgtagagatggggtctcactagtgatcctctcactttggcctcccaaagtgctgggctacaggtgtgaaccactgtgcccagccaactttttatttttataggcaccaaagcataagggctaagaacagggatttggtaactcagctatttgagttcaaatccaggctctgctacttattagctgtgagactttggacaggttacttagttctgtgcctcagattccttatctgtgaaatggagataatactagaacttatatcactggcctaatatgaagatgaaatgaactcatcctcagggtctaggacatggtaagtgctatttaattgttttttgtttgtttgtttttttgagatggagtctcgctctgtcgcccaggctggagtgcagtggcaccgtctctgctcactgcaacctccacctcccggatttaagtgattctcccagctcagcctcccaagtagctgggactacaggcacctgccaccatgcccggcttatttttgtatttttagtagagacagggtttctccatgttggccagactggtcttgaactcctgacctcaggtgatccacccacctcagcctcccacagtgctgggattacaggagtgagccaccacgcccggcctatgctgtttaattgtttgtcacacatagaaacagacttagttccagaccagcctggccaacatggtgaaaccccatctctactaaaaatacaaaaattagccgggtgtggtggcacgtgtctgtaatcccagctactcgggaggctgaggcaggagaatctcttgagcccaggaagtggaggttgcagtgagctgagatcgcgccactgtactccagcctgggtgacagagcgagactctgtctcacaaaaaaaaaaaaagaaaaaagaaagaaacaaagaaacaggctcgggcagcccaccccttctcacacatcacctccgacaggaggtcacagctgctgctgaggccaccccgccttgaggatgtgcctgccggacctgagttgcaacgagaggctgcagtctcccgaggggattcagaaagcccccagttattgaaaacccagcagaattgtcagccctgcacccccaagccctcttggagggagggttgccctggcagagcactgagcccatctgtttattcaccatcctgtggattcagcttcacagggtgacatattctgtcacaggttggtgttggagaaggggcactatcacctctatgagagtaacctcacatataaacatgaaaacaagccaggtgcagtggggcacacttgtagtcacagctgtcaggaggccaaggcaggaggatcgcttgagcctaagagttaaaggctacagtgagctatgatcacaccactgcactccagcctaggtgacacagcaagactctgtctctaaacaaataaaaattaaaacattaaaaagtaaaaaaaacccagatgttaaaggacgtgccacaaaacaacgtcatggtttgttgccagaggaatgacccttcttccctttcagaaccattgcaggaatgggggaagatatcacaaacccccaacatttatttctttgtcagatatttgagtgcctgctgtgtgccaggcaatgtgttagaatctgaggaaatgtcagttaacaaaactacaggtttcagccctttctgatctagtctgagctcctctcccagaaggaaactgctacttcctgcacagtttgagcacaaaaatatcaatgtaaccatataaggaaaaattacagcaaatgcctgggaagaaggagccccagatgccatgaaagtgtatagtgggggaactggtctgcggggtcaggagagcctctttgtggaagggcatgtcgtctgacccttgtagcattagccaaaggaagaagttgggggaggggaaatgccccaggaaagggcagcaccctggaggctttttttttttttttttctcttgagacagggtcttgctctgttgcccaggctggagttcagtggtgtgatctcagctcactgcatccctgacctccagtgctcaagggactacaggcacatgccaccatgcctggctaatttatttttaattaagaaaatttttttaatagagatggcatcttgctacattgcccaggctggtctagaactcctgggctcaagtgatcctcccacctcggcctccctaagtgctgggattacgggcatgagccactgcacctggcctatggaggctttgaaggaggaaaaaccttggcactgttaagatgaaaaaagccgaaagggcaggagcatagcgagtggggccaagaggcttgtgatgaaggcatcgtagtcggcagggcccagatcacacaggcccttaaagcagtaggaactgcatgttgaagatggtgatgtatttgtgatacctagcccggtcccaaactaagtgtgtaatacatgctaattccttctcaccacctcctgggtttgaaaatgtatcagggtgtttgggaaagagaaagaagttcctaatgtctgcagcacatgagacaggtgttgagagatgaccctggaaaggtcaaattagggccaaattatgaaaagttttgggccaggtgcagtggcttatgcctataatcctagcactttggggggcctaagctagggagcccagaagttcaagaccagcttaggtgacacagcaagaccccatctctagttttaagaaacgtttcatattccaggctaaatgtttggagtttgccacataggcagtagggagccatggaaggtgtcgcagcaggggagtagcatgatcagacaaattatgctaagttcaaggggagatcacagggctggagcagtcatgggagtgtaccttaagctgaaccttgaaggctgaacaggcacatggaaggccacagtgactctcccctgcttctttttcaggtggttccacgagtgtttgggcgcatggtgggtaaaagccgggaggcggtggctcaggccatggtgctggagatgtttcgagaggaggactactacaacgatgatgttctggaccagatgggcgccagtatcctgggcgtggagggcccccggcgccacccagatgagccccctgaggatgaagtcttcgagctcttccccatgttcatgggggggcttctctctgcccacaaccgagctgtgctagctcagcttggctgccccatcaagaacctggatgccctggagaatgcccaggccatcaagaagaagctgggcaagctgggccggcaggtgctgcccccatcagagctccttgaccacctcttcttccactatgagttccagaaccagcgcttctccgctgaggtgctcagctccctgcgtcagctcaacctggcaggtgtgcgcatgacaccagtcaagtgcacagtggtggcagctgtgctgggcagcggaaggcatgccctggatgaggtgaacttggcctcctgccagctagatcctgctgggctgcgcacactcctgcctgtcttcctgcgtgcccggaagctggggtgaggacctatcctcatgcacaggcatgaagagggaagagggttggaggtgaagaagtgggaaaagaaagtgccagggaaaccagaggtaccgatgagtgaccagaaggtgggatgaagaagtctagtttaggggccgggagcagtggctcacacctgtaatcccagcactttgggagcccaaggcgggcgtatcacctgaggtcaggagttcgagaccagcctcaacatggagaaaccctgtctctactaaaaatacaaaattagccaggcatggtggtgcatgcctgtaatcccagctacttgggaggctgaggcaggagaattgcttgaacctgggaggcggaggttgcggtgagctgagatcatgccatcgcactccagcctgggcaacaacagcaaaactccgtctcaaaaaaaaaaaaaaaagtctagtttgggtggaggtgacaggagcaacagaagggaggagccaggcatggtggctcctgcctgtaatcccactgctttgggaggccaaggcagaagcatcacttgagcctaatagtctgagaccatcctgggcaacatagcaagaccctgtctctacaaaaaattaaaaaattagtcaggtgtggtggcatgtagctatcatcccagctactcgggaggctgaggtgggaggattgcttgagcccaggagtctgaggctgcagtgagttgtgatcatgccattgtgctccaacctgggcaacagagtgagaccctgtctctcaaaaaaggggaagcaggtatagattcccagaggcaggctgatgaaaaaaaggcatggtagatggacagactgcctgctgaattccctccctggtctctcacctcccctctggccaccttctgctccagcttgcaactcaacagcctgggccctgaggcctgcaaggacctccgagacctgttgctgcatgaccagtgccaaattaccacactgcggtgagtgacctgggagtggggcatcctggtggccagctaaggtcaagggtgagctccctgcttcctgacatacttggcacagacccacccaagggatagtaaatggaggagagtctaggccctgacctgtcccctccacttcccccaggtccactgcaagcagcagggcagcagggaaacatgccacctgtaatgggtgctaagaaacctctcacgtggctaaaatcagcctgggggaggtggggagagagggtggaataatacctaggccggttgcctggtaacagtgccactgatcccctcccaggatttttcttgcagcctcccgaggaggaccctaatgctgggcactcagtagacaccccttaagtgttgactgatatgtggggaacctgagctcctgggttcccagtttctgattggtgtaaggggaggcaaatgaggagagaaaaaggaagagcagggagaaggataggggagtcagaggggagggagaagcagaggctgtggagggggtgaaaaaggcagaaaaagggaaacggaaatggtgaaaaggaagggaatagataagaagggagtcaggggaagagggaaggaaaggccagctcccctactctgactcctctgccaggcgccacaccccctattgctccagcctttctcctgggcctgcatttctatgtccaggttcctcttgccccatgcagggccctctttggcccaagtcctgacacccagcacagggctgccccattaaggctgccagtaccacccccaaccttgcctccccctcctctcaatgagccctcataaccttgggttgcacgtggctgtaggctgtccaacaacccgctgacggcggcaggtgttgccgtgctaatggaggggctggcaggaaacacctcagtgacgcacctgtccctgctgcacacgggccttggggacgaaggcctggagctgctggctgcccagctggaccgcaaccggcagctgcaggagctgaacgtggcgtacaacggtgctggtgacacagcggccctggccctggccagagctgcccgggagcacccttccctggaactgctacagtgagtcctgtccctggtcccattgcccccagcccttcagactacttccctctctcaactgtgctcctccaatcctagggagtgcttctgggcctgggcctggtgcctgtcctttattcctggtttctgactgatccttgtcaacctagctctgagccaacccaccccctctgtgactggcgcttaaactgcaccaattccctaccaccatttctcctaaagccctactgtctctggtcccactgaattctagtatcagggtcggctgtggtggctcacgtctgtaatcccagcacttcggggggccaaggcgggcacatcacctgaggtcaggagttcaagaccagtctggccaacatggtgaaaccccgtttctactaaaaatacaaaaattatctgggtgtggtggtgcgcacctgtaatcccagctacttgggaggctgaggcaggagaatcacctgaacccggcaggtggaggttgcagtaagccgagatcatgccactgcactccagcctgggtgacagagcaagactccatctcaaaaaaaacaaaaacaaaaacaaaaacaaaaacaaaaaaaaaaaagaattttagtattagtccctgcctcccactggccagcagcctccacctctggctcattgcagttacctgatcgcactctgcagccaggagatgagttgtgaggccccctgactttccatccatctaccctcgggccctccttctcagagctctactgaatggcatcgactttctctctcctgccagcctctacttcaatgagctgagctcagagggccgccaggtcttgcgagacttggggggtgctgctgaaggtggtgcccgggtggtggtgtcactgacagaggggacggcggtgtcagaatactggtcagtgatcctcagtgaagtccagcggaacctcaatagctgggatcgggcccgggttcagcgacaccttgagctcctactgcgggatctggaagatagccggggtgccacccttaatccttggcgcaaggcccagctgctgcgagtggagggcgaggtcagggccctcctggagcagctgggaagctctggaagctgagacactggcggcaggcacctagctatgtgaccactggccctaaaccttttccctctgtggcctcctggcttgcactgctccctctagaaagattccttcaggtctggaggcagaggaatgggcatagctgagccagttgccctcctagggcatgtttgaccaggactgagtctggaatctccaagttaaagatggtgaatcaatgcttcgggcttggagatggaacatgcctcctctccattcagctagaaggaccaaagcatgtggcatttggatggccagagtgccctgaagcaccactaccaaccttgcctccccctcctctcaaagagcctctgactgtgtcaccaaggggctcacatcttatgtctgccatgccaggggtgtcgccatccagatgtgttggaagcttcccctcctgccttatgctcacctgtggacaccgaggatgccctcacattggtgctttctcctcatcctcatgccccctttgccacaatggtatgatggcttggtagcccctcgaggcagatgcacctgacttgctgctattaaaaagccgtgtgccttctaccaat

SEQ ID NO: 2643 - DNA, 15287 bp, Homo sapiens; identical to SEQ ID NO: 2642
  source 1..15287: mol_type = genomic DNA

SEQ ID NO: 2644 - DNA, 54251 bp, Homo sapiens
  source 1..54251: mol_type = genomic DNA
taagagtgttttcagtattttattaacaaatgagctggcaagaggacaagtgatctagtagtatcacccccaccctcatggagcagccaccacaagcccaccatggtggggggtgtccaacatgctctgctggcccagttcccagccgatcccctgagtcttggcgcccgtttagtcacccttcagctgcttgggaggcaggaagagacttcccctcttcacgaggtaagggagacaaaagcagccatttggatgccagggccacaggggcaagccatgccctatttctttggagggacagaatcacttcttcccaaggccagacactgtagcccatggtactcagccttctagaggagggtagcctagcagaggagaagccctgagtggaagcagcattttgaaggcatcgtcattcttagaccagctaagagctgagggcattctctatctttgccagcagacagtgagactccaggattaaaattaaaagcccgtggtgcatcctttccttgacattaactttccacaaaaccttggaggagtcaaatcccacactgcacatactccggtgtctccagctgtgaagtgggaccagtatcaatacatgggaaagtgctgagaaggaagaaaatatttcaggtataatactaatccatcaaacacgttttattcaagaagcttggcaccaactttgtgccacatcctcaactcttcaatgaaaagagcggtgaccaactcgctcccgttggtccctatggcaggtgttggaatgaggtgaggctggcctcctctgtttgctcacagctttattcctctagcttcagataaaaataattataataggcaataaagtctcttcacagtgtatttactgtaactacaacagctcgcaagacacattctttttctgcagaattgtagcgggtacttagggagtttgccgaccagaccttctgcacaggaagctggcttgcatcatggaggcagtggactcctgatagtcccgcctgcgcaggcccctttaagacactgacacaaaagactgcccagagtggcatttgctgctgaggctccagggcaaaaaccccatgaacaggaaagcatcctctcagaaacagataatccgcttctcatcttcatagactttggcctcctctggttttatcaggtttccatttaggctgttgaaaaggaggaagacaaaagtacacaggtaaaatgttaaggatcctcgcacactccttcccaaggtgtgttcatagcacacactcgtgtatcacacaatacacatgtatccctgaaattaaggaacataccctttgcagatagttccttcatattagcatggatcctctccagctgccatccctctgttcactgggtctcactaaggtcacctgtagcctccataagcctgaatttaatgacattttccaggtcttgtctttcttggccctcaggattttggctgtcctgacctctcctctccctccttcttgaggcactccctccccttggcttggttatatgcgctgatttttctcctgcatctgagcactctacttcaatttcctttcctatattctcctccatgtgacctctacatctgagatttcctccaggtttggggctaagcccttttccccacccgatctcatcaatgccacggccttgtttgtatgtccgtggaggcagttacctgcttggcatcctcacttggacctctcccccacacctcaaagtagccacacctcctagggtcccctggcttagtgaatggaccactctcatcctgctgagcaggttagtaacctgggggtcaacctggacaccttccttctcatccccatgttccttgtatcacaaagttctcccctaattcctaagaatctagaatgcctccctggaacctctatgtctttggccggccatcttggtctgagcacccatcatctcttccctgcatcagtacaatgtcctactgacaggtcatttccacgtactctggccttctccaattcagtttcctagaagagccaagaattggtctttttgcattgcagatctgatcacatgcctctcctgcttcaaactgttcactgactttccatcacttttaggataaagaccaaaatgcacatcatgacccacagatcttttatggtccagtccctgcctatctcctcagcctcctgtagtcccctcttccacactgtctgaaccctggggcacagcagcttctggcagttcttccaggacaccacactccctcctgccccagaccctttgcacatgctgttccctacgcagaatactcacctcagctgactagctcctattcatccttcatggcttagtgtaagtgctgcttcctcagagaggccttccctgcaacctcatctaaatcaggttccctcttggccttcccctttgtgatagtacccatcacagttgtaattaaataattacgcaaatgattttttctttaatgtgcttctccctttctagacagtgaacccatgaagccatgttgttcaccactggatttttggtgctagcacagtccctgatgctcaagcgtttcgttattcaaggaataaatgaagacacagcactagtccctaggaccttgactcaggccccaccctcccagagccacagtctggaggagatagcctcacagaaagctgttatactggagtgggatacatttctgtaatttacagtgttcattgttcacctctaatttctgttcttaaagacagaactcatcaagggacttcagacttccaagttattttcagaaaggaatgaggtagaaataagtgtcagtacagttaacaagtccaaggagaaggcttactctgtaagtgttggctccaagcagagctgctccctgaacgtggctccccggccagctcaaccacaaccctgtggcctggtgtggcagtccctggcagggccaacaaagccacagccttctcagagcccagtcccatgaagtcacacacagaggagcatgctctggaggctcccagaacaagccagggacctaagtgaagacactcccaagaccagcacccatgccgcctgtcctgccctctctgaattggtggccagttcccctctccaccctgacacaagtgcaggccttgaagctgaagtctcctggccctactaaaatggttccttgtgtaggaatggtgaccctcaagagggaagcaatgcagattttgaaacttgacagaattaaagcaactgtaggtctttactacccgcctgaccagctacagagaaaagtggaagccaactgtgctctgcaaactgttctgtagtctggcagtctccttcctctccccctctgcctgctgtcctcaaaacttaagaatcagcagaaacggagtggcctgagggcaaacacccatgcaaacagttccagtgccctccagtgcttcccaggctgctgggcaggctgggcttcgcaggcacacaggccacaggtgtctgtttagatctgggctctattctctatgatggtgtttttctttttttcttttttgttttttgagacagggtctctggcacccaggctggattgcagtggcatgatcctggctcactgcagccttgatctcccatgcatccatcctcccacatcagcttcctgagtagctgggactacaggcacatagcaccatgtcgggctaatttttgtagtgacggggtttcgcatgttgcccaggctggtctcaaactcctgtgctcaagagatctgcccatcttggcctcccaaagtgctggtattacaggcatgagccaccatgcctagccaacagtgttttttttaaaaaaaaaccttttgtctacaaccctaaataagaattacattttatgttgtgaaccaacacttatgcaaacacacacccactcacatgcaagcatgaactaagatgaatgaaatgatactttcataccatgcacattgcatcctgatattttgttctgttctgttttctttttaaatattgttggttgcaattcaccaaactgatcgattttatgacaagttccaaacaagttctaaagcaaagtttaaaaaacactgtatgaggagcctgtgttggccaaggagctgttttttgtttttttttaattggctatgaaattctccccagtcatgaaaggaggacatagttaataaggcccctctcccagcatccacccagtcccacgtcacccaggcaattaagttgttaagggagctgctgagtggggagtgtctgtgccttatgggaggcaagaaagaagtggcatggcgctcaatgtcacagtaaagcaaactttttttcttctattagcataaggaagttctcaaagcagaaaaaagaagtagacaaagagcacaggtcagttcaagtcagcctggaaatgtcttacggaacccagaaaaggggaagaatgagctccaaactcctggccaacacagtcatctctcaattgctgagtcccagggggatttacttccactaggaaatcatttcactggccacttcccccatcccacccaatgaaggtagatgagggcgggggcccagggcaggagagcacagaatatggaatcaggcattctgggctgaattctagcttctctcgtagtgaccttgggcaaccttatttcactggtctgggcctctgtctacctctgtaaaacagaggtaataccattactgtgcagggttgctggaggaataaacagaaaccaccctgcgttgtgccttgcacagtcagtggtggtgagtaaacagtcactggtgttattactgtgacaaacgctgggatcttaccaaatctctgttatgccagtgttgctctgtaacgcatctgccagctgggcagtccccttagctgtgatctgattctggataagcctgaaagaagaacataacttgtataaaatccataatactggatcaaatttgaccccttcgtaagggagttgcaagggtgttttgggataagagacaagttggtcaggggaagaactgagtccatgtgactttgtatctggctaaaagtgtccaggtaagatccactagagtaaaggatagcttgatattttttaaattttctgtttgtttttatagtgaacataatgtaatacatgaactgatgtgtgtgtttgcatttttcactgcagaggtgcataatcaaaatatttggggccgggtgcagtggctcacacctgtaatcccagcactttgggaggccgaggtgggtggatcacgagctcaggagatcgataccatcctggccaacctgtctctattaaaaatacaaaaaaattagctgggcatggtggtgtgcacctgtactcccagctactcgggagactgaggtaggagaattgcttgaactgggaggtggaggttgcagtgagccaagatcgtgccactgcactccagcctgggtgacagagtgagactccatttatatttttatatatatttgggagaccaccaatctgaacaacaaattgtaagaaacacaccatgggacaggaagtctgacgtctccttccaggtagctagggaaaggcaaggcaggttttaaagttaagaggctaccaacatgcaagagggagggaggagaaacagttatgctgccatgaaatagttctcatgaatagttctcatggggctcagtggaaaagctttaataatggggactctgagaatgcaccccattgttctgggtagcagtgattcaaatgaaacaaagttttcagctatcgctaggaagccaggcctctcctgaaatgctcccttgggcagctacgcttctaacccaaccaggaaataaatgcatcaagaggctgtagtgtctccgcttcatcacagagtcattccctgctcctggctgtttgtagaataggctcctgctaaacatgacccttagaaatcctggcactgacccaagaaggaagcccttaccaggaagacgagggccctatgctgtcatgaatgaagaggactccctcgtgagaggcagtattgcagagcgggtgcagctcctcttaaaccctccctccccactgttcagctacagaaccttgaagaaataaacgcatctgtctgtgcctcagttgtgtcatctgtaaactgagaataactataagagtgccccccatccactgggtgtgtgagatttcaagaggagggtattaggcacagtgtccagggggaagggagctcttgtcactgttactgcccaagcacacaggaccactggtggctgggctgcagccaggatctggtgctcccagccataccccacaagggctagggcccctgggttcaatggcagaggtaatgaccttccctttcaaaagggacaaaaatagaaccaggaagtgggcaccaagttctgtattcagttacactctgctgttttctagtcaccacttaggcttttttgaaggcagggaaggcagcctccaaccaagatgtggcaggaggccaggaaggagagcacctaatgcccctaaaaagcctgcagtgtccaggcacatccacccactcgggctgccttcactagggccagtgcaggttgggaatgcacaaagcagccaagactctctttctgaccctgtcctagctctgctctccctggagaggctggcctgcacttagggaatgggatcaaataattctgcaggctaaaaaggaaagaaaaaacaatatgtagcagagtctagtctttttgcagaaattgacaaggtgagtctgaattcataagaaatgcaaagaacccagaatggtctaaacaatcttgagaaagaagaacaaagtagaactcacacctcctgatttcaaaatgtactacacaaagctacagcaatggtcctggcataggagagacatataaatcaatggaccagaacagagaattcagaaataaacccatacatttatggtcaattgatttttgacaagggtgtcaaggccattcaataggaaaagataatctgttcaacacgtggtgctgccgggacagctggatatccacgtgcaagagaatgaggttaaccctcactttacactatacaaaaattaactcaaaatggattgcagacctatatgtgaggggaaacaactataacgcttaacagaaaacttaggtggagttctttgtgatcttggattaggcaatcatttcttagataagacactgaaagcacaagcaaccaaagaaaaaaatagataaattggacttcatcaaaattaaaaactattggccaggtgcagtggcttttcgcctgtaatcccagcactttgggaggctgaggcaggtggatcacctgaggtcaggagttcaagaccagcctgggcctaaatggtgaaaccccatctctattaaaaatacaaaatgagacaggcatggtggctgatgcctgtaatcccaactactcaggaggctgaggcagaagaatcgcttgaacccaggaggtggaggttgcagagagctgagatcatgccactgcactcctgtctgggtgacaagagcaagactccatctcaaaaaaaacaaaaattaaaaactgttgtcctttaaaggtcactatcaagaaagaggaaaaactccacagaaagaaagaaaatacttgcaaaacctgtatctagtaaaggtctagcacccagaatatatagagaacccctataactcagcattagaagacaaacccaattttaaaatgggcaaaggatatggagacatttctccaaagaagctatacagactcccagtaggcacataaaaagacattcaacattgttgtcatcagggaaatgcaaatcaaaaccacaatattacttcacatccactagtataactagattttaaaagatggacaataataagtgttggtgaggatgtggagaaattggaatccacatacattgctggcgagaatgtaaaatagtacatccactttagaaaacagtttggtggctcctcaaaaagttacagaattgccatatgacccagaaattctattcccaggtatattcccaaaagagatgaaaacatatgttcacccaaaagcatgaacaggagtgttcacagtagcattacgcataatagtcaaaaagtagaaacaacccaaatgtcccatcaactgattaataaactgcaaaatttccttagagtgaattatcatttagccataaaaaggaatgaaacatgctagaacacagagacaaaaggtcacatattgcttgattccatttatatgaaatgcccagagtaggcaaatccatagagacagaaagcggattagtggttgccagggtctggggaggaggacagggagtgactgcttaatggataccagggctttttggagtggggaggaggagtgaaaatgttctagaattaggtggtgatggttgcactaaaaacctctgaattgtatactttaagagagtgaattttacagtatgtaaattttatctcaaaaaatacttttgaaaagtagcacagtctgaaattgtaaggctctctgagttaccataaatgctttaacgtctggttgactttcaacatttctgccaaactctctgccacttcatcgttgagttcattttgggtcagcctaaggaaaaaaaaggaagtatttactcaagagagcctacttggcagacattgttttagagttcacaggagcgggagctcagcccaaggctctccagctatgcagatgatcacttgctgagaacccagaaaacagccaggctccaagcccagcctgtcagccccacagaaggtcaatgggactcatttttaatgcaaatcctgtacctgggctcctatttcttagcccagctacctgtagaggagcccaccctccctccccacctttgctgagccctcagatttcatggaagatgggggcccacggaaaacaaagggccaatgcctgcttctcagttctcctctagtcccagggtcccttgaacaccactgacagtgtgttatccaagttagtttgaagacctgaaacagtcactgactgcacattaaaatgtgttcagtactttgctctcagttaacttgtgagggacccaagttaagtgactgaaagttcaggaagtctctcaatggtccttagaaccagaagtggtctggataaagcaccaaagctccttggtgtaaacagggtaggacccacttgtgccagtggacgaaagaatcattaggaagaagaatagaacagaaagaacatttaaaaaaaaaaattccttgaagggcagtttggatgtgcctgcccaaatttttaatgtgcttcattttaagacaatcagacttctagaaatttaccctacagtgtgcaaggatatacacacaaagctttatacattgcagcatgcattgtggtattatcctaatgtaaaatctgaacaaatttagatcagaaacaactgatgaaatatattgtgatatctattcgagatgttgtgcagcttgtagggagaatgaggtagaatgaggagggagaagaacacagcattgacatctactccggactcagcctgggcaggtttgtatcacccaccagcagggtgacctcgggcaacaggcttaagttctttgggtctgagttttctcactggtgaacgttaacagtagagatcgtatagagtggttgtgaggctgagtgagttaacacagggaaaaagtgtagaataacacatggcatgcagtcagcacttgagggcttctaggtgttgacattactactatccatgtgatttcactctccatggggcacctggccatgtccggaggcatttttgatcctcaccactgggaggtacagggcagagatgcggctaaaccgtctatgatgcacaggacagccctaccataataaagaatcacttggaccaaaatgtcaacagcatcaagatggagaaaccctaaaggagacatgtaaagtatgtgattacaatatttttagagccactgcttgaatgctattctgttttgcatatctttgaacatacatagaacaaaaggctagaaaggaaaggttattttggaaaacacaaagggaggtactttcacttcctccttttagcaggaactttaggaggtactttcatgtcctcctttagtgtcttacattttttccaaaaaacataaactacttttcaaaatgttaaatgatttgttgaggggaaagaatttaaaatgcacttactggacagcaggcctaatgtcaaaactctctcatgaagaggatattgtcattattctcagtaactaatttagcaagatcaaatgagcactgggctctgagtagatgatagggagggttgtaatacaactccctcacttaacctgtaaggaatgttttttttttttgtagatagagggtctcgctatattgcccaggctagtctcgaactcttggcctcaagcgatcctcccacctcagccttccaaagtactgggattacagatgtgagtcactgctcccagccacctgtatggaatttatgatacagagatgtaaatacaaataaagcaaaataaaacattaagtggccataaaaaagggaacaccaacaaaaaacactctcaggaggccacatccacttagtaagtgccctagagtgcagagagggagcgaggactgtgggcttcaggtgacaagtgacagatgagctggatggagcataaaggccaaaccctgatgtgaagacctggggaaggaggaggctgcctgggggaaggcagatgaagaggaggaagggagaaaattttgagccaagtgtgtggaagttggcctctgctaagcacatctgaaggtatccaaggatacctggatagcttgcatggccagcgttctagttctcctggggcctagaaggccaaggcctcagatccaggctcccggagcccacttcctcctcctgtacctgtttatgcttgtagaagtggctattctcttctctaggaggaaattatcaacttaactgaaaggcctagagcctttccaattgggagacaccttttctgttaagattccaggccatgtgcagcccctgggataattcctgggacctaaaccctccaaaatgactctgtgccaggtgcagtggctcacacctgcaatcccagggctttgagaagccagggcaggagaactgcttgagcccaggagttcaagaccagcctgggtaacatagcaaaaccccatctctacaaaaaattttaaaattaactgggtgtggtggtgcatgcctatagtctcaggactcggaaggccaaggcgggaggttcgaatgagcctgggaggtggaggctgcagtgagctgagatcacaccaatgcactcaagcctggacgacaaagcaagaccctatcacagaaaaacaaacaaacaaatgaaatgactcgagctattaccacagtatttctagagacgtgttctgctgcagggccctcgcaaggctctttcctccttctgtggagatgccgttggacgcaagactaggaaggaacacacttggggtgaattattaaagacacatctacattcaatcttagcttcaacatcagaacagctgggaagcctctgcctggctgtggccccagcccaggctcactcggggcaggatgcagaagtgttcagctgcagcagtagtgcccaggcgctgctgccccagagcccacacacagagcacaagggcaggctggacgggaaatgggtcatcagcacagcctgctcacacaacagtgggctggggtcggcacctcaggtttctgcacatgggcaggaggctggcgaggcctggcaagctgtccttctaaaggctggccccatcaaggtaccccatctgcaagacctggcaaagtctcttctgctactgtccccaccttcttggactctttttcagtggtaggaagaacagcagcagagccgtggacataccaaggtcccaagatttggccagcagcctaagcgggggctgggtaggtgcatccccatttatagagaggaagagtccctcttttccagcatcatcctgaggacaaggaaggggcaggaatctgctggccagcatcttattaagtttcatctgcacttaggaaaccctccctctaccagcaagggacatgcagggatggctgaggggctggaaatgtcctctgtcttgatgggggtggtggttggctggtgtgggacacatgcagaattcactgagctgaataaacacttaaggtgattcctcagggatctagaaccagaaataccatttgacccagcaatcccattactgggtatttacccaaaggattataaatcattctgctataaagacacaagcacatgtatgtttattgtagcactatttacaatagcaaagacttggaaccaacccaaatgcccatcagtgatagactggataaagaaaatgtggcacatacacactatggaatactatgcaaccataaaaaaaaatgagatcatgtcctttgctggcacatggatgaagctggaaaccatcattctcagcaaactaacacaggaacaaaaaaccaaacactgcatgttctcactcgtaagtgggagttgaacaatgagaacacatggacacatggaggggaacaacacacaccagggcctgttgggggtggggggcaaggggagggcaagcattaggacaaatacctaatgcatgcagggcttaaaacctagatgacaggttgataggtgcagcaaatcaccatggcatgcatttgcctatgtaacaaacctgcacatcttctacatgtatcccagaacttaaagttaaaaaaagagaagaatgtgctttactagatggcctcttatgcatcaaagaaaggtttgacaagagtaaggaaaatcacacatgcaaattcctcttctattaggagcacgaatcacccttccccagcaaacctagagcagctgggagggaccaggttggcccctggagacagcagggccacagttacctcagggtggtcaagctggggtggttccgcagagcctctgcgaaggcttttgctccttcatccccaacttgattgccccacatcctgagggaggagacaagatagtgaatgttagctccccaagaaacagccatgctcacccctccttttttgccaatggccacagctcagttcctactcaacaggcagatgtttgtgcccagtccctggatctgtggcctggacactaattcctcacactggtctctgagtgggctgctctggatttcaaattcaaggggtgatgcaagatcgaagagcaggggaagccttgtgaacagaggccatcggcaagtggcacagttagagaccgagcctcaccacgagcttcggagagctgtcagcccaggagcctgagctcatgagagaaagcacctgcatgtctcctgtggagcacagaggtgcgcagagtcctggagggaaggccgtgtgcaggtgctgggttcccagcatccgttcaactctgggcagggtcagagacattcctgaagacacagtcttccaggagacaaagagcaggaagtaccttcagaaaccccatcagcaacgttcctgtcacataaagaggacgttacccaaccaagctctgtggctacggccatcttggtggacaggtgcggcgataaagctgtattctgtcccctacagcagatccggagagtctctggctaaaacagtctgcgtggtaagatggtggactcctgacccggctctgccatctgctacctgtgtgaacttcgggaaattatgtagtctcttggacctcagttgccccatctataaaatggggataattagagcattccgtcatggagttgtgaggattcactgagttaacagaagcaaagcacttagaaccgtgtgtggctcacacaaagcgttggctgttcctaataggatcagcacacactgtctacacacaacagaacaagttcgtgtggcccactcacaacacaatggcagctgcctcaacaacacgttcacaccaagcaaactacctgcttacaccattccaggtatggcttgctggaacccagaataagagttttcagtgttttgcttacatatatgtatttactatacaattgaatggcatcacatttttaataaagtggaaagctactcaaggcatgagattaagtgaaaaaggaaggatacatatagtctcacccctactatagtatagatacatatagtctcacccctactatattttttaaaagttgtacaaagagagagaagggagagaaagtgagagagcttaactgagcttaaatgttaacaagaatcattttctgagaagataatttttattatttttcatagtttccaaataaaattacctgtgttccttttgtaatccaataaaaattataatgaaacaaaaagctttaaaaagcctcaagaatcaaaaccacaatgagacaggacctcacactcattaggatgggtactgtcaaaaagagaaaatagcaagtgttggcaaggatgtggagaaactagaatgaactgttggtgggaacataaaatggtgctgctgccgtggaaaacagtatgatgattcttcaaaaaattaaaaattaccatgtgatccagcaatcccactgctggatatatacccaaaagaattggagggaggagccaagatggccgaataggaacagctccggtctacagctcccagcgtgagcgacgcagaagacgggtgatttctgcatttccatctgaggtaccgggttcatctcactagggagcgccagacagtgggcgcaggccagtgtgtgcgcgcaccgtgcgcgagccgaagcagggcgaggcattgcctcacctgggaagcgcaagggatcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggcggcaacgaggctgggggaggggcgcccgccatagcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcagaggcacactgacacctcacacggcagggtattccaacagacctgcagctgagggtcctgtctgttagaaggaaaactaacaaccagaaaggacatctacactgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaagttcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcggtaaacatggaaaggaacaaccggtaccagccgctgcaaaatcatgccaaaatgtaaagaccatcgagactaggaagaaactgcatcaactaatgagcaaaatcgccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaatgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggtttttcgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacagcaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaagaatctaaaaaaaaaaaaaaaaaaaaaaaagaattgaaggcagtccttgaagagacatttgtatgcccatgtgcacagcagcattattcacaacagccaaagcatagaagcaagccagtgtctgttcttggatgaatgagtaaacaaaatgtggcatagccatgcaatggagtattactcagccttaaaaaagaaggaaatcctggcggggcacggtggctcacgcctataatcctgacactttgggagaccgaggtgggtggatcatttgaggtcaggagtttgagaccagcctggccaacatggtgaaaccccgcctctactaaaaatacaaaaattagctgggattggtggcgggtgcctataatcccagctactcgtgtggctgaggcgagagaatcgcttgaacccagaaggcagaggttgcagtgagccgagatcatgccactgcactccagcctgggcaacagagcgagactctgtcaaaaaaaaaaaaaaaaaaaaaaaaaaaggaaatcctgtcccatgcttccatgtggacgaatcttgaggacatgatgctagtgaaatcagccatccccaaaaggcaaatactgtatgattccacttacatgaggtagagtagtcaaaaccatagagagagtaagtagcagggtggctgcaagaggcaggggggagggggaccggggagttattgcttaatgggcacggtttcagtttcgcagcatggtgaaagctctccactatctctccccgacagcgagccccagtggtccttctggtgtactgatgtatgaaaagaacagcaaggcccgccccccacacacacagcaggttgtaccacatacatccatccccttctactcacccaacctcagagattgatttgctgttcttcacagccagggcgagatacttccctccttcacttgttattttgttttttcccagtctgcagagagagtcacacacagtcagcctccagctatgcaggggctccaatgtgggtcaccctcctccccagcacagagccccttccagccccatcttgggaaccgtacactttcttctgggatccacaagagccatggcctgggcctcctgtcagggagggaactgaagccctgaggacagtcagtcagggttcctctccaggagatggtccacagtctctgcagaagctcagggacctgagccctccctggggtcctctaattgacctcagcagcatcactgacttccctcgggagacctgggaggtcccactttgactgccaagggtcaaggtatgtggccactgtcagggcaggaccagaggctccaagcctggcgcactgtcaccccctgcgcagggcacacctacagcagggcaagggcccaagctcttccttgcaacccgacaggaaactcccttggggcaaaaagaccaccagaaagggtgagagttagtcctttcttcggcctagtagttaatgaaatcaaaatgccaacctttccccctaccaataacgggaggcccttccagaatccaagcctcacagatcacacagaggtatctttacttgaccaacatggccctgggacaagtggaaggctttaggatgaaagctctttactgtgacatttaatctttgaacaacagaagggggtgatcaagagaatatactaaggaacctggtgcctaccccacttacttaagatgcgtgaggcctttgcattcatccaggattttggtgacgtacctggctccgacatcggtgatctggttgttgtataaacttcaagagaaagcacagccatgagactttctggctcctgatgtcattttaatagcccctgttttttgaagcatatggtgtctactgatttccaaagtctgggttgaaaggggaacacacaggcaccagagtttagggctctgaggtctcacagctcaggttcaaaaccagctccactactttccccagctttatggcctgagacaagtcacgttacctctctgtgcctcagtttctccatctgtaatacagaggtaatgatgatagtccccttgcagggtggttatgaggatcttaggacataacgcaaagccctggtgcatgagtgctcggtgactggcaggtgatgggtatttacaactaagattacattcagcgtcttgagaagaaaagattctgaatattaaaacttctcgatgtctacctttcagccatctcaccgctcaatgccaattcaatagtacagcagatggaagttgaaaggcagctaagctcaggcttccagggttccacagccacacagagccctggagccgagtgtggcccggggtcgtttgcgtccatgtcctcattaacatcgaaggccactgaggccccaagaaactgaacaactgctccagcttgcagagccaccagttgtgtggggctggcccgcaatcccttctctcagactccaaaacctcaaaggctctgaatgcccaaagtttctcacaattcttttggcaactgatgtggagctacttatagtctttcttaccacacttggtttgactgtttcatacattctgcgggagaaatatgaaagtgtttgaaaatggggcactgccttagacccctgcggccacgtcatgccatagcatgcactcagaatccccattcgggtcttgccccaaaggctctggatgagggattatggacccaaaatagtccagactaatatgtaaacaggattctagcatttattaaatatatccccttatattctcgttgcatcccccaataaccagttgtaagcctacttgcctatactgggatcccagttttacaggtgaggaggctgaggctcagcaagacttcatgactggccgagccacaaagagaacccaggactctcaactcctgggccagcgctcttcccagccctgggccatccgtgccgatcatccagggacctatgggaatgtgaattccctgcagctctgtattattactaggtagttggcccagtgttctggagaaagacataccccaaataggtcacaattttgtatttggtcagctcttcgcttagcacctttaccccaccgtcagtgatctggtttacgctgagtctgaaataaaacagcaaaaaaattacgagtcagggcaggcactcattatgaaggaccattaatcttacaaagatccagaagccttcaggccctggagttttctcaggtatagacgcccctggagaatggccacagcaatcagccaaatagccccttacaaagcctggccaacgtggggccgccagacccatcctgcaccagcccatgagcgaggctgcagcacagcccctggctcctcacacgaccgtgaaggacacagggaggacgtgtgaggccagccacctctgacatccaccctttgcgtgtgacctatgtgtcagccagaccctgtacctggttctcgtatggtggagggcatgggtttggaaatgtcaggggctgcttttagtggttgtgactggaggagggagtgccctgtcatcttgcaggcagggccaatgatgttaggtgtcctgcaaaatgctggacaggtctcacaagaactgttatacccaaaatgccaacagcttccccccatccagaaacacatgggctaaccctgatttgtcactggaaaaggctgtgagtcccactgtcaaaggagactgctcatgtcattctgtaaagtgtcagacagcaaatattttaggctctgtgggccatgtggtctctgtcacagctactcaactgtgtagtgtgaagcagccagtaagtaaataaatgggtatggctgcgttccaataaaactttacttagaaacacaagccttgggcccaattagacccacaagctgaccttgataacaagtaaaaggctgaacaattaaaagcttgatttttaggccacatcaaaatgatcaagtcagacactctggaccctttccctcagagtccccagcttggtgctgggaaatagtgtgtatgtacatggcatggccagcccaagacagcacaggctgctagacattcccaatatctatactttcttagcaatagattcccccatcttttagctgggcccatctcattaaattctgcccataccattaagttctgaaatctaagcagcaatataattagtaatagccaagaagtgttcttaaaagattgaggcatgctctcaatctttgcccttccttcttactgatagctagagtgtcgactagatggctggagtttgagcagccctcttgggccaagatgggaaagccgggtagtgaggatggcagaacaggaaggcagaagagagcctgggctccggagggtcatggagactccataccagtcctgaactacctacctctagacttttacatgagagaaataagcttgtaactcaccaacatttggggttttcgctctcagctaaaactaatcctaactgatgcagccagagaactgagtgtgcttcccgtggttacccatatcctctgctttcctacaagctgttttttcttgcactggtgtgaaggaaagcttcacctggggacagcaggaagggcagggccaccacactggtgtggagtttcccattgaaaagatggacagaggggtcgggtgcggcggctcatgcctgtaaccccaacattttggaaggccgaggcgggcggatcacctgaggtcaggatttcaagaccagcctggccaacatggggaaaccccgtcctactaaaaatacaaaaaacttagccggacatggtggcgtgtgcctgtaatcccagctactcaggaggctggggcaagagaatcgcttgaacccaggaggcggaggttgcagtgagctgagatcacgccactgcactccagcctgggcaacagagcgggactccatttgggggagaaaaaaaaaagatggacagagggtggcactgagtgtgagactgcctggggctacagagggagagtcactggctgagagtacagagaacagactccaggttttccaattcccaggctagggcagccttcgaccccctgcaccccatgtccccatgcaattatttacactctgacactggtgtgacaggcactgggagtcagttccaaatccctactgctttttagaaatgcatgagtcaagtaatggcaaatttaaccccctgtagagatttacaaggtttattttacataggaaatgctaatagaagaaaacagactgggctctgtttcccgtaaactatggaacaggaaaacaaccacgagtcagcattttaactgaggtctctagcagtgtgaagggctgctagcgttgatcacagaaagtcaccagtgccaactggcacaaggtctgctttctctgcagtaataaaagctcccatattccagaaactttttgagggctatctcggagccttacattaatcttaaaaggaaggttctttatgcattctggcactgctatgtctgagctgtgtgacctaaagcaagctattaacttctctgtgcctctacttccttatctgccaaaatagagacaataacagtacctaagttacagggttgtaaagagcattccattaggtaatatttgtaatgcacttcacccattctcaactaacattggtccctgtggccataattgataggattatgagcatcttctttttccagatgagggcgtggaggctctgagagttaagcactttgttcaagggcacccagctgtggctgatccaggtccacctgcctcgaagctttgcaccttgacctctgccctgctaagaaagaaaaggtctggacattccaagggccatggtcatgagtcctgggggatcctggtccatgatgccattcccgatgccctccgagcctggcccgcccggcccacctgttgctccccttgcctggcagcctcacctgagaacagtgaggcggctgaagcagggctgcagctcccgcacgccgtagtcgttgagattgttgttgtctaggtctagggccagccgcttggggaagtgatgcaggacgaaggagagggcgctgcagtcggccgagcaggcgttgcagtaggtcagcttgaggtagttggcgcagatgcccctggccgccagctgccccaccttctggctctgtgtctcgtagatgcagcgcagcatccagatgaacgtgggcatggcctgcacctggttgaagctttcgacctgaacgcggggcaggctcttcaggtagccccgcaggctggaaaacaggtgtgcccacagggccttgcgctttctcctcagggctgccgcgggcaccagatgccgcaggagtttctgtttggctttggacaacagcccgcacaggaagaggttggtgaactggaagtgatccttgttcttgaagaggtcttcccgcgccggaccactgccctgcaggcactggaacgggaggaagggaggatagcaggacgtggtcgctgcccccgcagggggcatccactcctggaagaacctgagcagctcctgagtgcccaccctgtcgtccagcacgaggaagaaggctgtaaagaaggcctggagggtgaggtggaaaaactcataggactgctggtcacccccggggcccagctccggcaaagcccgcaggaagcccagctgcatgtctctctcctgcagcccggaggcctgcacctcctcctgggtgaagacaaagaggctcttctccatgccccggtgggccacctgccccagcgagcacagagtgtcccggccggcgtggagggtctccactgggctgcgtgtgttccgctgcaccaggctgctgggctgcatcctgttcagatggacctcagtgaccaggaggaagacatctgtcagggtcatcgtgcagtcgggcagctgtggtgagccttcaaaggcagcacggaagtgctggaagcaccggaagatgatccagcagaagaggggcacagagcacaggctgcagaggttggggttggcctccagctggctcagcaggcggtcctgcagggcccgctcggggaacatcctcctggcataggcgcgcaggtggctgggggagaagccccggagaagcaccttcttccgcaggaactggcgcgggacctcgatgcctgtgcgggctgtgagcagcttgctagcccccttgagcagcttcccactgagcaggttggccagcaagaccagggggtgggcaggctcccaggggcaggagctgtcaggcacgcggctcaggtccaagtccgagtgcagctcgtccaggccatcgaaggtgaagagggccacgtgggggaagcgcagcaggaaggcaaacacctcctcggggtcccgctctgggtagcagtagtgcttgaagagcaggtcctgcagacacagcctgtcactttccttgaagcagctgaacatgcggcagcgaaagtggaagaagaatttgacccctgcgtctagccggcccgtggcccagaggctctgcagccgctgtagcagcatggacttgcccaccccagcatcacccaggatgaagatggtctcaccctgctcattgaggatgccggtggtgtggtccaggaggcaggccaggctgttcaggctgcccaggctctcattgctgaagccaaccagctccatgatggtgtccatgtagatctcctccagcagcagctcctccttctgggcatagcacagcacgaacttggagtcacggcccagatggtgtcgcagctgctgggtatacctgctcactggagggagggggtggcagggcacagcagcagggtgaggagagaggcagaaacagcatcaaacagggaggtctcaaagaggagaggcgagtgcataaacaaaattcacaacctgggccctgaggccagcgcagccactcctcagatgcaggacctggggagcgtcacagagccagcattcctgaccctgagggccccaggctttgatctctctgcttgacctcagatttgccagaaagaaggtgacaaacttcagctgggatcagtgtctgagacaggccacccttattcctccgcacagtgtcatcactgaactgcagctaaacactgaagcccctcgcactcgagggccaggccagatggccacgctggccctcctccaccaacactgcttttttgttgttagagatagggtcctgctctgtcactcaggctagggtgcagtgacccaatcatgcagtctcaaactcccaggctcaagcaatcctcccacctcagcctcccaagtagctgggacacaggcatatgccaccaagcccaactaatttttgtgtttttttgtagagacggggtctcgccatgttgcccaggctggtctcaaattcctgggttcaagcgatctgcccacctcggcctcccaaagtgttagggagtgttatatatttgtcagtaatttttagtaagtttacaaagttgtgcaaacctcaccacagtccaggtctagaacatctctaccatcttcccagagttttctggagcctatttgtagccaatccctgggccgtaggcaactactgatttgctttgtctatagatttaccttttctggacatttcatataaacagaatcatacaatatgtagtcttttgtgtgagactgcttgtagagtgaattacactgtaaaagctagtaaagtagctggctaacggaaccaacagagaagtctttcgaaagaatgattcctcatgggaatactttctttttttttcatgggggaaggaaacaaggggagacaggaaggagcagacagagtcagaagctagcagtggctggcaggcacctgcaggggctgtggaagctggagcctagcactgacactctgccggctggccttgtttcccctaagcacacacctgtcttgtgcttctgtttccaacaacatattggattctttaaaaggcaggacttaggtccttggtgctggtatgttaccaacagctgtctcaaagtggagagttcaaaagcagggaaagaagactcctgccccagagcagatcctggccctaatgatatgttctcacatgccttggactgccgctgtcctgacacatttttgagattgctgactggtggtctcttccagctgacttgaagctccctgagggcaggaaccctgtctgtgtctgctcaccactgtctccctgacatccagcacagtgtagggtcttggcatgtggtggatacagcaaaaaatacttattgaactaatcagttaactgatggggtcttccattagtttggaaataaggactggcactcaacggtgacagaatactttgcctagaatcaaacctggcaaggctttttaatttttttctttccttttttagagacagggtctcactctgtcacccaggctggagtgtaggggcacaatcatagctcgctgcagccttagactctggggctcaagcagtcctcttgcctcagcctcctgagtagctggaactacaggtgtgtgctaccatgtccagctaaagatttttttaaaagaaaaaaaaatacaaccttgaatttgtgcaaccattaaaatgtctacatatgtcagaataggaagaaagcaaggggtcagaacacaggccattcccatacttccaaaggcccctctataaaccagaccatcgaggtgtgggcagttcaatcgcagccacctgggctgcacttgggagacaggattcagctgttcctttctaaaatcaaaatagcacctgggcctgcttcctgaggtggcactcagggctggcccagccattaccaaaccccccagggccctgcttgcactggtgcctgcggtcttgctggggctgactcctacctgggtcagtgttgaccacgactttgctctgagtgagcagggaaggggagaagccgatctccagcagccaaggcctgaggtccacgtaggcatctgcgagttgctggagcaagtagaggaagaactcggacacctcctcgcccttgctctgtaccaggtccagaattttgcggacctggaggtgacacaagcatgagggcacgggctggcatgaggggcatcctcctaccataaggaccctcaggcaggctcagggcagggctctgagttcttagtacagccggtagctatgccatccccccagctgctgtgacagtcaacatattggagcccgaaaatctgtgaaatgacctcctgagcaagaaataaaaccactcagctctaagaaaccaggaggcttccatgagcctaaaaataaaaaggacagacaaatagccatggacttctctacctcttttttttttttttcttttttgagacagagtcttgctctgtcacccaggctggagggctggagtgcaatggcacaatcttggctcactgcaacctccacctcccaggttcaaggaattctctttcctcagcctcccaagtggctgggattacaggcacccaccaccatgcccgactaatttttgtgtttttattagagacgggttttccccatgttggccaggctggtctcaaactcctgaccttaggtgatctgcctgcctcggcctcccaaagtgctgggattacaggcgtgagccacggtgcccagccttctccttgtccctcttaacctgacacaactgctgtgcaggaatgagagtggagaggtgagaaccaccccttgggcataatgaggtaggcacctgggccacacagtaggagggcgataggccatatattaaaaacggctttttttcttgttaaaaatgtgggaaaacaaatcaagagaagagaacaaagcacacgagtgtgctactgcttcccccagaaaccgtcctggtctcttctgagtcccagcggggtcatgtcataaatgagttgtgtcattcctctaaccaagaaggaatttgtggtctccattttatttttcaggagataacgcaaagcgtaagtggaagtaagggctgttaaggcgtcccacagtggagcggggaagattcttcactgtggacccaccgtgggatgtcatcattcctgaccctgagtcggttcccctccgagtctcacccagcaacaagcagccctccagccttcagaggcactgaatgaacatcgctgctggggatgctcttatgcttatgttctttttccctcctaatttaaaggggatctaaaaatgaagtgtctgggaaccaatacacacagcaatgagaactgagatgtcagggtttgctccagacacaaacacagaagtaaaatacctgactgtgcaacctgctaacccaggcatttgtgtgctattagtaccccaaaatgcagccctgcccgctggactaaactcccacgctcttcactcagatcagcagggagaggcctcttctagctcccggggtccacacaatgccatgcccgtccctgtccccggggcaccttgtcaggctgggtggggcaggcacacacaatctccgcatcttcggccgagaagtagtcattcttcagcaagttgtccaccagacactgagtattgcggatgtgagtgaccagaagttcccgattgcttttcagtaattgaatgtgggggtgagactctgatgggattatttccatctcactgtggccctgctcttccatagttaaagtagcaagcggctacttttcccaaattcatcttcagctgcgtgtgtcctctcagcagaagggcaatcaggattcaggccgcgccctccagggcccctgctactctgcgcagcccctgaagagatcaatgacatcatcagcaaagcaaaagctacagaaagagctcaccccacctcccactggttgtggggtttctctacctagagcaggaaggaaccatgcttaagacctttatctggccaggcaagttggctcatgactgtaatcccagcgctttgggaggctgagatgggtagatagcttgaagtaaggccagtagtttgagaccaacctgtgcaacatagtgagacacccatctctacaaaaataaaaaaaattagccaggcatggtggcgcacctgtagtcccagctattggggaggctaaggcaggaggatcacatgagcacaagagttcaaggctgcagtgaacgatgatcacaccactgcactccagcctgggtgacagagcaaggccctgtctctaaaaaaacttttatcttagatgcattaaagaaaaaaaatcataatttaattgtttgcacttgagggttacatctctagggtaggtgaccagagatagccaactcttttttatttttaaatcaaaacatctttattattactataaagcaaaagtgtgctttgatcctatactgggatagagatggaaaggtgtttattttacataataaggttaacagggcttggaggtttctgcattccccaagcagggaacaggcccagaactgagaaagaaagacctgtggggtttggtgggagacggtctcagcacaaaatagcctgagaagagagacagcagcatgaagtctcctgtggtagccagaggcaaggaacctgcggacggtgatgtctcagtcactgttgcccattttgggttgtgctataacctcttcccccgtgtccttgaccttcagcaaagtctgttatacacaagcaccctgggaaaggagggaaaagcaatagcccatgtggcatgaagtgggacagagggagggcagaggggcaggaggaagagggagagccggcacagagttcctgggattagattcccaagagaggtatctctctggaaacccttgaaaacctggtacaagtgctgagtttcttgtctgggtaggaacagggacccaggctattttatttgggcattaaaaaacatttgggttcatctgagttatcccaaaattgcactcactaccttccttgtaacaataacagcaaaaaataataattttttaaaaaaatcccacagaagatccttcagcctcttcttgtccaggaatacttgcgtgtgtaaaatgatcttggaagtggaaaggcctggaattggccactttgtcgtttgtctaggcaggaaaactcatgcatttcagagagagagtaaaaaaaaggtttttttgtagttcaaaaaaaagctcatagatcttttaacactatccacatcattaatatgtttcacaagccacatctgttaacattcaggtccagtggttctcaattttttttccaccaagtggcacatgagtctcctgctctttgacatgcttctatgttttctttttttaacctatcaaatgccagaccccacacaatagctttctttttagaatccaaatgatagagcaggaaagagtaaaatttaaaattatcagcaacagaagggcaagagatcctcaccaaaaaaatttaaaggtatgaaaatattagttattgttccaataaaagttattaaatactaatccagccttttcttttttttttttttttgacagagtcccactgtgtggctcaggctggagtgcagtggcacaatctcggctcactgcaacatctgcctcctgagctcaagcaattctcctgcatcagccacccgagtagctagaactacaggcgggtgccaccatgcccagctaatttttgtatttttagtagagacagggtttcaccacgttggccaagctggtcttgaactcctgacctcaagtgatctgcccacctcggcctcccaaagtgcttggattacaggtgtgagccaccacacccggctattttccatggcagtcaattctatgacccactttaggatccttagctttagaaaatcggttcatttaaagcataccagctgacaatattaaatttaaattagcagttaataatacctttttaagtttctggcatcattctttgaagttagaatattttaaaacaacattgtttaaatcttcaatttccaatttatttctggaatctgcaaaatcaaagaaagacttaaaaaaattattgtggcacatggtgaatgaatgaataaaattggcaagagaataattttaaaatctagtactcccaggtatcagactactctctgtaccttcttcttttaggacagtgttttctaaatgttcaacgtccccaccatagtcacttttttgttgttcttgccataattgagtcacacctgtcctttatttgcttaaccttttgctttcaattgagttttgaaaactctaataattttaaaggaatgtaatgtcaccattagaaacagaaaaaaaatatcctttgcaatacatagaaagtaacacaaaaattaattcaccagaaataccacaatgttactgtattccagctagtcctgctgcctggaaaggctccagggttggggcctgttttctctcggaagcatttgagagatgttaaagacacagtagcacagaattgagactttctctttaagatcatcacaaggctgagagaaaactggaaagaagtcacttctcactttgtgattcagcattttgcaatgccatgctccattctttagaaagctgggaaggggtgttgcacagcttccttcatccctcctttcccgacctttgcccgcctaccacgaggggcccgttttactcactgcttctgtctcttccaagcctgcgattcccataaaaacagcaacttgtcttcccagatgttttctgtaatcgccgccacaatctccacctcttgccatcaaaggcagaaaccgaaggaaagtctcctgacttacaatcacctaaataaagcaatatattatatgacagccatctggcaaggaggctgctttataatgtccagagccctggctgaagatttaatcaggtgtgcagagttagctcaattcagcaagaacttaacaaggtatggatgttggaagggaaagcagagaaactgaactctgccttggtaaacagaatctaagggtagaccaaaaccataccatgggagactggagatcaattcgaagttcatgggcacttattaccagaaacaccagacagccagagatctgctggccctggggggcaatcctttcctttctttgcttggtaaagggtgggtccagttgatgaagacggtctggtcctctcttccaggcaaagagaggacggagattgggctggggccaggtatctgggagctgggtctgctctcctgggtggagctttcccaggccagtggtgcagaccaatggggactgaagttggagatcctggtaagacagctccagggatacccaaaggaaaaaaccaagctaatggaggcagccagaaaacaggacacaccgcagaacaaaagatggatcaccaagtggaaaaatgaagcagaggagatcggaggagggtgagtccaccaccaaaagccatctcctgaggcaaaggcaggtgggggtagagcctgtgggcagtgagggagccccgaagggagctgggggttgcacaggcatttcctctcaaccgctcttctttctagctttctgccctcagagagggttagtttccagggtaagggaatcccaggggcaattcaccactccgggctcctcacagaaaccagtgcccaagtcccctcctgcaatgtgatcttccaaactaaagaaaaggtctgcagagcctccaggagaagattcagggaagctgctctggtgaaaaggaagcagggattgcaggatggcggatcttcaaagggaaaaaggagaccatagagcagctctgttgaattgaaatatgacacagctttcctagtaatttaaaactttctaatagccacactaataaaagtaaaaatggacaggtgaaattaatttcaatgatatattttaattctaatacactcaaaatatttcagtatgtcatccatacaaaatttatttattattattttttgagatgaagtctcactcactctgtcgcccaggctggagtgcggtggcgcaatctcggctcactgcagcctccgcctcccaggttcaagcaattctcctgcctccgcctcctaagtagctgggattacaggtgcacacccccatgcctggctactttttgtatttttagtagagacagggtttcatcatattgcccaggctggtcttgaactcctggcctcaagtgatcctcccacctcagcctcccaaagtgctgggattacaggtgtgagccactgcacccagcccatcaacaaaaaatttattaatgagatagtttacattctttttcttcatactatggcttggaaacctggcatgtgttttaatcgcacatctcagtttggatcaaccacatttccagtgctcaagagccacatgcggccaggggctactcaagtggacagtgccactccagggcaatcactaaaagctagggtgttgagacatcagagttcctgcctgctgcccttccatttgaaatactgatgccaggaatgatctttgttgttgttgttgttgttgttgagacggagtctcgctctgtcacccaggcgggagtgcagtggcacaatcttggcccactgcaagctccgcctcccgggttcacgccattctcctgcctcagcctcccaagtagctgggactacaggcacctgccaccatgcccagctaattttttgtatttttagtagggacgcggtttcaccgtgttagccaggatggtcttgatctcctgacctcgtgatccacccacctcggcctcccaaagtgctgggattacaggtgtgagccaccgtgcctggccaggaatgatcttaattggcttttcagatcagtttcatcggcaactcagtgagacagaggttaaagacgtgaggtcactgaaaattctgcaaactcaggaagaaaatacacactggacctactggtttatactcaatgtaaaattctcttcactgctgcatacaattttgcagctttgcatccttgcaaagatagagagtaagatacaaaaatgctgttgatgtttggtgagtcaggactctcctataccactggtggaaatgtaaatctgtggaagtctctggaaagtcctttgacacaatatgtgtcaacagactctgaaaactttctatttagtaacttccccttctagaaacccgccttttgaaaagaatcaggggttctgatgggttttttttttttttttgctgttttttctttttaaacaagggacttccagtcctggctataatagaataacttgtagctcacacagaggacaactgctggtgaatggattgacaaagtatagcatattcatacagtagaacacaattcaacaataaatgccaatgaaacaagaatccatcatgaatgagtgtcacagatactacactgagtgagagaagccagactcaaaagagtacttagggctgggtgcagtggctcacgcttgtaatcctagcactttgggaggccaaggcaggtggatcacttgaggccaggagttcgagaccagcctggccaacattgtgaaaccctgtctccacgaaaaatacaaaaattagcagggcatcgtggtgcacacctgtaatcccagctactagggaggctgaggcaggagaattggttgaatccgggaggcggaggttgcagcgagccaagatcgtaccattgcactccagcctgggtgacagagtgagactccatctcaaaaaaaaaaaaaaaaagatttcatgcatatgattctgaaaatctgatctagaaatcagatcaatggtttcctgaggcagggggcagatgggagtgggggagaaattgactgcaaagaggaataaggaaaatttctggggagatagaaatgttctgtgtcttgattgcatgcttgctctctcccttgtatacagtcacatatgtgtgtgtatgtatatatatgaatatacatatagatacatacgacttgtcaaaagtcagcaacccatatgcttgaaatctgtgaatgttattgtatgaaattacacttccatgaaattgattttcttttaaggaaaggcaaaataaagtttttccagacaaaaactgagactttgttgctaccgtatctgcactaaaatgaacactaaatagagtttttcaggtagaaaaaaaatgatcccaagacaaaaacaaaaatgatgagcaacaggaagtgttcataagctgggaaacagaaatgggtactaaccgaactatattatattaatatctcgtgaggtcaccaggacccctcaggaaatgattgacctagaaaggagtctcacctcctggagagcaaccaggactctgtccctgaatcctggggtggccccagagaaaccacagatacacactcactcagtgtcactttcaccgcaggcttctttctttccttgcactgtcccaggggaccttgagcggagatgtgcatttcttataactgagatgctaagattaaaaaaaaaaaaacattttataaagatgttctccacatgtacctttctatgttttaataactttttctgtaagtataaaacaatacctgctcactgtagaaaacttgggaaatgcaaaaaaaaaaattagaggaataaattaagttccctattatccacatgcaataaccactattctcattttggagcacttcctttcagcttttctctgcatgcatttgcgcccacactgactttttgcatgtttggcattacaccatgtttttgttgttctcttaccgttatcttgtgtttctttgtaactgctaaggccctctttggagctgcagaagctggcttctggatgacttggcttctagaaagcagaatgttttgctttccctggtttttctcttataaagaagggtaagaactcacctgccactctgctgctttaaagctctgcatctgagaaattccacgtgccaaagggaggctcaaagataatggcaaatggtctccctttcctcggcccggccatgcctgcctgaactgctaaagcaaacctggacaccttgcccagcagcctctgccagctgcgaggcacatgacagtgctctaccatcagcgtgacccgtgggatagctgcaagggggtgggcaggggcagagagtggtgggacaactccatgaggttgcagctgttcattccttctacagagatccactgagcacttcctcatgtccggccctgcaacgtgcaagggccccagcagggcctagtctgataatagctaacaccaagtgttgtactagggcatcagcatggatgttaaggctttatacacatggtgagaggcaggacaacataagggtgaaatctgtggtgtctgggatctctagagacagcagtgttcaaattctgactcatgagcaaattagagggaagttcctgctaaatggaccatgtttgctggtgattttaggctgtggggaacaggggcactctcagtttatgtctgttcatgggactttattataagatcactgattataaggaccatcacttgttagcaagttagccagcctttctgtgccgtgattgcctcaaggtaagagttccacctcaaaatgttgctgtaaggattaagtgagttaatatgcacaaaatgcctaggccagggctggcactcagtaatgagcgaatcatttactaatttctgttatctcaatccttgcaacaaccctaggtgccaggggtcattgttaccgccaatttacacatgaggaaactgaggcacacagaggtcaagtagctccctgccctcacagagtttacaactgggcaggacagacagacacagaacaaggaatcacaagtatggtgaatgtgtggaagcagaaatgagcagagagagacaggggggtgccgtggctctcaagggcttccttgggctccagccagcatgatcacagacgtgtctgctcccctgcagccctctgtaatggcaggtgacagggagacccagttagagctcctctctcagggagtttgaatttgagacatttagagagatgctgagtcccaaaaacccacaggaggtgtgggtttggctgcccacagctgaggccaccagccacggcttcccttattttgtgtatctttataataaacccccatgaacatagcctcagtgtgcccctgttctctgcagcctaaaaaacactagcaaacatgatccatttagcaggagcttcatgctgtgcagaatcacccagcagaggtttccctgctccattgtgactatgagcgccttcctcccagcatgagcagacaagactagactccatcccaactgatggggccagattgagaacagaaacctcaagaaagtcatttcccatcatcaacactggcctcatgatttcactctttcttcaggcacccaattgttgggaatcattattcgctctttttttttttcatgtttatatttcaaaataaataacacagctttccataaattggtgttgcaacagtagcagctaagattcctaacagatctaagccctgttataaaacattctttagcaatgtagcagatgctatcttagagttacaacccagcgtttttcaacagtgagctctgtgtagtcaggccattctgtaagtttttctactgtgatacttgctatataggttggtaacaaatacaagcataagcaaaaccaaggccagctttgctggcacccaggtcatatggaacctggcccagtgccatgccatctgcctctgctcctgtcctgaccctccctcctcaagctctgaccacttcttgaagtgagttcccaaacagctctgctctctgcaaccttggcggccacaggaaaaggccagtgattttatgaacacagaaaggattggcttctaggatataactttatgggtcacaggagagttttcaaagactttcccaccccttccttgaaaaccaacacagtggtagaagtattcagttcatcaaacagttcaggttcttctcctagacacctggtaggattacacttccctacccctttgaagttacaggctttaactcatgaaacatgagcagaaacagaatgtgttgctttgggtaggaggcttttagccatcactgcttaatttatcaatgtgcaatttttttttttttgcttctggcactatgattagcacaagatgggggcagctgcatcagctcaggcccacaaataaccacaatgagtagctcttgccaactcgcaaaggacataagatatgaggaagaaatcaaccttgattgtttgatagccaggcatggtggtgcacgcctactgtcctaatgactcaggaggccgaggcaggaggatcacttgagcccaggagttcagagttcgaggctacagtgagctatgatcacaccactgtactccagcctgggtgacaagtgagacccctgtttcttaaaaaataaacaaaacaaaaaaccttcgttgtctgagcccactacattaaaggatccctcttagcacagaaaagtcactacaacctttttcagatactataactatttatggaattaagatttaagataaaatataacaccattccctgtctacctcagactcagcagtaatctatatagggagatactgctttactaggaagaaaaataggcaggacatgcaccttctttatttgtccttgggttacatcattcaccttctcccaacttgtgttgggtcctgccacctcactccacccctcacttggctccacagaaccacatccatcatttctgttagaattactgggttggtatccctaaaagccaagccgaccagtgatgaaaaagaacacggtggagctgcatgtactgacatagaaagagccttaagacatcctgtcacttgaaaaatgtaagttgcagaaagaaatatagagtataataacatttatatggcttgcccacatcccctgccctccaaatacacaaagcactccacgttctctataggcatacgcccgtgaatgtaaatgcaaagaaaaccacctgtgagaagacacacggtgtgagaatgaaaattacttctggaaagggagaggacaccaggagtagggtaggacttttattcgtaatgtttttttttttataagaaggctatacacttgcatgattgaaatattttagggccttttcctcattagggcatctcaggacatcttgaggcaggccagcacaacattctcagcgactgccttgttttgaggaactatgactttcaactcaaagggcccacctgccctagagagaaaatgcttggtcttcattaaactaaacgatggttcattaagaccaaacaaactcagatgagatgttaagactttctgtgcacctgtaaatcaataaaaagctcttcctgttttgtgaaagtatcacaataaatctgatgggattgtgggtgggaacagttttttttgttgttgttgttatttttgtttgtttgtttgttttgagacagagtttcactcttgtcacccaggctggagtgcgatggcgtgatcttggctcactgcaacctccgcctcataggttcaagtgattctcctgcctcagcctcctgagtagctgggattacaggcacctgccaccacacccggctaatttttgtatttttagtagagacggggtttcaccacgttggccaggctggtcttgaactcctgacctcaggtgatccacctgcctcgacctcccaaagtgctaggattacaggagtgagccaccgcacccggcctatattttgttttaaatttagtagaaggccatcaacttagggtattaccattaagcctagttagaaataaggaatataaagtgaaaaataatcagtccccacaaaaatagtacagagcaaaagtcaacaatactggctttcaagtggatttttaaaatcccagagccacaagaaataccatattgaagaaatgctcaatggttgccaaacgtttcatttcctttgtcttgtatttcctctttttttcataaaacacatacctctgaacacttcaaaacattagcagctcaactgccttctggaacattctgacaccgagtgatgttttaattttgatttctcagcagcaaatggatgatgtcaaaggggcctcacattttcctaaccagtatcagctccccaacccaaatggttattattaccaaggaaactagttcagattctttttccctttctgttaaaaacacatcctatcacccaagtttaaccagaaaatgccatctctggtaaagtcacaacctgccatacacaacatgggcttctcagacattctgcccaccaccatcctggacaataggaatagataactgatattcatttattgaatgaactaagttaaagccatcattccctgcctacctcatgtaggtacctgcctacctcagaggtgatataacccagattgcaaatgtcaattagagtgggctccaccaacccccaacataactggcacacatatacccatgaatggggaccacatctgaattctcctttaggaaatgacttctcttgaatatgattcattttggtgaatttaatccacaggctccacagttttacaagtaaagaagataattatactctagttgttgacatgaactgcttggatgttcagggttgtggtgatgacgtgaacaacagacttcttcactctgcaagttacccaacagcaagctgggtggatgaagccatgccaacagcatctggcaggagccagcaccaagcacaccttacacagcttcgacagagctgcacggagaacacatatgcttggtcagctcaaatggtgtcctacttttcctgctgcatgatccacaacaatctgtgttctgttgttgtctgtttgtttttcttgcttggtttacaatttcttaaggaacttaacctggaaaacaagcccggtcatgtgggcctctgccatgccagaacactataggcagccgactctggagacaatttagcagatggatgaagctacaattattattggaagctttttaactccattgacactcactgactttaagtatctgaaagcacttaatccctcagaatttgaaagcagatggaagtcagtccctcccggaatcacctctctctctcccggcttccttcccctccctactccctcttccctccctctagctccctctgtctctcatacaaagtaccttatagtgtgagctccagacacacagacactgccatcctgcctacaaagaaaggaatgcagacacagccaacgtcagcattcggggtgggaccacagtggaacgcatacatcctttcacagctgccaaggccttctgggaagtccaatgcctgcccccacatctctcagagccaaacatcttcttctggtcaggaaaccctgttcagagtgcacagagagccagctcctcccttctctgctgaaatcctgggctcctgaggtcaaacagaatgttgtccaagccacctattttagagatgggaaaacagaggccctgggcagggccctggacttgtccggatcaatcaaaactagcatccaagtctcctggctgcgagacagttgcttcttttgtctacttctggccagagtagcctcctcagtagccaaacatttcctccatccccccagcggggatgtcacctgtcagaatgggaaaagggtagggttcccaccttactctgtttctcccctaagcccatctctccctgctgggaaggcccatggtattctatccccgcctctctcagagggcgtgcaactttgtgtcctaagttgattattttcctttcacattggttggtagtggcagtgaaggacacagactctaaagccaggctatctggttccaatcaccagctatgtgacttggacaaataatgctctcttctgtgcttctgttttcttctctgtaagtacagataataactgcacctactccatgtagggatctctgtgagcatgcagtgagttaatacacgtacatacggtatttagaacagcactggtcacatagtaagcaccggccgtgacctacaagagggcagcctaggccagcatttccatctgtcatcttcaaggccagcactgatgacaagggagggcgaccatctggtgagtcaccgtatctccagcacatagagggtgctcgataggaaccgtcgaatgaatgaatctggccgggtgcactgcgtatagcaggtgcttcatcatgtccactgatacgtggatttccataattcacaggctcacttagggaatgtcacttaccaagtttattggtgaataaattcaactttccatcaccaatagtttctgttgctctaaggcatttatcttcgctgctgtctttaaaaggttaaccagagcccagctgtcaatgtcaaaagcattgcctgtgcgaccacttggtacttaatcacctactgcttgacattttcttggttttatccaggctttgaaaaacaaagttcccaaaacactgcacttgatattcatctctgaggggccagtgaataaaaatatcttaatgaagaaagccagcagaaaacaacagagccttgaagtggaaaccggtttcctggaactccactctgcgagagggctgaagtgtttatgcagaggaaagtgccacagaagtggccgatctggaagctggaggacatctggatatggcatttaggactgacacagaaagtgtctggggcttatcaagtgaaaagcactccacaagaacaaaatatattagtcaccaccaaagtgggagttgaaaccgggcccacagcaaataaacactctgctgatcgctggccaaaatgcttagctgaagacgtttattaaccccattgaacatgtatacagagtcagcaagcatctaggacacaaacctgtcacagagctaagtgggagagtacccagggatttatgtgtggtgaccctgagtggcattaagaggttgagaagatgatagagccataacccctaaagcatctgccccagacactgcaccccttgggccaggactgctctcttccctcactaagtgaggtcccatgttaagcagaaggcctgcccaaccagccgagatacacctggcctgcaacacatctggcactgcaacctcatgaccgcttcacagcaaggaaggagaaacagggtcagtgcagatgcctggaagcagccagcatgcagtgctaaggatgtgggtcccacacagtggaggcttttcctgtgacctgaaaacacccaataaagaattttgtttttaccaaaccctgggtctctcaagtgcacacaaatgatgaattcagattttcaaaggtgaacagagctgggaaggcaccctctttgggatttctgggcaacagctaggcggagcagaacagactagcgtgaaaaactgacagcccttcccatagccagggggccctgacatttggtgcctacagattctgaccccctgacctgtacatgcccaacctccctccactcttcggggtcttttgttcctgtttctaaagagccaggaaggactggactccaccctagtccatccactgaagctcctgatgaaggatgccgggtgcctaggaggcccatatgcatttacactcatctgtcccagaaaactacagagcatgtgccgtgggctgggcaggcctggttccaaatcctgcctctgccttctttcactttgttttgagcctcagttccctcatctggagattgaaaactagacactccagaattgtttcacacactaagacaaggtttatatagcttaagaagtagagattgttcattatctgaataaatagaagtgactaatgatctttttcttgtatattatgaatgacaggaaaaagtcaggaggggaaattcctccaaagcttccctccgcacttcagaataaaatcccaaatccttacccagcccaggaggccctacttggcctgagtgtgtctcattatttagctctgtaccctcctgggcttgggccttaccacaccagccactcaacacacccacatccttcccattcacctctgggtctttgaacccactgttctctgcatccagcatgatttcactctttttttcatcccaagtcctagttgaaaaggctcattccttgagaggcgtccccagactctcctaattctagttctgctctgatctcctgtctcatgacatgctgttgttttcacttaaagcactttccacaagttacaattatgtatttacctgtgtgcttactgccctaacctcctacttatggactgatgtttatgtccctccaaagttcacatggtgagggagaacccccgatttgatggtgtttacagatagggctgttgggaggtgaataggtttaaatgaggtcgtgggggtggagccccaatgatgggattagtgcccttatagcaagagacatgagaaacctctttcacaaatcaggaagagggtcctcaccaaactcccatgctggcaaccaggtctcacacttccagcctgcagaactgtgagagataaatgtttgttgcttaagtcccccagtctgtgatagttttagcaacccaagctgactaagacatcctctccacccggcagcctccaaattccatatggccagaggcagggtctgtttcattcattgctgtaatccaagtacttagtagactcctggcaccagcaagactttctgataatatttgttgaattaacatgttgcagaattgaagccccaaagtgccagaaggaaccaagagctataaatagctttctaacagccttccacaccagggtagggggccagcagagcacttcacacacacagaaagccagaaaagcaattactacctcattatcaggaatgctaaagaagccacacctcactcaactgagaatttgcctttctgggcccccaaattccactgacccagacctcagggaagattgccagaactcaagaagaggccaaagccactggggtaaaggagagggaggatgagtaaggaatgtcagaaaaggtggtgtacttagaacagaccactgcacctttgatgtaatattattttcaatactgttgctgtccacctgagtctcaacctgggatctcctaggcctggtttctgtcttccaaacaccccccacatctgtctgggtgaaggcatgttttattacacacaggctaacaatctcagtgcatcgagatgacatttatctcaaaactaacattgcaacccactctaataatgttagtcaatatcggtatcagatttttttttccagttgatattaaccagcctaagcaatggatgaggtttaatgttatctggaagtgggaggaggcgacaggaggagtgagctgccactttcacttcctaagtaagctgctctttggaagcaggggctctgtttccagaaatatggccctacacagagcataagcacatctgactgttaatggcaggagatgggcatcaggaggtaggtagaataagcaggggtgggggtactcactgagcagctggggcagtggttaagaacagggactctgcttcaagtcctgggatagactttgggctagttatttaatcttgttgagcctcagttgtctcctctataaaacaagggaaatgataaccactgcacaggggcgctgggaagataaaatgagctaaaaacaaacaacaaaaaccctaaactcttagaccagtgtgggacacaggaagtctatgtaaatgctattcttatttagggtctaccagatcaggcctgtcatcatttcatttaatcaaatcaagcctcaaagcaatctttccagataggtagagttagcccattttacagattcaaaagccaaggctcaagaagattaaaaaccttatctgaagtcacacaactaggagaaggaaagaccagccctggaaccaaagtaatcatcataatctttatcatcataatcatgacttactagaagctgggtgatgtgctaagcactttacatagattagctcatcaaatactgaaaactgcccagcaaggaaagcattattgtaactagtttacaaaggaggacacagagttggagtggttaagtatgttggtgaaggtcacacagttagttaaggcagtgatccccaacctttttggcacgaggaactggtttcatggaagacaatttttccacagacagcggcgagtaggggcacaggggagatcgttttaggatgaaactgtctacctcagatcatcaggcattaaattctcataaggaatgtgcagcctagatccctcgcgtgtgcggttcaccatagggttcccctcgcatgagaatctgatgccaccgctgatctgacaggaggcagagttcaggcggtaatgcttgctcactgctgctcaccttctgctgtgcggcccacctaagaggccaccgactggtattggtccatggcctagggattggggacccctgaagtaaggaataaaacaggaattggatcctggttctgactccaaaacccattgtttcttccatttcagccctgcatgtctggtatactttatagacccaacatctctatttgaaatcatcaacacgcctgttttcatattaagtatgaaacactagctttgttaaatggagtccagaaatgacccactcactgaaggggcctgtgttgtaaggagttaggatatcccctgccaaaaaagcctagctttcccccagttccttccaagaaggtttggttttgaggtcataggcagcaatctgggcatgtgttacaagaagcaggggaagttcttactcattagacttttaatcttttgggaattagaaaacgaatactctcccaagtaaatcatcatctgctctcagctctgctatcatgtaaggcgtttccttagcaatatgtgactgccaggcccagttgcatgtggctctgaaaatatctaccaaatgactacattctcccaattctgaccctaacctgtatggtggcaatgacagaacagaaggccaagggacatcaactttctgaaacaaatgtaatcaaggtgaatgttcatgttttattaaaatcttaatctgccaaaatctggcactaatctggtgctcactttgaaattatctgggcccttactacagtgctctataatttagaggaaaaggacgcttcagtaaaacaaattctaaagtggcagtttactggagagtaacttttaatttccatgcagtataatacaaaattgccttgttggctctaaggacgtgcatccctcatcagggaactctgccccattagaggaccaaggtgagatcccttcagagtggcatcatccccggttggctcaatggctccagagacagggaggatggcgaagagaagggccggtggcatgcctgccttagccaactctgcacaggaatctctgcccacagtttggactgtggcagttccagataaaacacatgtttaaataagagttcaagccaggaagtcttgcctgaatgaactttctagcgtgggtaaaaaatgtcagctaactgacatgccagtgactactcacctctcaccacaagagtcaagtttagaaacaacacttgccctcaacgagtatttgatgcgctaaagagtttttccagaaaccaggtcagaccttttggataaatcaaaggaggccccttgtgtgacatgcaactgactgtccctagaagataaaagaaaatgggacttctgaaaacttgcaaaatacctagagcctctgcatgacaaaaattcagcataagtacacattttagcttttctaatttcttcttgcctaaaaaaaatccccccaataataagaatgatagaagaaactagtaacttaaaccttaaatcctacgttcatatcttagattttgaacaaatattgaatccttttctttgaataagagataagactttgatagtcttgtgtaagcaaatatcagtgatcacacatacactagaaaaacacttgatctttatgcctatattacttactgtttctatttctgatgtctaatctaaacagcactgctgttaggatcaaagtgaccatccatgatgcacagagcacgtaccagggtaaagttccagctgggacgcaggcatcagcaattgtagaatttgggttctcccttcctcagatccctgactgtccttggtcattcaagaaagattcactgtccctaggccaagagtcaggagcaaaacaggaacaccaagggtatggtctgaggatgttgtcagcagggagcaacgtgcgtgtgtgtgcacatacactaattctgagacactgtgcacagcccagctttcttggaaagccatttaaaagatatatatgtggcaacagagaggaggaagtctcaagattaagaacagcttttgagtgtgtgtgtgtcaaaatattcattcctatcacatgcagtaaaactgtattccagagccattaatacgccctgggggactgaggggatttgcagcctaagatttcagacttaaagcccgctaaggccctgagcggggcagcagggcaggagaaggaatggagcgttgaagggaacattttatagacattctccctcatagtggctgtactaagtaaacaattaacgggcacaaactgccactccagtgtctaataactacctctgccagagcacctgccagcgccaccaccttccaggtgtgtgatgcacatcatctcgctgaactatgctagcctcaggagagggttgctctttattttacaggtgggaaaacaggggcttggagaggtcaaggaacttgcccaaagtcacagcatagaagtgacagaatccgagttttgacccagatttgatgggttccaaagcgtgaacttatttctccactccacaaaaataaaacctactcttcttacaatatttgaaagagccctcttctaccactctgctgtttgttttaaacacagcttgcttatctgtctggcatattcggtagaagtctgtactttgtcaatgcctggtttgcctggatttcagctacctggcccctggcatctaagcctgggtgagaacagggaatccactcctctctaagatgcatcgtggagttactcttttactcttccctgaaagtgatagttcaatcttcaacaggggctttgagggagaacaaactcgaccctttggcaagcacgacttctggcttcaccgtttttttgttttttgtttgtttgtttgtttttgacggagttttgctcttgttgcccaggctggagcgcaacagggcgatctcggctcactgcaacctctgcctcccgggttcaagcaattctcctgcttcagcctcccgagtagctgggattacaggcatgcgccaccacgcccggttaattttttttttttttttttttagtagagacggtttcaccatgttgggccaggctggtctcgaactctcgacctcaggtgatccgcctgccttggcctcccaaagtgctgggattacaggcgtgagccaccgcgcccggccctggcttcacccttaaagcagaaaggccagaagtcatcaaggccatgggtttactagcttagcttccccagacttaatttcaaacaccaacaaccgaaatgtttcctagaatgcagagctaatgagacatcaacctctgtcatttcctatgtttttcacaatgtgccaaaacaactgcacacattggaggcgtttttgaatgtgatattcaggcgaccttgccaagcattgtctcatttccttactttgtggagcatgaaacccaagggaagttctcaccctctctccaggaccaagcaggacactgggagctgctgtcccgtctgcaggcgggactccatgaaggcccctgtctgcccttccagcctttgccacaaaccctcgaacgctggctgcacactggaatcacttggggagcttttaaaagatacggaggcctgggtctgactccgtgagattctgatggaattgatctagggtgcagcctggatatctggattttaaaagctccccaggtggttctaagctgctggcacgattgagaacccctgcgttcgaccacagtgggataaacgattccgctgactgtgaagttcatccctctcaactttcgctacatgcttcaaactcgcgggtttctccgcttggttccacccagagctcctccagagccgcgctgcgttccgcccgcacgcaaatcccgcctccctgcgcctcctcactcgcagcgcccaggacctcagaaagggcctgccccgcgcgaatccccagtcgctgggacttacttggccaccaggtttacagacttcgcagccgctgagagctagagaagagcccggagagcgccatggtccggggacgccggggccgggaagcgccgtggcccgggaggacgctgctcccgcagtagcgcgagggaggggcaggaccggggcggctgcctcgcgggcccggaac

SEQ ID NO: 2645 - DNA, 1446 bp, Homo sapiens
  source 1..1446: mol_type = genomic DNA
gagtttttcaaatcattttatctttaataatcttgtagtaatttaaaatatgagaaaaaaaagtcaaatgtgttccctttatgggtgatgccaccatgattgcctcacacaagcataatcaatcgccacgagagactggatgccaaagagtatggctggcaaaaaggcatcagggctcacagtccgaagagtttggttacggagtctccgaggggtaacaggtggcagaaaagacatcagtttaagggaccctcagaggacagggcgcggttgctgggtcatgagcaccttgaagcgtttcttgatggtgattcggtgtcgagagtatttgtcatctggggagaaccgagcaggatgggctgagcaggtctgttgtcccatcgggtcaaatttctgctccaggaacacagaatgtatgtcagtacaggagtgatgaaatggggtggggccagcgcgaaaaagggcaaacatgaaaatagaagatgcaatggtcaactcaaaaagttgtacaaataaatagagaaatataaaatttaaaaaggccgagcgcggtggctcacgcctgtaatcctggcactttgggaggtcgaggcgggaggatggtttgagaccagcctgggcaatatggcgaaacctcgtctctacaacaaacaaacaaacaaaaccaaccaaccaaacaaaaaaccccaaaaccaaaaattagccgggtatggtggcgcacgcctgtagtcccaactactcgggaggctgaggcagaaggattgtttgagcccaggaggcggaggttgcagtgagccgagaccgcaccaccgcactacagcctaggcaacaaagcgagtccctgtctttaaaaaaaaaaaaaaaaaaaaaaaggaaaagtgagtgcaatggcgctatcccggctcactgcaacctctgcctcccgggtttaagcgattctcctgtctcagcctcccgagtagctgggataacaggcgcacaccgccatgcccggctaattttttgtattttagtagaaacggagtttcacagtgttgcccagaatggtcgcgaactcctgagctaaggcaatccacccgcctcggcctcccaaagtgctaggattacaggcgggagccactgcgccccgccagaattttttcttttaattaaaaaatgagtcgcgcggtcccggttcttccccacctcggttctggactttctggttccccgcacccagctaggtaactccacgtatgacctcacccactcctcccatctacatttctcgccatgcctatttacaccctgttttctctcctcaccttcagcgtatagactcgatctccctgctcgttgaggtaatactggagaaacatgatcgcttataagccagcggtcccaattcggtccaccgctcagtctgcagtggtccgcccgaccgcgtcacgtgttcgtcaatttcct

SEQ ID NO: 2646 - DNA, 1668 bp, Homo sapiens
  source 1..1668: mol_type = genomic DNA
ttaagtgcttcaaaaatacagtatttattgtaataactacagtagcaagaagaaaaaaacgaagtggaactacgtgtttagcagcagagctgaataattatgaatataaacaattactattgggagaaaatacattacactcattgcttggaaccatgaataatacttatatatgtacgaaatatagaaaaataaaataggttaacataataaggatataggcaattattttttttaattttataaaaacttttatttttccttacaaactggggtagttaggagacctgataatagcttttttattttcttggcaccaaagcaacttacttatgtgttccttcttgcattatctgttccagatcatagtcaagttttccaattcgttttactaagctagcaaaattttttataccaaaaagagtaaaatcaaaacaaatgctcctttgtttatagatgaaaatctggagcaaaataacacaacattaaaaaaacaaaactttgcaaacacatcctaaagctacacacattgaagcgtttacagcaatatgctccctgggttcgttctcccttcccccaatcctctaaactgtgcctttgggtctcagacccttgtcccgggggtccctctgaatccacctttcaagaggatggagctgggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttggtggggtagacccctaagcgccgcagaaagtcccaggcttcagtttccttgatggtgttgcccttcataaagatgagccctaagacgatcatcaggaggcccgtagtgggcgtgccttggtcacccctcatctcggcatcctcctccacaggctccagggtgttgatgaggatgtaagtgttgctcttgggttcaagttccaccagcttatacccgaagacgtactggaggcgctcggcggcccgtttgaagaggtcggggaagatgtccttgtagtccccgatgacgtgcttcagtatgtcggcccgcttgatcggaatcttcttctggtctttaatcagcaagaactgcaccagctcggacactttcagctccagctgcttctggctcctgggccccacggcgggggcggcctgggcccggcgggcgccctgaggcgaggggccctgcgacccctgcgagccgcccggcccgcgggacgtgctcggggcctcctcggcaaagccgtctctgagaacccgggcgtcttccccggcccgcgaagccccggggtttccgctatggctccagtctctgtccctctcggcctggccgccagagcggccccggttcctcggtttttgcaacatgtctccggcggcaggtgccggcgcacactccggtaggcaagcagccgcggcggggattgcgggtcggcgacccgctaacgccggtgcctggaggcgcgcgcagtgtcggct

SEQ ID NO: 2647 - DNA, 12974 bp, Homo sapiens
  source 1..12974: mol_type = genomic DNA
tcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaaggtgagtccaggcctgcctggccaggggaggggtggctgaatgtgcaagagttgagattgagaatgagagagagagagagagagaagcaaaaacctagaacccagggtgcaaatgtgagtacagagagctgagatcttctgggatggtggtttcttatttatccacacagcatgttaaaatagattctggggtgaaatcctacatccctattattaacaagtgaccctcccccctacttcccgctgaagtttatgaaccactgtcctgggcgatgcccatttcagaaatagggaactgaatcccagctctggtaaacagtttgctaattcgtggccaggctaggggctcaccatttctgcagtgaagaatcatatgttttgaaagcaaatagcacctgctggctgcaagaccttgagcaagtcacttaactactctgtgttccaatttcctcagccataatccccaatactgttgcagtcttgccagtgcaccttaatgtagcagcttctcactgaattagtacccaaggttctttgtcctgcatccaagaaaattaaggaacatggacacaaacgtgagcttggagcaaaagttcagtaagcaaaagaagaaagctgtctccactgtggagagggaagtctgagtggattgccagattgcagctgaatgcaaaaaacttttataagaaaccactctcctccctgtaactgtttgagaaactttttatcagtaaagctgtgcaacttcccttaccttatgcagctgtgggtatatctctaggcaagcataaagcgctgcttctcttgtatgtataactgtggatttgttttaggtaagtcccactccctgcgccagtttcaggcaggccgctcctccagggcccagccttgaccatttacctaactgatttttcctctactttccctcaatacctcatagggccgtgtagattaagtaaaatagtaagtgtgaaccacccagcataagctagtcctgggcatcgtaaaggacaatgggaaaagaacacagatcctggaagaaggcccccaggtttgaattgtatttgccacctactagctgggtgatggggctgatatattatctcactgagcatccattttcccatctgtaaaatgggaactaatgataatggcatccaaatcatagcatcattgtgagcattataggagtttaagacatgcaatgccttcagaacagtggctagtgctccataatgttagtgattgctcctgtcattttatttagggaggtttgcctcactaagcatcaattattatttttgtcgtctttttcagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtgagagctcccagcttctttttctccctcttcccatttctgagcagaaatctcccacagtttgagagctttttgccccaacagggcatctctctaaagcagggtgggaggagatcttaggatctgtcccggggcaagaatgaatacggtcatgatctatcacaggagagacattaaacagcaaattggcataatgtggggacaaagacatttcttacagaacatctgcaaggcttactggttctgtttaaggcaaaatgtgtgaattttatctttctaaaatcaggcagcaaagatgtggcttaaagttcatgttactctcatctttgtcccaacatgagatctcatcaaacgtatgcagcacgttgggagatagatatttataatttgcaggaacatttggacaggaagtgtaacctctcagaggctcccttgccacatcaggagaattggtaaaaccacactacctgtatcatatcattattttaagtgataaatgatcatctacattcagctctgatgagtaataggtgttcaaaaataggaacttccagccaagtgtggtggctcatgcttgtaattccaacacttttggaggctgaggcaggagggtcgcttgagcccaggagttcaagaccagcctgggcagcaaagtgaaacctcatctctactaaaaattttaaaacattagccaagtgtggtggtacatgcctgtggtcgcagttattcaggacgctgagactgaacgatcacatgaggccagccaaggattcgaggtgtcagtgagccacgaatgtaccactgcactccatcctaggcacagagcaagagcaagaccctgtctcaatcaatcagtcaatcagtcaaaactatgaatttcccagctgtatatgaaggcacctcaaaacaccacagtgaactcacagagggacacggaatagtttagattttaattttttgagggaaatgcgatgacatctgtcacacaccgcacaaacggctactattaaactgaacttactgattagtggctactaattaatagttggtcattaagcagtaattagtgattaattatcaagtaattaggacttaattaaaggaactgtcacagtttcctttagtcctagggcagccatgaaaaaaaaaatgctgactctccaaagacaccagggtatgagaaagttttggattctctcctttgtgccatctcctgtgttgggggctgaagtacaatggttgtaaaagacaagagggagaaggctggtcacagtggctcacgcctgtaatctcagcactttgggaggccaaagtggggggatcacttgaagtcaggaattcaagaccagcctggccaacatggtgaaatctcacatctactaaaaatacaaaaattagctgggcgtggtggtgtgtgcctgtaatcacagctactcgggaggctgaggcaggagaattgcttgaacccaggagatggaggttgcaatgagccaagatcatgccattgcactccagcctgggcaacagagtgagactccatctcgaaaaaaagaaaaaagaaaagaatataaggagtgattaaaaaagaaaagaaaagaaaactaagtagggtgaaacaatagatagccatgggggttagggagcttttttagacagggtcgtgagggagggtccctgagcctgagtggcgagaaggagtgagccttggggagatctggaggttctgggaagaggaatggcaagtgcagaggccctgaagcagcaatgaccatggcacatttgaggaagagagaaaaagtcagagaagtagaaagtgggcaaaggaagcaagacaggaggtgaggtgggagaggttccagagaccagatcacaccagacatcattggccaccataagatctttgggttttaaaattccagatgttatgggatgcaggaagcagcatgatcagcagcattctctaggtgccaggttgagaacaggctgtgggggaacctgtaaagaggttgctgccatagttccggcgagtgacggtggtggcttggatggggtgatggcagtggagagggcaggagggaggatcaggaatggacctcaagacttcccagccctgggtctgctgcacttttcaatcaaaccccatggccagggagattgtcccctcagagtgactgaaggaaattcagagaagagctgacacctaagttgtagattttgcccgaacaggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaatgtatggccctcccaccaggcctggtgggtcctgtctcgactgggagcagaggaggggtggggggaggagagaaagaagggagtgaagggaagaggagggggagtggtggagggaaatagagggatggaaaaaggagagaaaggaaaaagaggtggagagaggagcctgcaacagaagggagaatgaaagggaaggaagagagaaaggaagggattttggtgttctgttcactgctgtatccccagaacttaaaacagagcctggtgcataataggtgtaaataactgttgaataaatgaatcaatgctacatacacacacgcacgcacacacacacagagagagagtcaaccacactcttcagaaggtggataagttaaaacaagagtttcaaacaaatatatgttcagatgccctttcctcccacttactggctggctggccttaagtaagcaacttaacctttctgttctttctgctttcttatctgcaacgagtagcatgccatagctagagtaacacggcatatagttggtcctgataaatgtagcatattttagccaccataggagtacacataataaaagctaacatgtagtatgtgcttagcttatctatgttttgtggatgtgatacaattttctgttcacttttaaatgccctgcatcttagtcaattttaacagtgattctgtaagttagataaggttaggcattattattaaatccattttacaccaagagaaacttgggtcaaaaagagaaactcctgggtcacatggctcattcggccaataagtagcagaagtaaaatttgaatttggctgggcgcggtagctcacaccagtaatcccagcactttgggaagccaaggcaggtagattgcttgagcccaggagttcaagactagcctgagcaacatggcaaaacctcgtctctacaaaataaactaaaaatttagccaggtgtgatggtgagcacctgtagccccagctactgggtaggctgaggtgggaggatcgcttgagcctgggaggaggaggttgcagtaagtcaggattgcactactgccctccagcctgtgagacagagcaagatcttctctcaaacaaacaaacaaacaaacaaacaaaaactcgaatttgggtctattgacttaagagtttgcctgataataataggcattcaatgtatatttcttgaatgaacgaatgaatgaaaataatcaggaataaactttccaatttaaaagtaacacctctaggtaaaaaaaagacaatcatttagttgccagacttctaagtgtttgctgttctatgaattgtaatcatggagcctgagcattgtagaatttacaaaagcagttcctgacaaaagcagcactgcccccagggacatattgaaaattaatgagggtgtttttggtaaccatggtgatgggaggacatgggtgctacttatatttagtggaaagaagacaagaatgctagttattgtacaatgatcaagagagtcctgcacagccaagaattgtctttttctttctttcttgatgctgttctcctttaaaacaagacaagattaacaataatttaactccactaaccaccatcatcaccacctccaacttatatgctacatttcttgtatatttcaagtctgtttatattttcaagtgcctcgaagtattattgttttatagccaaatgtttagttaatctgctcacagatttaccactttcttcactattcattctgtcttacacctctaacattccatctggggtaattttcctaaatgatcatgcatcctttgggatttcttttgatgatggtctattggtagtaaactctctcagttattgtttgtctgaaaatgtcatgcttttgccttcattgttgaagggtgcttttgctgggtggtcatttcagtatattgaatatatcattccatcttccagtgtcatcattaaaaagtcagttgccagtctaactgcagctcttttataagtaacctgtcttattcttctggctgcatgtaaaagttttctctttgtctttgattttgtttagcttcaatctgctgtgtcttaatgatgggttcctattgtttgtcctgattgggattccgttaagattcctgaatctgtgggtagatatctttaatcagttttgaaacttctcagccattcttctaaaatattgattctccttcattctctcctcaccttctagaattccaattaaatgtatgttagaccctgctctatctttcatatctctatactctcttctgtgtttttcatccttttgtctatttttccatgctttattctgaatagttccttctaatctaccttccaattaactaattttctctttagctatatctaatttgctgtaattaattacagttgccatttttatcctaaaatttctatttcatatttttgtatctgccatggtacttcttatggcttttaattccctgctaactatttaaagttcttattttatcctgtgaatatgatattcctagttattttatttttaatttttattatttgttaatcttatgttttatttacacttcttttctgtgacatgagcacacacagattcatgtgtatacatatatggctctgatacctctcctttcctgtcctcattcaaaccactgatcacagagagaggactatttttttttatttttaatttttctatttcaataggtttttgggggaacaggtggtgtttggttacatgaataagttctttagtggtgattttggtgcacccatcacccaaacagtgtacattgtacccaatgtgtaatcttttaacccttgccacaccccaccctttccccgcagtccgcaaagtcccatgtatcattcttatgcctttgcttcctcatagcttagctcccacatatgagtgagaacatacaatgtttggttttccattcctgagttatttaattaaaataatagtatccaattccatccaggttgctgtgaatgccattattttgttcctttttatggttgagtagtattccatggtgtgtttgtgtgtgtataacatttttctttatccactcattgattgatgggcatttgggctggttccatatttttgcaattgcaaattgtgctgttataaacatgtgtgtgcaagtatcttttttgtataatgacttcttttcctctgggtagatacctagtagtgggattgctggatcaaatggtagatctacttttagttctataaggaatctccacactgttttccatagtggttgtatgagtttacattcccaccaatggtgtaaaagtgttcccttttcaccacatccacaccaacatctattattgtttgattttttattatgaccattcttgcaggagtgaggtggtatcacattgtggttttgatttgcatttccctgataattagggatgttgagcatttttccatatgcttgttggtatttgttttttttttttttttttcattattatactttaagttttagggtacatgtgcacaatgtgcaggttagttacatatgtatacatgtgccatgctggtgtgctgcacccattaacccgtcatttagcattaggtatatctcctaatgctatccctccccaattccccccaccccgcttgttggtatttgtatatcttcatttgagaattctctgttcatgtccttagcccactttttgatgagattttttttttcttgctgattcgtttgagttctttgtagattctggatattagttggatgtatagattgtgaagattttctcccattctgtgggttgtctgttaactctgctaattatttcttttgctttgcagaagctttttagtttaattaagtcccatctatttatctttgtttttgttgcatttgcttttgggttcttggtcatgaagtctttgcctaagccaatgtgtaggagggtttttccaatattatcttctagaatctttatggtttcaggtcttagatttaagtatttgatcgattttgagttgaattttgtataaggggagagagaaggattcagtttcattcttctacatgcaacttgccaattatcctaggaccatttgttgaatagggtgtcctttccccattttatgtttttgtttggtttgtcaaagatcagttggctgtaagtgtttggctttatttctgggttatctattctgttccatttgtctacgtgactatttttataccagtaccatgttgttttggtgactatggccttacagtatagtttgaagtctgataatgtaatgcctccagatttgttctttttacttagtcttgctttggctatgtgagctcttttttggtgccatatgaattttaggattgttttttctagttctgtgaagaatgatggtggtattttgatgggaattgcattgaatttgtagattgtttttgggagtatggtcattttcacaatattgattctacccattcatgagcatgggatgtgtttccatttgtttgtgtcatctatgattttctttcagcaatgttttgtagttttccttgtagagttcctagttattttaaagtctgtgttcggtctttcagcatttaaagtttgtaggtttattactatttctcttctttctgttggtcataactcttagtgttttgtttccttgtgtgcctggttacatatgtgctggtcattgtatttgaaaattatgtgtgaaataatttgaggttttggattatgtatattcctccagaaagaatttcatttgcttctgtgcatttcttaggaacattacaagtccttcttctcagttaattttcgtagtatctttatcagataggtgctattacaaccactcacttagcagatgaaaatcatgaggctctgagagtctaagtcatctacttagaattggacaatggtgaagccaggattcaaacccacatcaataagaatccagcgctcttaacaaggggccagtacacttttttaaaaaataaaaggctagatagtaaatattttagactttgtggactgcacagcctctgttgcaactactcaaccctgcctttgtagcatgaatgcagtcataaactatacataaatgaatgagcctggattcgttccaaggaaactttataaaaacaggtggcaggctggatttggcccatgagaagtgtagtttacacaaaagttgagcaaaccaatttttttctgattgtttttcctcttctcagtgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggtatgctatccccacatggcttagctcccctatgtaaatgaacacctggatacaggtacagtgccttggaaatggaggaggtgggagggctccccacttagtgagaatctcctgttgcccatcattgtactgggcattttactactgccatctgttttaaacacctacctccaaccctgtgaggcaggcactatgccaattattttacaggtgagtaaactgaggttctgagaggtaaggagcttgtccaacccttaacagaaaatgagtaaaatagctgcagtttgaactgaaataagaacagcagcaacaacaatgatagtaattgctcccaggtattgaaagcttgttgtaagactaacacatgctaatataatagtaaaaattattagcaatattactgatatgtatgttatgttctagtcgctgtgctgagcatttcatataactgggctttttctatcctcacagcatagcctttgagataggtatgtggaactattcccattttacagataagaatcctgaggcttagagagttcaagtgacctacccaagggcacatcactgataaagggcagaggtgggattcaaacccacatctgtcaggtgcaagtgcaaggctccttctcctcatgctcactgcctgctggggaatagggcactggggacataccccagggagcccttcctcatgttctgagtcccagttcatcccatgctgctattttgctctcccaggagcatctggactccctagacagagccccagcttctcacctgtccctctctaaatgctgctctgcaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaatcccatgaggcatttttaaaaattttttattattttagattcagagggcacatgtgccatttgttacacagctatattgtgtaatggtggggtttgggcctctattgatcctgtcgcccaaatagtgaacagagtacccaaaaagaattttttcaacctttgcctttctcccttcctcctccctgttggagtccctagtgtctattgttcccatctttagcagatgttaagtatttgattttctgtttctgggttaattcacttcggataatggcctccagctgcaaccatgatttcattctttcttatggctgcataatactccatggtgtagatataccacactttctttatccagttcacactgatgggcacttaagttgattccatgactttgctattgtgaatcgtactgcgataaacatacgagtgccggtgtcttttgatagaatgatttctttacctttgggtagataccgagtagtgggattgctgggttgaatggacattctacttttagttatttgaaaagtcccatgaggcatgttttctatcattcccatcttacagatgagacaaaggctcagagaggtgaggtcacttgctcaaggacatcagctaacaagtggtggaaatggaattcaagctcagtggactctaaagccagtgctcatgtcactgtgctaaacagcctgccttgtcacatccccacctctcatctgaccaatgggagactctgagcagctgagtgacttgggttgtcacacagctaaacaggggcaaaggacccagtcttggatctttccacctccaagcaggaatctgtctgattccaggggattgatgatgttgcagatggctaggaagcagactccaggatggaatttagtatgcaggatgttctgggggagagccactggaaccagcactcagggaaaggggggaagaaaggataggaaggaagcatgaaagagaatagggagaagtgaacagggatgcagagcgaatgccagtttcagccaactccaaggacagccctggagctggaatggcctttagagctgccccatggtgacagaggtggccaggcttctatacccctacgtggatcactcactgtgcttgggcaccttgggaaagggcatggctttgagcaaaaggctctctgcagctgaggcaacccctaaaagggctgacggctgaagtctgtctgctgaccactgtcccagcagctggggcttgttagtccttcctcaaagggggatccagatggcatgtcacagtgtctaccgtaaatgctcactgaatccagctgcaatgcaggaagactccctgatgtgatcatgtgtctcaccctttcaggctgaaagcaacagtgcagacgatgagaccgacgatcccaggaggtatcagaaatatggttacattggaacacatgagtaccctcatttctctcatagacccagcacactccaggcagcatccaccccacaggcagaagaggactggacctgcaccatcctctgaatgccagtgcatcttgggggaaagggctccagtgttatctggaccagttccttcattttcaggtgggactcttgatccagagaggacaaagctcctcagtgagctggtgtataatccaggacagaacccaggtctcctgactcctggccttctatgccctctatcctatcatagataacattctccacagcctcacttcattccacctattctctgaaaatattccctgagagagaacagagagatttagataagagaatgaaattccagccttgactttcttctgtgcacctgatgggagggtaatgtctaatgtattatcaataacaataaaaataaagcaaataccattta

SEQ ID NO: 2648 - DNA, 11093 bp, Homo sapiens
  source 1..11093: mol_type = genomic DNA
tcccttctgaggaaacgaaaccaacagcagtccaagctcagtcagcagaagagataaaagcaaacaggtctgggaggcagttctgttgccactctctctcctgtcaatgatggatctcagaaataccccagccaaatctctggacaagttcattgaagactatctcttgccagacacgtgtttccgcatgcaaatcaaccatgccattgacatcatctgtgggttcctgaaggaaaggtgcttccgaggtagctcctaccctgtgtgtgtgtccaaggtggtaaaggtgagtccaggcctgcctggccaggggaggggtggctgaatgtgcaagagttgagattgagaatgagagagagagagagagagaagcaaaaacctagaacccagggtgcaaatgtgagtacagagagctgagatcttctgggatggtggtttcttatttatccacacagcatgttaaaatagattctggggtgaaatcctacatccctattattaacaagtgaccctcccccctacttcccgctgaagtttatgaaccactgtcctgggcgatgcccatttcagaaatagggaactgaatcccagctctggtaaacagtttgctaattcgtggccaggctaggggctcaccatttctgcagtgaagaatcatatgttttgaaagcaaatagcacctgctggctgcaagaccttgagcaagtcacttaactactctgtgttccaatttcctcagccataatccccaatactgttgcagtcttgccagtgcaccttaatgtagcagcttctcactgaattagtacccaaggttctttgtcctgcatccaagaaaattaaggaacatggacacaaacgtgagcttggagcaaaagttcagtaagcaaaagaagaaagctgtctccactgtggagagggaagtctgagtggattgccagattgcagctgaatgcaaaaaacttttataagaaaccactctcctccctgtaactgtttgagaaactttttatcagtaaagctgtgcaacttcccttaccttatgcagctgtgggtatatctctaggcaagcataaagcgctgcttctcttgtatgtataactgtggatttgttttaggtaagtcccactccctgcgccagtttcaggcaggccgctcctccagggcccagccttgaccatttacctaactgatttttcctctactttccctcaatacctcatagggccgtgtagattaagtaaaatagtaagtgtgaaccacccagcataagctagtcctgggcatcgtaaaggacaatgggaaaagaacacagatcctggaagaaggcccccaggtttgaattgtatttgccacctactagctgggtgatggggctgatatattatctcactgagcatccattttcccatctgtaaaatgggaactaatgataatggcatccaaatcatagcatcattgtgagcattataggagtttaagacatgcaatgccttcagaacagtggctagtgctccataatgttagtgattgctcctgtcattttatttagggaggtttgcctcactaagcatcaattattatttttgtcgtctttttcagggtggctcctcaggcaagggcaccaccctcagaggccgatctgacgctgacctggttgtcttcctcagtcctctcaccacttttcaggatcagttaaatcgccggggagagttcatccaggaaattaggagacagctggaagcctgtcaaagagagagagcattttccgtgaagtttgaggtccaggctccacgctggggcaacccccgtgcgctcagcttcgtactgagttcgctccagctcggggagggggtggagttcgatgtgctgcctgcctttgatgccctgggtgagagctcccagcttctttttctccctcttcccatttctgagcagaaatctcccacagtttgagagctttttgccccaacagggcatctctctaaagcagggtgggaggagatcttaggatctgtcccggggcaagaatgaatacggtcatgatctatcacaggagagacattaaacagcaaattggcataatgtggggacaaagacatttcttacagaacatctgcaaggcttactggttctgtttaaggcaaaatgtgtgaattttatctttctaaaatcaggcagcaaagatgtggcttaaagttcatgttactctcatctttgtcccaacatgagatctcatcaaacgtatgcagcacgttgggagatagatatttataatttgcaggaacatttggacaggaagtgtaacctctcagaggctcccttgccacatcaggagaattggtaaaaccacactacctgtatcatatcattattttaagtgataaatgatcatctacattcagctctgatgagtaataggtgttcaaaaataggaacttccagccaagtgtggtggctcatgcttgtaattccaacacttttggaggctgaggcaggagggtcgcttgagcccaggagttcaagaccagcctgggcagcaaagtgaaacctcatctctactaaaaattttaaaacattagccaagtgtggtggtacatgcctgtggtcgcagttattcaggacgctgagactgaacgatcacatgaggccagccaaggattcgaggtgtcagtgagccacgaatgtaccactgcactccatcctaggcacagagcaagagcaagaccctgtctcaatcaatcagtcaatcagtcaaaactatgaatttcccagctgtatatgaaggcacctcaaaacaccacagtgaactcacagagggacacggaatagtttagattttaattttttgagggaaatgcgatgacatctgtcacacaccgcacaaacggctactattaaactgaacttactgattagtggctactaattaatagttggtcattaagcagtaattagtgattaattatcaagtaattaggacttaattaaaggaactgtcacagtttcctttagtcctagggcagccatgaaaaaaaaaatgctgactctccaaagacaccagggtatgagaaagttttggattctctcctttgtgccatctcctgtgttgggggctgaagtacaatggttgtaaaagacaagagggagaaggctggtcacagtggctcacgcctgtaatctcagcactttgggaggccaaagtggggggatcacttgaagtcaggaattcaagaccagcctggccaacatggtgaaatctcacatctactaaaaatacaaaaattagctgggcgtggtggtgtgtgcctgtaatcacagctactcgggaggctgaggcaggagaattgcttgaacccaggagatggaggttgcaatgagccaagatcatgccattgcactccagcctgggcaacagagtgagactccatctcgaaaaaaagaaaaaagaaaagaatataaggagtgattaaaaaagaaaagaaaagaaaactaagtagggtgaaacaatagatagccatgggggttagggagcttttttagacagggtcgtgagggagggtccctgagcctgagtggcgagaaggagtgagccttggggagatctggaggttctgggaagaggaatggcaagtgcagaggccctgaagcagcaatgaccatggcacatttgaggaagagagaaaaagtcagagaagtagaaagtgggcaaaggaagcaagacaggaggtgaggtgggagaggttccagagaccagatcacaccagacatcattggccaccataagatctttgggttttaaaattccagatgttatgggatgcaggaagcagcatgatcagcagcattctctaggtgccaggttgagaacaggctgtgggggaacctgtaaagaggttgctgccatagttccggcgagtgacggtggtggcttggatggggtgatggcagtggagagggcaggagggaggatcaggaatggacctcaagacttcccagccctgggtctgctgcacttttcaatcaaaccccatggccagggagattgtcccctcagagtgactgaaggaaattcagagaagagctgacacctaagttgtagattttgcccgaacaggtcagttgactggcggctataaacctaacccccaaatctatgtcaagctcatcgaggagtgcaccgacctgcagaaagagggcgagttctccacctgcttcacagaactacagagagacttcctgaagcagcgccccaccaagctcaagagcctcatccgcctagtcaagcactggtaccaaaatgtatggccctcccaccaggcctggtgggtcctgtctcgactgggagcagaggaggggtggggggaggagagaaagaagggagtgaagggaagaggagggggagtggtggagggaaatagagggatggaaaaaggagagaaaggaaaaagaggtggagagaggagcctgcaacagaagggagaatgaaagggaaggaagagagaaaggaagggattttggtgttctgttcactgctgtatccccagaacttaaaacagagcctggtgcataataggtgtaaataactgttgaataaatgaatcaatgctacatacacacacgcacgcacacacacacagagagagagtcaaccacactcttcagaaggtggataagttaaaacaagagtttcaaacaaatatatgttcagatgccctttcctcccacttactggctggctggccttaagtaagcaacttaacctttctgttctttctgctttcttatctgcaacgagtagcatgccatagctagagtaacacggcatatagttggtcctgataaatgtagcatattttagccaccataggagtacacataataaaagctaacatgtagtatgtgcttagcttatctatgttttgtggatgtgatacaattttctgttcacttttaaatgccctgcatcttagtcaattttaacagtgattctgtaagttagataaggttaggcattattattaaatccattttacaccaagagaaacttgggtcaaaaagagaaactcctgggtcacatggctcattcggccaataagtagcagaagtaaaatttgaatttggctgggcgcggtagctcacaccagtaatcccagcactttgggaagccaaggcaggtagattgcttgagcccaggagttcaagactagcctgagcaacatggcaaaacctcgtctctacaaaataaactaaaaatttagccaggtgtgatggtgagcacctgtagccccagctactgggtaggctgaggtgggaggatcgcttgagcctgggaggaggaggttgcagtaagtcaggattgcactactgccctccagcctgtgagacagagcaagatcttctctcaaacaaacaaacaaacaaacaaacaaaaactcgaatttgggtctattgacttaagagtttgcctgataataataggcattcaatgtatatttcttgaatgaacgaatgaatgaaaataatcaggaataaactttccaatttaaaagtaacacctctaggtaaaaaaaagacaatcatttagttgccagacttctaagtgtttgctgttctatgaattgtaatcatggagcctgagcattgtagaatttacaaaagcagttcctgacaaaagcagcactgcccccagggacatattgaaaattaatgagggtgtttttggtaaccatggtgatgggaggacatgggtgctacttatatttagtggaaagaagacaagaatgctagttattgtacaatgatcaagagagtcctgcacagccaagaattgtctttttctttctttcttgatgctgttctcctttaaaacaagacaagattaacaataatttaactccactaaccaccatcatcaccacctccaacttatatgctacatttcttgtatatttcaagtctgtttatattttcaagtgcctcgaagtattattgttttatagccaaatgtttagttaatctgctcacagatttaccactttcttcactattcattctgtcttacacctctaacattccatctggggtaattttcctaaatgatcatgcatcctttgggatttcttttgatgatggtctattggtagtaaactctctcagttattgtttgtctgaaaatgtcatgcttttgccttcattgttgaagggtgcttttgctgggtggtcatttcagtatattgaatatatcattccatcttccagtgtcatcattaaaaagtcagttgccagtctaactgcagctcttttataagtaacctgtcttattcttctggctgcatgtaaaagttttctctttgtctttgattttgtttagcttcaatctgctgtgtcttaatgatgggttcctattgtttgtcctgattgggattccgttaagattcctgaatctgtgggtagatatctttaatcagttttgaaacttctcagccattcttctaaaatattgattctccttcattctctcctcaccttctagaattccaattaaatgtatgttagaccctgctctatctttcatatctctatactctcttctgtgtttttcatccttttgtctatttttccatgctttattctgaatagttccttctaatctaccttccaattaactaattttctctttagctatatctaatttgctgtaattaattacagttgccatttttatcctaaaatttctatttcatatttttgtatctgccatggtacttcttatggcttttaattccctgctaactatttaaagttcttattttatcctgtgaatatgatattcctagttattttatttttaatttttattatttgttaatcttatgttttatttacacttcttttctgtgacatgagcacacacagattcatgtgtatacatatatggctctgatacctctcctttcctgtcctcattcaaaccactgatcacagagagaggactatttttttttatttttaatttttctatttcaataggtttttgggggaacaggtggtgtttggttacatgaataagttctttagtggtgattttggtgcacccatcacccaaacagtgtacattgtacccaatgtgtaatcttttaacccttgccacaccccaccctttccccgcagtccgcaaagtcccatgtatcattcttatgcctttgcttcctcatagcttagctcccacatatgagtgagaacatacaatgtttggttttccattcctgagttatttaattaaaataatagtatccaattccatccaggttgctgtgaatgccattattttgttcctttttatggttgagtagtattccatggtgtgtttgtgtgtgtataacatttttctttatccactcattgattgatgggcatttgggctggttccatatttttgcaattgcaaattgtgctgttataaacatgtgtgtgcaagtatcttttttgtataatgacttcttttcctctgggtagatacctagtagtgggattgctggatcaaatggtagatctacttttagttctataaggaatctccacactgttttccatagtggttgtatgagtttacattcccaccaatggtgtaaaagtgttcccttttcaccacatccacaccaacatctattattgtttgattttttattatgaccattcttgcaggagtgaggtggtatcacattgtggttttgatttgcatttccctgataattagggatgttgagcatttttccatatgcttgttggtatttgttttttttttttttttttcattattatactttaagttttagggtacatgtgcacaatgtgcaggttagttacatatgtatacatgtgccatgctggtgtgctgcacccattaacccgtcatttagcattaggtatatctcctaatgctatccctccccaattccccccaccccgcttgttggtatttgtatatcttcatttgagaattctctgttcatgtccttagcccactttttgatgagattttttttttcttgctgattcgtttgagttctttgtagattctggatattagttggatgtatagattgtgaagattttctcccattctgtgggttgtctgttaactctgctaattatttcttttgctttgcagaagctttttagtttaattaagtcccatctatttatctttgtttttgttgcatttgcttttgggttcttggtcatgaagtctttgcctaagccaatgtgtaggagggtttttccaatattatcttctagaatctttatggtttcaggtcttagatttaagtatttgatcgattttgagttgaattttgtataaggggagagagaaggattcagtttcattcttctacatgcaacttgccaattatcctaggaccatttgttgaatagggtgtcctttccccattttatgtttttgtttggtttgtcaaagatcagttggctgtaagtgtttggctttatttctgggttatctattctgttccatttgtctacgtgactatttttataccagtaccatgttgttttggtgactatggccttacagtatagtttgaagtctgataatgtaatgcctccagatttgttctttttacttagtcttgctttggctatgtgagctcttttttggtgccatatgaattttaggattgttttttctagttctgtgaagaatgatggtggtattttgatgggaattgcattgaatttgtagattgtttttgggagtatggtcattttcacaatattgattctacccattcatgagcatgggatgtgtttccatttgtttgtgtcatctatgattttctttcagcaatgttttgtagttttccttgtagagttcctagttattttaaagtctgtgttcggtctttcagcatttaaagtttgtaggtttattactatttctcttctttctgttggtcataactcttagtgttttgtttccttgtgtgcctggttacatatgtgctggtcattgtatttgaaaattatgtgtgaaataatttgaggttttggattatgtatattcctccagaaagaatttcatttgcttctgtgcatttcttaggaacattacaagtccttcttctcagttaattttcgtagtatctttatcagataggtgctattacaaccactcacttagcagatgaaaatcatgaggctctgagagtctaagtcatctacttagaattggacaatggtgaagccaggattcaaacccacatcaataagaatccagcgctcttaacaaggggccagtacacttttttaaaaaataaaaggctagatagtaaatattttagactttgtggactgcacagcctctgttgcaactactcaaccctgcctttgtagcatgaatgcagtcataaactatacataaatgaatgagcctggattcgttccaaggaaactttataaaaacaggtggcaggctggatttggcccatgagaagtgtagtttacacaaaagttgagcaaaccaatttttttctgattgtttttcctcttctcagtgtaagaagaagcttgggaagctgccacctcagtatgccctggagctcctgacggtctatgcttgggagcgagggagcatgaaaacacatttcaacacagcccagggatttcggacggtcttggaattagtcataaactaccagcaactctgcatctactggacaaagtattatgactttaaaaaccccattattgaaaagtacctgagaaggcagctcacgaaacccaggtatgctatccccacatggcttagctcccctatgtaaatgaacacctggatacaggtacagtgccttggaaatggaggaggtgggagggctccccacttagtgagaatctcctgttgcccatcattgtactgggcattttactactgccatctgttttaaacacctacctccaaccctgtgaggcaggcactatgccaattattttacaggtgagtaaactgaggttctgagaggtaaggagcttgtccaacccttaacagaaaatgagtaaaatagctgcagtttgaactgaaataagaacagcagcaacaacaatgatagtaattgctcccaggtattgaaagcttgttgtaagactaacacatgctaatataatagtaaaaattattagcaatattactgatatgtatgttatgttctagtcgctgtgctgagcatttcatataactgggctttttctatcctcacagcatagcctttgagataggtatgtggaactattcccattttacagataagaatcctgaggcttagagagttcaagtgacctacccaagggcacatcactgataaagggcagaggtgggattcaaacccacatctgtcaggtgcaagtgcaaggctccttctcctcatgctcactgcctgctggggaatagggcactggggacataccccagggagcccttcctcatgttctgagtcccagttcatcccatgctgctattttgctctcccaggagcatctggactccctagacagagccccagcttctcacctgtccctctctaaatgctgctctgcaggcctgtgatcctggacccggcggaccctacaggaaacttgggtggtggagacccaaagggttggaggcagctggcacaagaggctgaggcctggctgaattacccatgctttaagaattgggatgggtccccagtgagctcctggattctgctggtgagacctcctgcttcctccctgccattcatccctgcccctctccatgaagcttgagacatatagctggagaccattctttccaaagaacttacctcttgccaaaggccatttatattcatatagtgacaggctgtgctccatattttacagtcattttggtcacaatcgagggtttctggaattttcacatcccttgtccagaattcattcccctaagagtaataataaataatctctaacaccatttattgactgtctgcttcgggctcaggttctgtcctaagccctttaatatgcactctctcattaaatagtcacaacaa

SEQ ID NO: 2649 - DNA, 12974 bp, Homo sapiens; identical to SEQ ID NO: 2647
  source 1..12974: mol_type = genomic DNA

SEQ ID NO: 2650 - DNA, 10337 bp, Homo sapiens
  source 1..10337: mol_type = genomic DNA
caagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccatagtgagtccagggctgaggttgggtctctgggaggcaggagattccacggcggcagcaaggccgagctactgggtgctgggtgcctattatgtgcgaggcccacacttgggtgggatgtggtgtaggagtctcaggctctggagcaggcgcttgctccagagctgtgtgacactgggcaggctacttaacctctctgtgcctcagtctctgactctgtaaaatggggagaggcataatacccacttcagagtatcgtaaggcttgagcacatcatgttcttagcaaaagactggcagtgctcagtgaattcactgtgattactcactgcgattttcttctatcctctccacagtacagaggagtaaacttagggaggctagagaactttgttcaaactacccaggttgccttgtggtttctccgcagcaagaaggagtggcttttatcagttagaaatatttggttttgtggacacaaatctcaggactgaggctgaaaattctggacctctggggaggaagggggactggggagatgccaggaccctagaattgggggcgtgggggtcctgatggcccaatactatcctcttagcctcctgagctgctgacgtcccttctctgctgctgccacactttttggtctctaccccttgcacacatccgctagtgcctcaataaagaaatctagacacgtggtgtccccagccctggcccaggccagcaagctaaggcaagtttggttaatagctattgtcagaactgggattttaagcctgggtaattggcttgagggcatgcatgtttaaccactacactatcctgcctctcaatttttttttcctcatggaagtaaaacagaaaaagtgcccagatcaaagtgtccagcttgataggtagccacaaacaatgtaactgtgtaacccccacccagatccagaaacaaaacattctcagccccccagagccctgggcccccgatccagtcagcacctccaaacccaggtaggcaatctcctgacttctaacagcatagacacgttttgcctgtttttaaacgttttacaattatagggtgaccaactatcccagttcatccaagattggggtgtttcctgggatgtgggactcttggtgtgaaagctgggaatgtaaaccaggatgcatgggtgaaccctacataaatggcatcatgggctctgtgtgctttagtgcgtggtttctctgacctatgatgtttatgaaatttatgttgtggggtacagttgtttatcttttcattgttgtgtcaattccattatgtgaatattccacatttgtccattctactgtgtttttttatttttacataattgtgcatatttatatggggtacatgtgatatttggacacatggatacaatgtgaaatgatcagggtagttaggatatccatcacctcaaacattgatcatttatttgtgttgagaacagttcagatcttctcttctaactattttgaaatatataataaattattgttaactatagtcaccccattgtgctatcaaacactagaatttatcccttctatctaactgtatgtttgtatccattaaccaacttctcttcatttcctcctctacttcccagcctctggtaactatgatcctactctctacctccatgagatcaactttttttaacttccacataaacacatgcaatattgtctttctatgcctgacttatttcatttaacataatgacctctagttccatgcacattgctgcaaatgacagaattccattctttttgtgtctgaatagtattctattgtgtatatatactacattgtctttatccattcagctgctgatggatacgttggttgattccatatcttggcttttgtgaatagtgctgcaataaacatgagggtgcagttatcccttttttggataaatacctagtagtgggattgctggattgaatggcagtgccatttttattttttttagaaacctccatactgttttccgtaatgactgtgctaatttacattcccaccaacagtgtgtaagattccctttactccaaatccttgctagcgtttattttttgtctttttgataatagctattctaactggggtgagatggtatctcattgtggttttgatttgcatttccctagtgattagtgatgtcaagcattttttcatatacccattggccattttgtatgtcttcttttgagaaatgtctatttaggccctttggctgctttttaatgggatgggttgttttctttgctgttgagttgttcacgttccttgtatattctggatattaaacccttgttggaaaaatagtttccaaatattttctcccattctacagcttgtcttttcactcttgattgttccctttgatgtgcagaagctttttcatttaatatagtcccaattgtctattttttgtttttgttgcctgtgcttttgaagtcttagccacaaaatacttgcatagaccaatatcatgaagcattactcttctgctttattctattaattttatcatttcaggccttatgtttaactctttaacccatttttagttaattttttataagatgacagacgggggcctagtttcattcttctacatatggatatccagttttcccaacaccatttattgaagagagtatcctttccctaatgtgtgttcatggtgctttctcaatcagttggctgtaaatttgtggatttgtttctgggttctcgattctgttcctttggtctatatgtctgtttttataccaatcccatgctgctttggttactatagctttgtagtatattttgaagtcacgtagcatgatgcctctagctttgttctttttcctcagtactatttggctatttgagatcttttgtgtttccatacaaattttaggattgttttttctatttctgtgaaaaaaaatgtcactggtatttataaggattgcattgattctgtagattgctttgggtagtatggttattttaacaatattaattcttccaatccatgagcatgggatgtctttccatttgcttgtgtcaccttcagtttcttttatcagtgttttgtagttttcactgtagagatctttcacttccttagttaaatgcattcctaggtatttttgttaaatactataagattgctttcttgatttctttttcagctagttcattactgatgtgtagaatatgttggtattttggtatgttggtatggtatgttgattttggtattttgattttgtatcctgcaactttaccaaatttatcagttctaagaggttttcttggtggagtctttaggtttttctgtatagaagatcatatggtctgcaaagaggggcaatttgactttttcttttcctatttggatgccttttatttctttatcttttgggattgctttggctaggacttccaggatacaggctgaaagcctttcccaattcagtatgatgttaactgtgggtttgtcatatatggactttattatgttgaggtatgttccttacatgcctaatttgttgagggtttttagcataaagggatgttgaattttaccaaatgttcttctacatctaccaggataatcatatgatttgtccttcattatgttgatgtgatgtgcaaatgttcaacatttgttgacttgctcatgttgaaccatccttgcatccctgggataaatcccacttgatcatgtgttatcttttcgaagtattattggatttggtttgctagcattttgttgaaggtatttgtatctatgttcatcagggatattggcctgtagttttcttttttgttgtgtctttggtctagttttggtatcagggtaatgctgacttcatagaagtggttaggagtaattccctcctcttcaatttttttggaatagtttgagaagaattggtgttaattcttctttataagtttggtagagttcagcagtaaagccatctagtcctgggctattctttgttgaggagttttttattactgattcaatctactcactcactattggtctgttcaggttttctgtttcttcctggatcaatcttagtaggttgtatgtgttcaggaatttatccatctcctctaggctttccaatttgttcacatgtagttgttcatcatagtctctaatgaccccttttatttctgtggtatcaatggtaatgtctccttttttatccctgattttattttacttgggtcttctctttttttagtctatttagtctaagtagcggttcatccattttgtttatctttttaagaaaccaactttttattttgttaatttttagcctctattatgtttagttctgttctgatttttattatttctttccttctactaattttaggtttggtttattcttgcttttttgtttgtttttgagatggatttttgcttttgttgcccaagctggagtgcaatgacgtgatctcagctcactgcaacctctgccccctgggttcaagtgattctcctgcctcagcctcctgagtagttgggatcacaggcatgcaccaccacgcccggctaattttgtatttttagtagagacggggtttcaccatgttggtcaggctggtctcaaactcctgacctcaggtgatccacccgcctcagcctcccaaagtactggaatttcaggtgtgagccactatgcctggcttttcttgcttttctaattccttaagatgaaccgttaggttgtttatttgaaattgttctactttttttgatgtaagcatgtattgcttcaaactttgctgtatcccttaggttttggtatgttgtgtttccattttcatttgtttccagaaattttttgatttccttttaaatttcttcatcagcccagtggttgtccaggagcgtgttgtttaattttcacgtatttgtacaatttccaaagttcctcttgttccattgtggtctgtatccattgtggtaagtatccattaagatacctgacagtatttcaatttttaaaaatttgttgagccttgttttgtgacctaccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccagtatttctttgctgattttctgtctacgtgatctgcccaataccaaaagtgagatgaagttcccagctattactgtattggcagtctctcggtctctgtttagctctaatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactctgtctgatataagtatagctactcctgcacacttttggtttccatttgtgtggaatattttttccattccttcacattcagtctatatgtatcttcacagatgcagtgagtttattggaggcagcatatagttggaccttattttttatccattcagcttgtctgtatcttttaactagagaatttaaaccgttgttaaattcagggttgttattgataggtaacaacttactcctgtcattttgttatttgttttgattgttttgtacattctttgttcttttctttctctttattgcctacctttccaattgttgggggttttgtaatgataacatttgactcctttctctttgtcatttgtgtatctgctctaccagtgagttttatacttttgtgtgttttcatgatggtagacatcatccctttgcttccagatgtaacactctcttaagcattttctgtagaactagtctagtggtgatgaattccctctgtttttgcttgtctgggaaagactttgtttctccttcatttttgaaggatagctttgctgggtatcgtattcttgtctgaaagggtttttttttagcactttgagcatatcatcctattctcttctgacctgtaagttttctgctcagaaatctgctattagtctgaggagaattcccttatatgtgactttatacttttgtcttgctattttcagaattatatgtttgtctttgacttttgacagtttgactataatatgcctgcagaagacattttggggttgaatctatttgagaatctttgagcttcctgtatctgggtgtctaaatctcttgtaagacatgggacgttttcagctattacttcattaaatagattttctatgcctttgcccatctcttctcctagatctttccaaatttaaatatttggttactttatgattaccaatatggcacataggctttcttcactcatttttatttatttttctctccttttgtctggctggattatttcaaaagaactgtcttcaagtttagaaattctttcttctccttgacctagtctattgttaaagcagtgagttgtatttttattttattcattgatttcttcagtttcaggaattctctttggttctttttagcaatatctatctctttgttgagtttctcattcagagcataaattattttcctgatttatttgtattgtttatctgtgttttcttgtatcttactgaatttctttaatatcatggttttgaatttttcttaaccattgcacagatatcattttctttgggatctgtactaaagaattattgtgctcctttggaagtgccatgtttcccttgctttttcatgtttctgtgtccttacattgatatcagcacagctaatgtaacagtcacttctccaattttatttattgactttcatagggaaagacattttcctctgctgggcatgatggctcatgcctataatcccagtgactcaggaggctgaggtgggaagattgcttctggcaggagtttgaggttacagtgagatatgattgtgccactatgctccagcctaggtgacagagcaagaccctgtctctaaaaaattaaataaaaataaaataaaaaagatgttttcctgtagatgtgtctatagtgttggttgagtggagcgctttggctttgattctgtgtgggcacagttagtggagcctccacatgatttcattagcatcagtgttgtctgtgagctcctcagtggctgacagtgtagttgttaatggagtctgtggaaaggctgtgctgggaacagggacatcaggcaggttggtcttcaagcaccagtggtgacagcagtatgccaggcatgctggtcctcaggcccccaggcagtgtatgtgggtgtcaatgctggtgtgtccaggtgggcagggtatcagacttcaagatgacatgttcgggtgccagtggtagcagcagtggactgaacaggcaggtccttgggcccccaggtggcttgtttggaagcggcagcagcaggccaaccctcaggccctcaagtggtgtacacaggcatcagtgatggcaagctgggtaggctggtccccaggcccttgggagacacatgtggtcactagtggcaggcagagtgggcccatccttaggcctctggatggtgtgtgcctgtgctgctggtggtaaagaggacgggttaatctcctggcccctgggcagcacatgtggatgctggtggcaggtggggcgagcctgtcttcaggttccctaatggtgtgtgcaggtgctggccgcaggtgggacagttttacccccattcccccagatgcgcacaggcaccagcaacaatggcaggtgaggcgatcctatcctcaggccctgggacagtaagcacaggtgctggtggcaggtggggcagttcaatccgtttctattgccagcggccatttgagtcacctccaggttggggctagtatgaaaagtgttactatgagcatcccaatcaggtctttgtggggcaaatggatgcctgccactcaatgttaagaccatttttggcttttacttgagttgagaaataccactgcctgctagagatccctgtaaccccagaatctagtgtctcatatctgcttctttgtcactggcagggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagcgggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcatgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccctaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccata

SEQ ID NO: 2651 - DNA, 32230 bp, Homo sapiens
  source 1..32230: mol_type = genomic DNA
caagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccatagtgagtccagggctgaggttgggtctctgggaggcaggagattccacggcggcagcaaggccgagctactgggtgctgggtgcctattatgtgcgaggcccacacttgggtgggatgtggtgtaggagtctcaggctctggagcaggcgcttgctccagagctgtgtgacactgggcaggctacttaacctctctgtgcctcagtctctgactctgtaaaatggggagaggcataatacccacttcagagtatcgtaaggcttgagcacatcatgttcttagcaaaagactggcagtgctcagtgaattcactgtgattactcactgcgattttcttctatcctctccacagtacagaggagtaaacttagggaggctagagaactttgttcaaactacccaggttgccttgtggtttctccgcagcaagaaggagtggcttttatcagttagaaatatttggttttgtggacacaaatctcaggactgaggctgaaaattctggacctctggggaggaagggggactggggagatgccaggaccctagaattgggggcgtgggggtcctgatggcccaatactatcctcttagcctcctgagctgctgacgtcccttctctgctgctgccacactttttggtctctaccccttgcacacatccgctagtgcctcaataaagaaatctagacacgtggtgtccccagccctggcccaggccagcaagctaaggcaagtttggttaatagctattgtcagaactgggattttaagcctgggtaattggcttgagggcatgcatgtttaaccactacactatcctgcctctcaatttttttttcctcatggaagtaaaacagaaaaagtgcccagatcaaagtgtccagcttgataggtagccacaaacaatgtaactgtgtaacccccacccagatccagaaacaaaacattctcagccccccagagccctgggcccccgatccagtcagcacctccaaacccaggtaggcaatctcctgacttctaacagcatagacacgttttgcctgtttttaaacgttttacaattatagggtgaccaactatcccagttcatccaagattggggtgtttcctgggatgtgggactcttggtgtgaaagctgggaatgtaaaccaggatgcatgggtgaaccctacataaatggcatcatgggctctgtgtgctttagtgcgtggtttctctgacctatgatgtttatgaaatttatgttgtggggtacagttgtttatcttttcattgttgtgtcaattccattatgtgaatattccacatttgtccattctactgtgtttttttatttttacataattgtgcatatttatatggggtacatgtgatatttggacacatggatacaatgtgaaatgatcagggtagttaggatatccatcacctcaaacattgatcatttatttgtgttgagaacagttcagatcttctcttctaactattttgaaatatataataaattattgttaactatagtcaccccattgtgctatcaaacactagaatttatcccttctatctaactgtatgtttgtatccattaaccaacttctcttcatttcctcctctacttcccagcctctggtaactatgatcctactctctacctccatgagatcaactttttttaacttccacataaacacatgcaatattgtctttctatgcctgacttatttcatttaacataatgacctctagttccatgcacattgctgcaaatgacagaattccattctttttgtgtctgaatagtattctattgtgtatatatactacattgtctttatccattcagctgctgatggatacgttggttgattccatatcttggcttttgtgaatagtgctgcaataaacatgagggtgcagttatcccttttttggataaatacctagtagtgggattgctggattgaatggcagtgccatttttattttttttagaaacctccatactgttttccgtaatgactgtgctaatttacattcccaccaacagtgtgtaagattccctttactccaaatccttgctagcgtttattttttgtctttttgataatagctattctaactggggtgagatggtatctcattgtggttttgatttgcatttccctagtgattagtgatgtcaagcattttttcatatacccattggccattttgtatgtcttcttttgagaaatgtctatttaggccctttggctgctttttaatgggatgggttgttttctttgctgttgagttgttcacgttccttgtatattctggatattaaacccttgttggaaaaatagtttccaaatattttctcccattctacagcttgtcttttcactcttgattgttccctttgatgtgcagaagctttttcatttaatatagtcccaattgtctattttttgtttttgttgcctgtgcttttgaagtcttagccacaaaatacttgcatagaccaatatcatgaagcattactcttctgctttattctattaattttatcatttcaggccttatgtttaactctttaacccatttttagttaattttttataagatgacagacgggggcctagtttcattcttctacatatggatatccagttttcccaacaccatttattgaagagagtatcctttccctaatgtgtgttcatggtgctttctcaatcagttggctgtaaatttgtggatttgtttctgggttctcgattctgttcctttggtctatatgtctgtttttataccaatcccatgctgctttggttactatagctttgtagtatattttgaagtcacgtagcatgatgcctctagctttgttctttttcctcagtactatttggctatttgagatcttttgtgtttccatacaaattttaggattgttttttctatttctgtgaaaaaaaatgtcactggtatttataaggattgcattgattctgtagattgctttgggtagtatggttattttaacaatattaattcttccaatccatgagcatgggatgtctttccatttgcttgtgtcaccttcagtttcttttatcagtgttttgtagttttcactgtagagatctttcacttccttagttaaatgcattcctaggtatttttgttaaatactataagattgctttcttgatttctttttcagctagttcattactgatgtgtagaatatgttggtattttggtatgttggtatggtatgttgattttggtattttgattttgtatcctgcaactttaccaaatttatcagttctaagaggttttcttggtggagtctttaggtttttctgtatagaagatcatatggtctgcaaagaggggcaatttgactttttcttttcctatttggatgccttttatttctttatcttttgggattgctttggctaggacttccaggatacaggctgaaagcctttcccaattcagtatgatgttaactgtgggtttgtcatatatggactttattatgttgaggtatgttccttacatgcctaatttgttgagggtttttagcataaagggatgttgaattttaccaaatgttcttctacatctaccaggataatcatatgatttgtccttcattatgttgatgtgatgtgcaaatgttcaacatttgttgacttgctcatgttgaaccatccttgcatccctgggataaatcccacttgatcatgtgttatcttttcgaagtattattggatttggtttgctagcattttgttgaaggtatttgtatctatgttcatcagggatattggcctgtagttttcttttttgttgtgtctttggtctagttttggtatcagggtaatgctgacttcatagaagtggttaggagtaattccctcctcttcaatttttttggaatagtttgagaagaattggtgttaattcttctttataagtttggtagagttcagcagtaaagccatctagtcctgggctattctttgttgaggagttttttattactgattcaatctactcactcactattggtctgttcaggttttctgtttcttcctggatcaatcttagtaggttgtatgtgttcaggaatttatccatctcctctaggctttccaatttgttcacatgtagttgttcatcatagtctctaatgaccccttttatttctgtggtatcaatggtaatgtctccttttttatccctgattttattttacttgggtcttctctttttttagtctatttagtctaagtagcggttcatccattttgtttatctttttaagaaaccaactttttattttgttaatttttagcctctattatgtttagttctgttctgatttttattatttctttccttctactaattttaggtttggtttattcttgcttttttgtttgtttttgagatggatttttgcttttgttgcccaagctggagtgcaatgacgtgatctcagctcactgcaacctctgccccctgggttcaagtgattctcctgcctcagcctcctgagtagttgggatcacaggcatgcaccaccacgcccggctaattttgtatttttagtagagacggggtttcaccatgttggtcaggctggtctcaaactcctgacctcaggtgatccacccgcctcagcctcccaaagtactggaatttcaggtgtgagccactatgcctggcttttcttgcttttctaattccttaagatgaaccgttaggttgtttatttgaaattgttctactttttttgatgtaagcatgtattgcttcaaactttgctgtatcccttaggttttggtatgttgtgtttccattttcatttgtttccagaaattttttgatttccttttaaatttcttcatcagcccagtggttgtccaggagcgtgttgtttaattttcacgtatttgtacaatttccaaagttcctcttgttccattgtggtctgtatccattgtggtaagtatccattaagatacctgacagtatttcaatttttaaaaatttgttgagccttgttttgtgacctaccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccagtatttctttgctgattttctgtctacgtgatctgcccaataccaaaagtgagatgaagttcccagctattactgtattggcagtctctcggtctctgtttagctctaatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactctgtctgatataagtatagctactcctgcacacttttggtttccatttgtgtggaatattttttccattccttcacattcagtctatatgtatcttcacagatgcagtgagtttattggaggcagcatatagttggaccttattttttatccattcagcttgtctgtatcttttaactagagaatttaaaccgttgttaaattcagggttgttattgataggtaacaacttactcctgtcattttgttatttgttttgattgttttgtacattctttgttcttttctttctctttattgcctacctttccaattgttgggggttttgtaatgataacatttgactcctttctctttgtcatttgtgtatctgctctaccagtgagttttatacttttgtgtgttttcatgatggtagacatcatccctttgcttccagatgtaacactctcttaagcattttctgtagaactagtctagtggtgatgaattccctctgtttttgcttgtctgggaaagactttgtttctccttcatttttgaaggatagctttgctgggtatcgtattcttgtctgaaagggtttttttttagcactttgagcatatcatcctattctcttctgacctgtaagttttctgctcagaaatctgctattagtctgaggagaattcccttatatgtgactttatacttttgtcttgctattttcagaattatatgtttgtctttgacttttgacagtttgactataatatgcctgcagaagacattttggggttgaatctatttgagaatctttgagcttcctgtatctgggtgtctaaatctcttgtaagacatgggacgttttcagctattacttcattaaatagattttctatgcctttgcccatctcttctcctagatctttccaaatttaaatatttggttactttatgattaccaatatggcacataggctttcttcactcatttttatttatttttctctccttttgtctggctggattatttcaaaagaactgtcttcaagtttagaaattctttcttctccttgacctagtctattgttaaagcagtgagttgtatttttattttattcattgatttcttcagtttcaggaattctctttggttctttttagcaatatctatctctttgttgagtttctcattcagagcataaattattttcctgatttatttgtattgtttatctgtgttttcttgtatcttactgaatttctttaatatcatggttttgaatttttcttaaccattgcacagatatcattttctttgggatctgtactaaagaattattgtgctcctttggaagtgccatgtttcccttgctttttcatgtttctgtgtccttacattgatatcagcacagctaatgtaacagtcacttctccaattttatttattgactttcatagggaaagacattttcctctgctgggcatgatggctcatgcctataatcccagtgactcaggaggctgaggtgggaagattgcttctggcaggagtttgaggttacagtgagatatgattgtgccactatgctccagcctaggtgacagagcaagaccctgtctctaaaaaattaaataaaaataaaataaaaaagatgttttcctgtagatgtgtctatagtgttggttgagtggagcgctttggctttgattctgtgtgggcacagttagtggagcctccacatgatttcattagcatcagtgttgtctgtgagctcctcagtggctgacagtgtagttgttaatggagtctgtggaaaggctgtgctgggaacagggacatcaggcaggttggtcttcaagcaccagtggtgacagcagtatgccaggcatgctggtcctcaggcccccaggcagtgtatgtgggtgtcaatgctggtgtgtccaggtgggcagggtatcagacttcaagatgacatgttcgggtgccagtggtagcagcagtggactgaacaggcaggtccttgggcccccaggtggcttgtttggaagcggcagcagcaggccaaccctcaggccctcaagtggtgtacacaggcatcagtgatggcaagctgggtaggctggtccccaggcccttgggagacacatgtggtcactagtggcaggcagagtgggcccatccttaggcctctggatggtgtgtgcctgtgctgctggtggtaaagaggacgggttaatctcctggcccctgggcagcacatgtggatgctggtggcaggtggggcgagcctgtcttcaggttccctaatggtgtgtgcaggtgctggccgcaggtgggacagttttacccccattcccccagatgcgcacaggcaccagcaacaatggcaggtgaggcgatcctatcctcaggccctgggacagtaagcacaggtgctggtggcaggtggggcagttcaatccgtttctattgccagcggccatttgagtcacctccaggttggggctagtatgaaaagtgttactatgagcatcccaatcaggtctttgtggggcaaatggatgcctgccactcaatgttaagaccatttttggcttttacttgagttgagaaataccactgcctgctagagatccctgtaaccccagaatctagtgtctcatatctgcttctttgtcactggcagggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagcgggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcatgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccctaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccatactctgtacctgccttgaattctttcctgcatgagatccaagaaccctctcttgggatctgaatcaggaccctcttttccagcaacgctatcacctgtaaaccaaaagtatctgagacaggtctcaatctatttagaaagtatatttgccaaggtgaaggatgtacccatgacacagcctcaggaagttctgatgacatgtacccaaagtgctcagggtacagcttggttgtatacgtggtatggtttggctgtgtccccaccaaatctcatcttgaattgtagctcccacaatttccacatgtcatgggagggacccagtgggaggtaattgaatcatggaggcaggtatttcccatgctgttctcatgataatgaataaatctcacgagatctgatggtgtcataaaggggagttcccctgcacaagctctctctggcctcccaccatgtaacatgtcccttgctcttccaccatgattgtgaggcctccccaaccatgtggaactgtgagtcaatcaaacctctttcctttataaactactcagtctcaggtatgtctttattaacagcatgagaacagactaatacaatacattttagggagacatgagacatcaatcaatgcaggtaagatgtacattggtttggtttggaaaggcaggacaactcaaagtgggggcttccaggtcattggtagatttaaagattttctgattggcaattgatggaaagagttatcatcaatagaagggaatgtctgggttatgatgataaagggttgtggagaccaaagttttatcatgcagctgaaaactccaggtagcagacttcagagagaatagattgtaaatgtttcttatcagacaagagcctgttctatcactaattccaaaagagagggaggtatcatgaggcatgtccagctcctccttcccatcatggcctgaactggtttttcaggtcaactttggaatgcctttgctgagaggagaggtccattcagatgactgggggtgcttagaattttgtttttggtttatatacctaagccaggattgtatctccagctcccccacctcctcactcacagcccatcactaagtcctgccagttctgcctaacttgctcctaaatctgcatcatttctctcccttcccactgctacttccctagtcaacgtcaccaccagggatggggcaatggcttcctaattgtctccctgcctcctgtctcactccaccctgcagctggtgctctctttccatgcacaaatattgtgtcacacactctgcctctaatggcttttcactgcatttaggaagttgaccaaaaaggccaaactctgtaaaatattttaagaggttttttctgagccaaatatgaggaccatgacctgtgacacaatctcagtagttcctgagaacgtgtgccccaggtgattaggttacagcttgatttgtatacattttagggggacagaatttacaggcagaaacgtaaatcagtacacataagatgtgcattgattcagcctggaaaggcaaaatgtctcaaagcagggtcttccaggtcatagatggttataaagatttcctgattagcagttagttgaaggagttcagcttaagaaaaggggagttgtggaagacaaggttcttattatgtagatgaagcctccaggtagcaggcttcaaggagaataggtggtaaatgtcccttatcagaccttaaagatgtcagacgattagttaaaatctctcctgaatcaggaaaagatctggaaggggaaggggattctccacagaatgtgaatttttccacaggacacagctttgcagggccattccaatatatgtcaaagaaatatattttggggtaaaatacttttgatttcctttagggcctgttatctgtcaggtgatgccagagttaggctggaatttggtgtcatactgctacaaagagtctgttctgtcagtcttggggtctctattttaatgttagtgtttgtcgattgtgcctgaattccaaagggaggagggtataatgaggtgtctgagctcccccttcccatcatgacctgagctagtttttcaggtttctttgggggttccccttggccaagagaggggttcattcagtaggttgggaaggcttagaattttatttttggtttacaaggataaggatcaaactcctcagcaggacaggactttgatgatctggcagcccctacttacttacctctccagctgtaccactcaccaccaactaactctctatgcttcagccactctggccttccctgagctcctcaaacccacatgatgctagctcaacttgagactttggcctatactgttcctttgcctggaatatacttcccccagccttttatttttggataactccaactcatcctttaagtcctctggctctctatgtctgggttagatccactttccacatgctccagtagcaatttgtgctgtctgaatcatgggatttatcactttgcaaaccccaactatctgagacaggtctcagttagtttagaaagtttattttgccaaggttgaggatgcgcacccgtaacacagcctcaggaagtcctgatgacatgtgcccaaggcgctcagagcacagtttgcttttgtacgttttagggagacctgagacatcaatcaacatatgtaaggtgaacaatggttcactccggaaaggcgggacaactcgaagcaaagtgggacaattcaaagtggggagagggcttccagatcataggtagataagagaccaatggttgcattcctctgagtttctgattaacctcttccaaaggaggcaatcaaatacacatttatctcagcagagggatgactttgaatagaatgggaggcaggtttgtcctgagaagttcccagcttgacttttccctttaaccgagtgattttggggccccaagatttattttcctttcacaacttatatggaaataatgtatttagctttctcctctcctagactataagctccatgaggacaggtatcatgagtatcttgttcttctatggtctctagtacaatgttcattattaataatagttgttggttggatggatggatggagcatgatggataaatggatggaaggtaaatggatggaaaaatgaatgtagatggatggatggatagatagatattaaatatatgtatatatttatggatgaggtagatagatggatagtctcaagcacaaagtctcaagtacaggtgcacatataatcacaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaaaaaaaaagaaagaaagaaaagaaaaggggaggggaggggaagagaggggaggggaagggaaaattcccaagctgaaacttaagccatcattaaacaaatggggaaacagaaaagcccaggtcttctaagcccatggccagagtaccttccatcacctatagttttaaggaatttctgggttaccaggaaccatgaagaacaattagcccaggcatcactgataaggaggagacatacagacatcctgataactcacattcacagaaaggtggcctggcttggggaaacatgtaccagtttgggaggttggcagttctgagttcttatcctggtcctactactcacttatgcctgccagctgtacagtcagactagaaactagattccagggccattaggatgctcagggttgggggtgggggcctgcttcaaacaagggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggtaaagctgcacattccaaattattataagctcctttttctgcaaggaaacacagggtcactttctgagaaaagcaacctacaggggaattggtaacttgcttttcgttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatctgtaaattagtaattgcaattgcacttgccagctaagagttttgtgaggcttgtatgtttcactgtacataaaaggcttagagtaaacacaccataaacgttagctatttattatcattatgggggaagatagaatgctctttccgtcaacctccctgcatgccaagtgcccagaaccatgcctagggagtcagtaaatatccactggggtgtatgaaaggaacaagctagctgctttctcctggtttcttatctaaatgtgtttatgggccagggagctggctcacgtctgtaattccaacactttggaaggccaaggtgggaggatcacttgaggccaggagttcaagaccagcctgggcaacaggcttttttttttctccaaaaaaaaagccaaacatggtggcacacgcctgtggtcccaggtactcagaaggctgaggcaggaggatcacttgagccttgaaatatatttgagggtacagtgagctatgattgtgccattgcagtccagcctgagcgacagagaagactctgtctctaaaagtaagaataatgatgaaacaaactcagtagtcctatagaccattttttgtttgtttttgtttctatttgtttggttgtttttttgtgggggggggagggttgttttgttttttaatgaacatagaaattgacccttctgatcttaaagcttgaaacttacatttgttttatctaagttccttcctcagaaaaggaacctcagacctctcaaaaagtatcaaagaactgaaactcaccagtcactgcatccagacaatgggatgtcaaatcccttattcctcatgattacctccttacccctccctaattcccgttttcccacacatagttacatttcttccctgctatatagaaccctaactttagtctgtcagggagaaggatttgagactgatctcccatctcctcagctgcagcacctgattaaagccttcttcttggcaacacttgtttccgccattggctttctatgtggtgagcagcaggacctagactgaacccctggtgtttcagtaacagtaatcaatcaataaatgtgtttattttatttttatttttattttgagacaaagtctcactctgtcacccaggctggagtgcagtggtgcaattatggcccagtgcaacatccacctctcggggtcaaggagttcgcatgccttagcctcctgagtagctgggattacaggcacctgccaccacgcccagctaatttttgtatttttagtacagacggggtttcatcatgttggccaggctggtctcaaactcctggcctcaggtgatccgcctgcctcagactcccaaagtgctgggattacaggcatgagccaccgtgcctggctaaataaatgtgtttataaacagtggaactcagctagcaagaatggaaacccattgattaaaccagcccctgtccccagacctccagggccctgctgccaccttgcctgcctcctcaaagtccctgtaccctgacattctgaagtaaaatattcacaggatggactcaatgacagaatatattgcatgtaaaatataaactttcctttcttccagatgtatgctaactatgccaacacaaacaattttttaaagaacccacttgctccctactaatttggataattccctttctcgtttataattccatctcttgtccctccattaggttctgctgatcttgtcttgggttaacaccatactgttttcattacagtcagtttagactacactttattatctaatgggccaagtcacccttccctactatgttttatgtaaaggtacctgtcctctgaccgattaagcaagagtcgtgtgctatcaaactataactgaccttcattgtagagcaaccctggctctctaaaaccaggttacataaataacaacgttccaatttctgtttcacatcaggcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacaggtaattttccaactgtctatatatggttatcattcatttcctttttatcgagataattgacatccagtaaagtgcaacaatcttaggtatacagctcaacgcattttttacaatcttaccagcaacacccaaatcaacatagggaacgtttcgtgtaccccagaaggtgcctcaagcccattgtccccctagtaatcctcccaaacaaacccctattctaacatctattaccaccgcagattagttttgcttgattttaaacaaacaatgtaagtgggattatatggtacatacttcatgtctgccttctttggctcaacgggatgtctgagagactcattcatatggttgcagggtcttgctctgctgcccaggctggagtgcagtggtgggatcttggctcactgcaacctgtctcctgggctcaagcaatcctcccatctcagcctcccaagtagctggaactacaggagtgtgccaccatacctggctaatttttgtattttttgtagagatgaggtttcaccatgttgcccaggctggtcttgaactcctgggctcaagctatgtgcccacctcagcctcccaaagtgttgggattacagacatgagccatggcacccagccatagtagcactttttttcattgttttcccatattcaattgtattaatgtaacacacatttatccattctgctgctttgggtcattttcaaattggggcaattttcaaatagatgattgggtcattttcaaattggggcaattatgaattaggttactatgggtatttccctacatgtctttttgtgaatgtaagcattcatttctcttggataaatatgtagcagtagaattgctgggctatccagtgcacatatatgaatgttgtgtacatatatgcgtgtaaatatataaaatatatatgtagtttgtttttttgtttaaccatagcaaatcttgccgaatcatttccaaaatcttaccaaattatactcccatcagcaagatgtgagtttcaggcatattctcaaacccaactggggatctgcccacccagcgcagcaaagccaaacagactttgggattgcagtgagagagtgaagcatttattgcagggagccaagcagggagaattgggcagctcatgtttaagagccgaactccccgatggcttacaggtaagggttttaaaggtgaggggacagaggttacaggcaaagccataaatcaacacatggaggctgtacattggtttgacctaaaaaggtgggacgtctccaagcaggagggaggaggaggatgggtggcgctggtcacaggattcaaagactttccaatttgtgatgggtgaaatgggcgaagctttatctaaaaatttcagatcagcagaagggaacgttagctctggctcgtaggtgtgacctcctccaaaaccctcaggaagaaatttagaacaaagaacgaggtcagggttcaatcctcagtttcccctcatctgaggtctacctgccagtggatttgcttggtgggggcctgagtttctgaaaatcaactcagggacatatgctaagatgttatctttagtttctatagggaacaaaacatcttttgactctaacttccttggctactgttttaagtgactattaccttcttttttgttgtttttgttttattgggttttttttcactgctcctgtagaccctgaactactgtatttttgcttatcgagttgctcattgacttttcaaggctagtaaggtgcctggaatttccctcgaaagaactccagattttcctttattttcatgcttgtgggatgggagcagtgggtggcctgcagacacctaagagaggtccctgctccatcccagttgttccacatctttgtcaagacttggtattgtcagtccactgaactgtaggcattctagcaaaggacaatgacttcctgtagacctctggtttcttgatttcagatccctgacatggtaagaactagatcccccaatgagctgctaccctttccttatcccacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggtgccaagcttctcacaccctatccctgtacctcatcatccgcatgccaggcatacctctttggaatgagatctcagccttgccctatcaagccagtgctggaccagaagaatggcagccaccatgggtggggaggcagatgggtctgtctgaaagaggggaggtccagccagtgcttttcacattccaaaccatagtcacattttgtcccctaaacaaacactggagagacacttccccttatagaaggaaggagctaagagagaaaggggatggggggcaggaagaggagaccactttgttattttattaatagaatgtctctgtaaagcagcaaacccagggccagaggggcttgatgtcgtagacaaaatccctcagcagcttggaggagctgcaggaatccaaattcaagttgccggattcccactccaggcctctttccccaaaacagattttgcctcccacaagcagctcaactgactttttttaatctaatggaatacacaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctggtaagagggttttccaaatacagggtgtttcatgctgcaggaaggtcttcctgacacccaggctaggtcttatctgagagtactctatattcgtttcctgtattgctgttacaaagttccacaacacagatggcttaaagccacagaaatttattctcttaccattctggctattacaagttcaaaatcagggtgttggcagagccaagctctctgcaggccctagggaagaattattccaggcttcctgcagcttctggtggttgccagcagtccttggcttgtggctgcatcactccagcctctgtccctgaggtcacatgcccttctccctacatgtcttcacatcaccttccctctgtgcatgtctgtcttatcatctcctcttcttctaagaacaacagtcatactgaattagggcccaacataatgacctaatcttcactagatcccatttgaaaagacactatttccaagtaacacacattcatcgatactgtaggttggaaccccagcatcttttagggagacacagttcaacccatcacacaccatcagggcaatgactgtgaagtgcaaaatggaacaaagagaaaggggggtacccaaagatgcgagatctcaattaatttttgcaagagagaaagctggtgagcaggtggagacatgaaacggagcattgctcagagaagggggtggcagtcaggcctgtggatgccaggacaggctctgagctccgttcaggcaggtgccgggggcaacagtcagaagtgcggccgaaacaagagaaccaattaaggcaccagctgtgaaacaggtgcactggccttccccctcccatccccaaaaggagaagtaaatctgtcaacacaaactcccctgcatgctcagtgcttattagagaaaagccatccaagaagaaccttcccaggttagaccactgagccctctcagctttcctgggaaccgcactggagacaactgtattaattgaggccaaagaggccaatcaaattccacagttcacagacagattaatttatattcaagttatgggaggcggaatctataccccgtttgcacagaagtttgaaggctaactgagtaccaatctggcatgtaaatgaagatgtaaatgagtttagcaaacttcacagaggttggggagtctatgaatggggaacttccctaactggacccagaaggatcaggacgctctgagcagtcacccctgtgcccaccctaacccctactttcactggacccctggtctttgctctctgaccccaattttcccggcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttacagttgtttttaatctttttttaagagatggggctataactcgctacattggccaggctggtctcaaactcctgggctcaagtgatcctcccacctggcctcccaaagctctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatattattgtcccaatacagcccattgggatgatttcgacagtcattccaagaagggcctttataggacattcttttccaacccagaagcacatgtggcatttagttccaaacatctcctaaaccatcttttgatactcactgtggctgtttttgttctgctatcccatcaacttctattttgagaactgtgagaccatccctgtctctgcagttgttgaagaaaatttaggcccaggaaccactgcataaggcggtccaaacattgggggctcatgcacacatacacacacacacacacacgtacatgcatacacaaacatgcacacacacactcacacatgcacacacatgtactcacaccatgcacacacgcacacacgcacacacatacatgcatacacacatgcatacatgcactcacacacatgcacacacgtactcacaccatgcacacacatgcactcacacacatgcacacatgcactcatgcacacacatgcatgcacaccatgcacacacatgcactcacacacatgcacacacatgcactcataccacgcacacatatgcactcacacaccacaaatattctgccctgtggaaggggcagtgttggcaatgaatattccttcaataggcaccgtcctcagcaactataaggccaacttacaacatctgagaacaaccaaggttggccttcaactttcaagctgagtgcccttccccacctccaggtgagctagcccatcttgtctgtgttgccagcaaaagtacaatatttgtatagaacagtaattacttgcctcttactgctgttttaaaaaaatgccctaaacttagtggcttaaaacacatgaatttgagccaggcacagtggctcacacctgtaatcccaacactttgggaggctgaggcgggaggatcacttgagaacaggagtttgagaccagcctgagcaacataacaataccccgtctctacaaaaataaataaataaattagctgtagtcccagctagttgggaggctgaggcaggacgatcacttgagcaagggagatcaaggttgcagtgagccatgattgtgccactgcattcagcctgggtgacagaacaagaccctgtctcaaaattacttttgcaccaaccaaaaaatatatatatacatatatatacacacacacatatacacatatatatacacatatatacatatatacacatatatgcacatatatatacacatatatacatatatacacatatatacatatatacacatatatacacatatatatacacatctatacacatatatatatacacatatatatatatacatatatatgcttcctcaccttttcaagctccttgaggttgtccaaatttcttggctcatggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcacgcctgtaattacagcactttgagaggctgaggtgggaggattgcttaagaccaagagtttgagaccagcctggggaacctagtgagactcccatctctacaaaaaaaaaaaaaaaaaaaaaaaaagctaggcgtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggttggaaggctacctgttgggttctatgctcactacctaggtgatgggatcattcatacaccaagcctcagcgacatgcaatttacccatgtaaaaccccacacatgtacctccttgaacctaaagtaaaagtggagaaaaatgtattaattaattcaattaaaaattaaaattaagaggaaaaagacccctgtgataacatcaggccaaaccaggtaatgcagaataatcctcccatctctagagacttaaccacgtgtgcttcagagggagcacagctgtgccaaaacctggactttgaactgttggcctccagaactgggagagaataaacttctgttgttttaagccacctagttgtggtcacttgttatggcagcctttggaaaccaacacacccgcacatggcgtgtttaacgcaggctgatacaaccttaagaaaggaatggatgtggtcatcagcaatctccaatacctacagcaaatgggaagacagggaaggaccagaggtgtaggtaaagcaaaaagccacaggtcattaggaagtgatgctccaactgggcatggaaaaggagtttggagttaggaacacgacagatctgtctggacaaggatccagatctctcctagggggaaggaggggcaactaggacagtttttgtgtctgtggggggtcttgtgtgccactccaaactctcaggtgtgttcttgggatgtatttgtgcaatgacaaaagacggaaaagatgccagcccacgagcaggagggcagttgggagaggcagggtagggggcccagtacaggcaggaaaagaagccttgggtgggcttacaggtgccactcacacttggggtcttccttccttccccagcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccgggtgagcactggcctttctcatgtcttgttggaatgatgtaatattgggcattcctggaagggaggtaagtgggcattgtagctctccaggatccatctaccttcagaaacttgaggaagggaagccaggagttaagggaactaggacactagttttcaggggggttgtggatagactgcctaggtcattaacaacacaactttgattctgtattgtttttcttggagctgttggccgtccttggggctcttgggcctggagacacatcactcccgtctctgcctctgtcatcaccttttcttctgtgtcctcccccttctcttcttttctaagaacacttgtcataggatttagggcccagcctgatccagaatgatctcatctccaggtccttaactcagttacatctgcgaagaccctttttccaaataagggcacatccacaggcccccagagcatgtatttttaggggtccaccattgaacccactgcagattctaaggagcttagaatctccttctcctttgagtgactggagcccggcttgccccatcagctgagctagagatttagaggcttttgtcattcttgtccgtggctcaaaggccacggggctgacatgtttctctctgtttactggtcacacgaccagataaacgtgtccccgtggtcacaagaagggaaggaggaaaatgttattatgtacgcgtaaatttctgcgttgatgccagaacaaatctgtgcaactagagaagaggggcctgggaaatggcaccaatagccccagggcaatgagtgaactgtctcattgaaggtcactggagtgaaaacaggactgagtttctgatcagtgttagaattgtcaaagcatgtgctttctcctctccttcctgaaaccccattcacatgatagtcagtgaaaaataaaaggtatatgacacatcaaagaagaaaagagagccatcggcagataagacattgctttccatcttcctgaagttggttgaaggtttctctgcttaggccagaggaaggtgacacctagagattgtaaggaaggggctacagtctgagaggagccgccgaagcccacctcttaaagacaaaggtggcctgcatgaatgaagggggctggaacagggatgaattgaggatctgcatacaggaaatagaacataccctttcctcacctccttaacccatgtaatcaggcatttaatacccatggataaaataaaacatttttctctacagaaactaaatggaggagaaagaggaggaagaggaggagggagggaagggagaagccttaatggcagagacataaatagcccacaaagcctaaaatacctactatctggcccttttgcagaaagtttaccaaccctgtacctcaattatggatattcacccaatgatcgccagacctgcaggagaaaacacacatcaaagaacagatgagcaccttcaccataattattgcattccgctcgatttatttggttacaggaatccaaataaagctaaatatgtctttaggaaaatctttaggaaattgacctgagaagcaggtaacttgtaactagcccatcagttgttcatgtataaaaggcaggagaataattgccttgggaactgtattgtttaataactgcattatctattagtttgtaaaagaaaaccctttgctttggactcagccctcactgaaccctaacgcagaacttggccttggaaacagtgtcagttagcccaactggtgccagcccacgggggcacgggactcctcggttaaggaaattctggatctcaaccttcctttcttccttagggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtaaggctccccagaccttagcttggaagtgatggtggacagaaggtggagggagagccacgtgacttgattacgggctctgaaaacatgtgccactcatgggtccctggccccagcaagtggcattagtcatggcagtaatacttcacacttgtagacaattttggtcccatttctcttttccaagcatggggctgtgtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaataaataaataaataataaacaaagttagccaggcatggtggcacacgcctgtagtcccagatacccaggaggctgaggtgggaggattgcttgagcccaggagatggaggctgcagtgagctgtgatcatgccactgcactccagtctggggcaacagagcaaaactctgtctcaaaaaagcaaaaaacaacaacaacaacaaaaaaaaaaaaaaaaaaaaaaaaaaaaaaaaacaagaagcagcgcaccagatttagcccagggggcggtagttcacaaagtccagatcagtgtcgtcccagagatctttctgtgatcatgaaaatgttctatgtctgggttctacaactactgagagcttgacatgtggctacagcaactgaggaactaaatttttaattttcattccctttaatgaatgtgagtgcaaatggccacattgctggtggctgctctgttagtttaagtctagataatactttaataataccagctgcacctgtgtagaccacataatttttacatatctcattattctggagatgctccctgtgtcttagacatcagtcttttaaatatgctaatactattcacagtaatttccaagaattaaatcatatttgtcaaaaatgttttggaatctgttacttactatgtgtattaaagcaggatgtcaatctctccctcatgccaggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtctttgttctgaccatggggttattatttttaccagtaagccatgaacattaagccctgttgcccacaatctcccatgctgagggctgagccactttggagaatctgcccactggatatctttacgacgttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgccaataggacttttctgcttcccggcgcacatgctctctctcagaaggcaggttgaagctgtaggtggaaccggggctgcattttctatacacccagctcacaggagcttgaacaactggtcagcccctgagcccctactacaagtgatcctcaggcaggtaaccccagattcatgcactgtagggtgctgagcagcatccctagtctctacccagtttcccctcacttgcacacaaagtagcttctgaacatcctcatgacagtaaacatcaagcacgatatcagctcttcctgagatgcctcctttctgtgtccagctccctgaaatgtgaaaccaagaccaaactctgtagttttcatcccagaaaatcagagagctggcatggcgtgtcagaagacttggggctgtggcgtgaccttgagtgagtcactccacttcccgcagcttcaaagtcttcatctaaaatgcaggtcatgctgcctgcattgtggggaagattaggaatgatgtgggtaaatgcctgggcccatagctggcatgcagtgggtttctagtaaactgtagctatgttattgtcctaggaaggcatatatggtcaaaagcacaacaaagaaactcaaatgtgctgctgccaggtggactcctgtaggctgtacaatttagacatccaagctgcagagtgtgagcacaccagcacgacactgtgactcagttgccttgctgtggtccctgtgcggctctcactgagctcctaggctaaccagttcgtctgatgttcccactcttacctagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggtgccttcaccctagccccgtacttttcttaacctgattcccttgaacactgtctcagcaacctggattttcctctgctggggtcacgattcattccttgcatgacgggggaaagtgctagccaacagaacctgtcacagtctccagggataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttattgggttagggtttatctactctttcagaccttcaagaatagtaagaaatcatatccatctgcttagggccaccagcaagggacaaaaacaatggaaaccagaggaaaggaaagagagaaaataaaggagcgttgaaaaagaatagaggagaagtaagagagaaggagacccccggtgggttgcctaccctgggttcttggcaacattgtatttgattaaattatgtatcatattttagctgacatagcaaggaggagatatttagactatgccttcattatgccttcatgagtatagcaattaacagctttcaaaacgcttttggcaaatacaatttaattctaggaagttgctttggttttggcttttgtttttgtttttgagacagagcctcactctgtcacccaggctggagtgcagtggcacaatctcagctcactgcaacctctgcctcccgggttcaagctggttctcctgcctcagcctccgaagtagctgggactacaggtgcgcaccaccacgcccagctaatttttgtatttttagtagagatggggtttctgcatgttggccaggatgttctcgaactcctggccctcaagtgatcctcccacttcagcctcccaaagtgctgggattacaggcatgagccactgcacgcggcctctagaaagttactttgaaccctactagtaaatttgagttgctgacatctaagctgtaagaacacattgtcttattgctgaaagtattataggatggaccccaaattctgaagtcactgggatttggaatctcctaatgccttctaacctctcattcaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagccccctaagcccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggctacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctagagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccacttt

SEQ ID NO: 2652 - DNA, 33255 bp, Homo sapiens
  source 1..33255: mol_type = genomic DNA
caagagttggtaagctcgctgcagtgggtggagagaggcctctagacttcagtttcagtttcctggctctgggcagcagcaagaattcctctgcctcccatcctaccattcactgtcttgccggcagccagctgagagcaatgggaaatggggagtcccagctgtcctcggtgcctgctcagaagctgggttggtttatccaggaatacctgaagccctacgaagaatgtcagacactgatcgacgagatggtgaacaccatctgtgacgtcctgcaggaacccgaacagttccccctggtgcagggagtggccatagtgagtccagggctgaggttgggtctctgggaggcaggagattccacggcggcagcaaggccgagctactgggtgctgggtgcctattatgtgcgaggcccacacttgggtgggatgtggtgtaggagtctcaggctctggagcaggcgcttgctccagagctgtgtgacactgggcaggctacttaacctctctgtgcctcagtctctgactctgtaaaatggggagaggcataatacccacttcagagtatcgtaaggcttgagcacatcatgttcttagcaaaagactggcagtgctcagtgaattcactgtgattactcactgcgattttcttctatcctctccacagtacagaggagtaaacttagggaggctagagaactttgttcaaactacccaggttgccttgtggtttctccgcagcaagaaggagtggcttttatcagttagaaatatttggttttgtggacacaaatctcaggactgaggctgaaaattctggacctctggggaggaagggggactggggagatgccaggaccctagaattgggggcgtgggggtcctgatggcccaatactatcctcttagcctcctgagctgctgacgtcccttctctgctgctgccacactttttggtctctaccccttgcacacatccgctagtgcctcaataaagaaatctagacacgtggtgtccccagccctggcccaggccagcaagctaaggcaagtttggttaatagctattgtcagaactgggattttaagcctgggtaattggcttgagggcatgcatgtttaaccactacactatcctgcctctcaatttttttttcctcatggaagtaaaacagaaaaagtgcccagatcaaagtgtccagcttgataggtagccacaaacaatgtaactgtgtaacccccacccagatccagaaacaaaacattctcagccccccagagccctgggcccccgatccagtcagcacctccaaacccaggtaggcaatctcctgacttctaacagcatagacacgttttgcctgtttttaaacgttttacaattatagggtgaccaactatcccagttcatccaagattggggtgtttcctgggatgtgggactcttggtgtgaaagctgggaatgtaaaccaggatgcatgggtgaaccctacataaatggcatcatgggctctgtgtgctttagtgcgtggtttctctgacctatgatgtttatgaaatttatgttgtggggtacagttgtttatcttttcattgttgtgtcaattccattatgtgaatattccacatttgtccattctactgtgtttttttatttttacataattgtgcatatttatatggggtacatgtgatatttggacacatggatacaatgtgaaatgatcagggtagttaggatatccatcacctcaaacattgatcatttatttgtgttgagaacagttcagatcttctcttctaactattttgaaatatataataaattattgttaactatagtcaccccattgtgctatcaaacactagaatttatcccttctatctaactgtatgtttgtatccattaaccaacttctcttcatttcctcctctacttcccagcctctggtaactatgatcctactctctacctccatgagatcaactttttttaacttccacataaacacatgcaatattgtctttctatgcctgacttatttcatttaacataatgacctctagttccatgcacattgctgcaaatgacagaattccattctttttgtgtctgaatagtattctattgtgtatatatactacattgtctttatccattcagctgctgatggatacgttggttgattccatatcttggcttttgtgaatagtgctgcaataaacatgagggtgcagttatcccttttttggataaatacctagtagtgggattgctggattgaatggcagtgccatttttattttttttagaaacctccatactgttttccgtaatgactgtgctaatttacattcccaccaacagtgtgtaagattccctttactccaaatccttgctagcgtttattttttgtctttttgataatagctattctaactggggtgagatggtatctcattgtggttttgatttgcatttccctagtgattagtgatgtcaagcattttttcatatacccattggccattttgtatgtcttcttttgagaaatgtctatttaggccctttggctgctttttaatgggatgggttgttttctttgctgttgagttgttcacgttccttgtatattctggatattaaacccttgttggaaaaatagtttccaaatattttctcccattctacagcttgtcttttcactcttgattgttccctttgatgtgcagaagctttttcatttaatatagtcccaattgtctattttttgtttttgttgcctgtgcttttgaagtcttagccacaaaatacttgcatagaccaatatcatgaagcattactcttctgctttattctattaattttatcatttcaggccttatgtttaactctttaacccatttttagttaattttttataagatgacagacgggggcctagtttcattcttctacatatggatatccagttttcccaacaccatttattgaagagagtatcctttccctaatgtgtgttcatggtgctttctcaatcagttggctgtaaatttgtggatttgtttctgggttctcgattctgttcctttggtctatatgtctgtttttataccaatcccatgctgctttggttactatagctttgtagtatattttgaagtcacgtagcatgatgcctctagctttgttctttttcctcagtactatttggctatttgagatcttttgtgtttccatacaaattttaggattgttttttctatttctgtgaaaaaaaatgtcactggtatttataaggattgcattgattctgtagattgctttgggtagtatggttattttaacaatattaattcttccaatccatgagcatgggatgtctttccatttgcttgtgtcaccttcagtttcttttatcagtgttttgtagttttcactgtagagatctttcacttccttagttaaatgcattcctaggtatttttgttaaatactataagattgctttcttgatttctttttcagctagttcattactgatgtgtagaatatgttggtattttggtatgttggtatggtatgttgattttggtattttgattttgtatcctgcaactttaccaaatttatcagttctaagaggttttcttggtggagtctttaggtttttctgtatagaagatcatatggtctgcaaagaggggcaatttgactttttcttttcctatttggatgccttttatttctttatcttttgggattgctttggctaggacttccaggatacaggctgaaagcctttcccaattcagtatgatgttaactgtgggtttgtcatatatggactttattatgttgaggtatgttccttacatgcctaatttgttgagggtttttagcataaagggatgttgaattttaccaaatgttcttctacatctaccaggataatcatatgatttgtccttcattatgttgatgtgatgtgcaaatgttcaacatttgttgacttgctcatgttgaaccatccttgcatccctgggataaatcccacttgatcatgtgttatcttttcgaagtattattggatttggtttgctagcattttgttgaaggtatttgtatctatgttcatcagggatattggcctgtagttttcttttttgttgtgtctttggtctagttttggtatcagggtaatgctgacttcatagaagtggttaggagtaattccctcctcttcaatttttttggaatagtttgagaagaattggtgttaattcttctttataagtttggtagagttcagcagtaaagccatctagtcctgggctattctttgttgaggagttttttattactgattcaatctactcactcactattggtctgttcaggttttctgtttcttcctggatcaatcttagtaggttgtatgtgttcaggaatttatccatctcctctaggctttccaatttgttcacatgtagttgttcatcatagtctctaatgaccccttttatttctgtggtatcaatggtaatgtctccttttttatccctgattttattttacttgggtcttctctttttttagtctatttagtctaagtagcggttcatccattttgtttatctttttaagaaaccaactttttattttgttaatttttagcctctattatgtttagttctgttctgatttttattatttctttccttctactaattttaggtttggtttattcttgcttttttgtttgtttttgagatggatttttgcttttgttgcccaagctggagtgcaatgacgtgatctcagctcactgcaacctctgccccctgggttcaagtgattctcctgcctcagcctcctgagtagttgggatcacaggcatgcaccaccacgcccggctaattttgtatttttagtagagacggggtttcaccatgttggtcaggctggtctcaaactcctgacctcaggtgatccacccgcctcagcctcccaaagtactggaatttcaggtgtgagccactatgcctggcttttcttgcttttctaattccttaagatgaaccgttaggttgtttatttgaaattgttctactttttttgatgtaagcatgtattgcttcaaactttgctgtatcccttaggttttggtatgttgtgtttccattttcatttgtttccagaaattttttgatttccttttaaatttcttcatcagcccagtggttgtccaggagcgtgttgtttaattttcacgtatttgtacaatttccaaagttcctcttgttccattgtggtctgtatccattgtggtaagtatccattaagatacctgacagtatttcaatttttaaaaatttgttgagccttgttttgtgacctaccatagggtctatcctggagaacattccctgtgctgataagaatgtgtattctgtagctgaataaataatctgcaaatattcattaggtccatttggactataatgcagactaagtccagtattctttgctgaataaataatctgcaaatattcattaggtccatttggactataatgcagactaagtccagtatttctttgctgattttctgtctacgtgatctgcccaataccaaaagtgagatgaagttcccagctattactgtattggcagtctctcggtctctgtttagctctaatatttgctttacatatctcagtgctctaccgttgggtggtcatacatatgtgtataaatatacatatacatatatatgtctatatacatatatacacatacttatatcctctggctgaattgatctcttgatcattaattataaaatgaccttctttgtctctttttatgtttttgacttaaagtctactctgtctgatataagtatagctactcctgcacacttttggtttccatttgtgtggaatattttttccattccttcacattcagtctatatgtatcttcacagatgcagtgagtttattggaggcagcatatagttggaccttattttttatccattcagcttgtctgtatcttttaactagagaatttaaaccgttgttaaattcagggttgttattgataggtaacaacttactcctgtcattttgttatttgttttgattgttttgtacattctttgttcttttctttctctttattgcctacctttccaattgttgggggttttgtaatgataacatttgactcctttctctttgtcatttgtgtatctgctctaccagtgagttttatacttttgtgtgttttcatgatggtagacatcatccctttgcttccagatgtaacactctcttaagcattttctgtagaactagtctagtggtgatgaattccctctgtttttgcttgtctgggaaagactttgtttctccttcatttttgaaggatagctttgctgggtatcgtattcttgtctgaaagggtttttttttagcactttgagcatatcatcctattctcttctgacctgtaagttttctgctcagaaatctgctattagtctgaggagaattcccttatatgtgactttatacttttgtcttgctattttcagaattatatgtttgtctttgacttttgacagtttgactataatatgcctgcagaagacattttggggttgaatctatttgagaatctttgagcttcctgtatctgggtgtctaaatctcttgtaagacatgggacgttttcagctattacttcattaaatagattttctatgcctttgcccatctcttctcctagatctttccaaatttaaatatttggttactttatgattaccaatatggcacataggctttcttcactcatttttatttatttttctctccttttgtctggctggattatttcaaaagaactgtcttcaagtttagaaattctttcttctccttgacctagtctattgttaaagcagtgagttgtatttttattttattcattgatttcttcagtttcaggaattctctttggttctttttagcaatatctatctctttgttgagtttctcattcagagcataaattattttcctgatttatttgtattgtttatctgtgttttcttgtatcttactgaatttctttaatatcatggttttgaatttttcttaaccattgcacagatatcattttctttgggatctgtactaaagaattattgtgctcctttggaagtgccatgtttcccttgctttttcatgtttctgtgtccttacattgatatcagcacagctaatgtaacagtcacttctccaattttatttattgactttcatagggaaagacattttcctctgctgggcatgatggctcatgcctataatcccagtgactcaggaggctgaggtgggaagattgcttctggcaggagtttgaggttacagtgagatatgattgtgccactatgctccagcctaggtgacagagcaagaccctgtctctaaaaaattaaataaaaataaaataaaaaagatgttttcctgtagatgtgtctatagtgttggttgagtggagcgctttggctttgattctgtgtgggcacagttagtggagcctccacatgatttcattagcatcagtgttgtctgtgagctcctcagtggctgacagtgtagttgttaatggagtctgtggaaaggctgtgctgggaacagggacatcaggcaggttggtcttcaagcaccagtggtgacagcagtatgccaggcatgctggtcctcaggcccccaggcagtgtatgtgggtgtcaatgctggtgtgtccaggtgggcagggtatcagacttcaagatgacatgttcgggtgccagtggtagcagcagtggactgaacaggcaggtccttgggcccccaggtggcttgtttggaagcggcagcagcaggccaaccctcaggccctcaagtggtgtacacaggcatcagtgatggcaagctgggtaggctggtccccaggcccttgggagacacatgtggtcactagtggcaggcagagtgggcccatccttaggcctctggatggtgtgtgcctgtgctgctggtggtaaagaggacgggttaatctcctggcccctgggcagcacatgtggatgctggtggcaggtggggcgagcctgtcttcaggttccctaatggtgtgtgcaggtgctggccgcaggtgggacagttttacccccattcccccagatgcgcacaggcaccagcaacaatggcaggtgaggcgatcctatcctcaggccctgggacagtaagcacaggtgctggtggcaggtggggcagttcaatccgtttctattgccagcggccatttgagtcacctccaggttggggctagtatgaaaagtgttactatgagcatcccaatcaggtctttgtggggcaaatggatgcctgccactcaatgttaagaccatttttggcttttacttgagttgagaaataccactgcctgctagagatccctgtaaccccagaatctagtgtctcatatctgcttctttgtcactggcagggtggctcctatggacggaaaacagtcttaagaggcaactccgatggtacccttgtcctcttcttcagtgacttaaaacaattccaggatcagaagagaagccaacgtgacatcctcgataaaactggggataagctgaagttctgtctgttcacgaagtggttgaaaaacaatttcgagatccagaagtcccttgatgggttcaccatccaggtgttcacaaaaaatcagagaatctctttcgaggtgctggccgccttcaacgctctgagtaagcattgctgggtgtcaggagagaaaagccaaagaagcgggtgccagacagctctgtgcaacctctaggccatgagtgggatagataccactgctgctttaaaaaatgggagaccatagaccctcaggagagaagaatcccttctaccctggactcgctctcttctctggaactaacttctcccccataccctgattgtctttggagaaaatgttctggattctagaatctaaggcagagccttttaagccatactgtacacataaatcacctggaaccttgttaaaatgcagatcctgactcaggaggtctgagttagagcccaggatttcatatttctagccagctccatgatgagctgctggtccgcagatcatgcttgcaggttttgaccagagtcagtgttggttagagtaagaggatgaggcagacatctgggaaaagtccagctggggcaagcatttgaagtctgccttcctaccaggtcaaaatcaaggcaacgaccttccatagataactatcaaagcttgagggggtgccttgaacccaactcctaaatccctaagacctgcccacctcttgtgtctcctgtctcagcaaacattcccacactcttgcatattgttaaagtaacctctgcttaccaggcttctggtttaataaaagatggctagagtgactccatcttaaagcaagtagctaggcactcaaaaggaacctacaggcttaatacttgggtctgaaaatagccacagtctaagctgaccaccaattataattgcagaatatttaaggccatacaaaacatctcccactaagcctacaaaatgtccaggtgtcctaaaagttcagcccacttaaaggcagcattaatgagcaggtttaggttgaaggattaatggtcatcaataccactgttaagaagaaaattcttggccaaattgaatttaatggagtttaactgagcagacaattcacaaatctagaagcctcctgagccagagtaggttcagagagtcttgaacacagccacgtggtggaagaagatttatggacaggaaaaggaaaatgatgtactgaaaatgaaagtgaggtacagaaacagccagactggttatagctcagcattggccttatttgaacgagatttgaacagttggccacctttgattggccgaaactcagtgattggcacaagagtaggttgcagtctgtttacacatccttttaggttatagttcaccatgtacagagaaattttaggccaaacttaaaatatgtaaggaggcagctttaggctaaacttgatttaacagcaccaataccccctacctttagtgagcacatctgcacattccaattttaatgacagctccttagaatttcttatcaacgaagacactaacaaagaatggcgcattcctccttctcctttctgaggatgccctaccctgtaacaaagtcgtttctaataaatttgcttctttcaccatactctgtacctgccttgaattctttcctgcatgagatccaagaaccctctcttgggatctgaatcaggaccctcttttccagcaacgctatcacctgtaaaccaaaagtatctgagacaggtctcaatctatttagaaagtatatttgccaaggtgaaggatgtacccatgacacagcctcaggaagttctgatgacatgtacccaaagtgctcagggtacagcttggttgtatacgtggtatggtttggctgtgtccccaccaaatctcatcttgaattgtagctcccacaatttccacatgtcatgggagggacccagtgggaggtaattgaatcatggaggcaggtatttcccatgctgttctcatgataatgaataaatctcacgagatctgatggtgtcataaaggggagttcccctgcacaagctctctctggcctcccaccatgtaacatgtcccttgctcttccaccatgattgtgaggcctccccaaccatgtggaactgtgagtcaatcaaacctctttcctttataaactactcagtctcaggtatgtctttattaacagcatgagaacagactaatacaatacattttagggagacatgagacatcaatcaatgcaggtaagatgtacattggtttggtttggaaaggcaggacaactcaaagtgggggcttccaggtcattggtagatttaaagattttctgattggcaattgatggaaagagttatcatcaatagaagggaatgtctgggttatgatgataaagggttgtggagaccaaagttttatcatgcagctgaaaactccaggtagcagacttcagagagaatagattgtaaatgtttcttatcagacaagagcctgttctatcactaattccaaaagagagggaggtatcatgaggcatgtccagctcctccttcccatcatggcctgaactggtttttcaggtcaactttggaatgcctttgctgagaggagaggtccattcagatgactgggggtgcttagaattttgtttttggtttatatacctaagccaggattgtatctccagctcccccacctcctcactcacagcccatcactaagtcctgccagttctgcctaacttgctcctaaatctgcatcatttctctcccttcccactgctacttccctagtcaacgtcaccaccagggatggggcaatggcttcctaattgtctccctgcctcctgtctcactccaccctgcagctggtgctctctttccatgcacaaatattgtgtcacacactctgcctctaatggcttttcactgcatttaggaagttgaccaaaaaggccaaactctgtaaaatattttaagaggttttttctgagccaaatatgaggaccatgacctgtgacacaatctcagtagttcctgagaacgtgtgccccaggtgattaggttacagcttgatttgtatacattttagggggacagaatttacaggcagaaacgtaaatcagtacacataagatgtgcattgattcagcctggaaaggcaaaatgtctcaaagcagggtcttccaggtcatagatggttataaagatttcctgattagcagttagttgaaggagttcagcttaagaaaaggggagttgtggaagacaaggttcttattatgtagatgaagcctccaggtagcaggcttcaaggagaataggtggtaaatgtcccttatcagaccttaaagatgtcagacgattagttaaaatctctcctgaatcaggaaaagatctggaaggggaaggggattctccacagaatgtgaatttttccacaggacacagctttgcagggccattccaatatatgtcaaagaaatatattttggggtaaaatacttttgatttcctttagggcctgttatctgtcaggtgatgccagagttaggctggaatttggtgtcatactgctacaaagagtctgttctgtcagtcttggggtctctattttaatgttagtgtttgtcgattgtgcctgaattccaaagggaggagggtataatgaggtgtctgagctcccccttcccatcatgacctgagctagtttttcaggtttctttgggggttccccttggccaagagaggggttcattcagtaggttgggaaggcttagaattttatttttggtttacaaggataaggatcaaactcctcagcaggacaggactttgatgatctggcagcccctacttacttacctctccagctgtaccactcaccaccaactaactctctatgcttcagccactctggccttccctgagctcctcaaacccacatgatgctagctcaacttgagactttggcctatactgttcctttgcctggaatatacttcccccagccttttatttttggataactccaactcatcctttaagtcctctggctctctatgtctgggttagatccactttccacatgctccagtagcaatttgtgctgtctgaatcatgggatttatcactttgcaaaccccaactatctgagacaggtctcagttagtttagaaagtttattttgccaaggttgaggatgcgcacccgtaacacagcctcaggaagtcctgatgacatgtgcccaaggcgctcagagcacagtttgcttttgtacgttttagggagacctgagacatcaatcaacatatgtaaggtgaacaatggttcactccggaaaggcgggacaactcgaagcaaagtgggacaattcaaagtggggagagggcttccagatcataggtagataagagaccaatggttgcattcctctgagtttctgattaacctcttccaaaggaggcaatcaaatacacatttatctcagcagagggatgactttgaatagaatgggaggcaggtttgtcctgagaagttcccagcttgacttttccctttaaccgagtgattttggggccccaagatttattttcctttcacaacttatatggaaataatgtatttagctttctcctctcctagactataagctccatgaggacaggtatcatgagtatcttgttcttctatggtctctagtacaatgttcattattaataatagttgttggttggatggatggatggagcatgatggataaatggatggaaggtaaatggatggaaaaatgaatgtagatggatggatggatagatagatattaaatatatgtatatatttatggatgaggtagatagatggatagtctcaagcacaaagtctcaagtacaggtgcacatataatcacaaacttaaataattccaggctgggcacagtggttcttgcctataatcccagcgctttgggaggctgaggcaagaggattacttgaggccaggagtttaagaccagcctgggcaacatagtgaaaccccatctctacaaaagaattaaaaattagatgtggtggcatgcagctgtattcctaactactggggagactgaggcaggaggatcacttgagcacaggagttcaaggttgcagtgagctattattacaccactatactccagcctggacaacggagcaagatcttgtcaaaagaaaaaaaaaaaagaaagaaagaaaagaaaaggggaggggaggggaagagaggggaggggaagggaaaattcccaagctgaaacttaagccatcattaaacaaatggggaaacagaaaagcccaggtcttctaagcccatggccagagtaccttccatcacctatagttttaaggaatttctgggttaccaggaaccatgaagaacaattagcccaggcatcactgataaggaggagacatacagacatcctgataactcacattcacagaaaggtggcctggcttggggaaacatgtaccagtttgggaggttggcagttctgagttcttatcctggtcctactactcacttatgcctgccagctgtacagtcagactagaaactagattccagggccattaggatgctcagggttgggggtgggggcctgcttcaaacaagggctggagtcaaggagggagacaggtgcatcataattctcataggaaagtcctctcttcctgttccaagtgccatgctgggagacctggccagagcgccctctactgggttcaccccatcatgcaaggatggtgtgagaatgagaaataaactcttccccacatgtgctacccagaagctgccactagatggtggtaaagctgcacattccaaattattataagctcctttttctgcaaggaaacacagggtcactttctgagaaaagcaacctacaggggaattggtaacttgcttttcgttttgttttgttttttaaactaaatattagcctaactaatctggcctatttttacaccaggtccaggctggctgtctccaattctgcatctctttccaccactgtgtgccactacaactctccccctagggcctttgacccaaagcaagaagtacctatttacttgactggctggtatttccattatcctcatctgtaaattagtaattgcaattgcacttgccagctaagagttttgtgaggcttgtatgtttcactgtacataaaaggcttagagtaaacacaccataaacgttagctatttattatcattatgggggaagatagaatgctctttccgtcaacctccctgcatgccaagtgcccagaaccatgcctagggagtcagtaaatatccactggggtgtatgaaaggaacaagctagctgctttctcctggtttcttatctaaatgtgtttatgggccagggagctggctcacgtctgtaattccaacactttggaaggccaaggtgggaggatcacttgaggccaggagttcaagaccagcctgggcaacaggcttttttttttctccaaaaaaaaagccaaacatggtggcacacgcctgtggtcccaggtactcagaaggctgaggcaggaggatcacttgagccttgaaatatatttgagggtacagtgagctatgattgtgccattgcagtccagcctgagcgacagagaagactctgtctctaaaagtaagaataatgatgaaacaaactcagtagtcctatagaccattttttgtttgtttttgtttctatttgtttggttgtttttttgtgggggggggagggttgttttgttttttaatgaacatagaaattgacccttctgatcttaaagcttgaaacttacatttgttttatctaagttccttcctcagaaaaggaacctcagacctctcaaaaagtatcaaagaactgaaactcaccagtcactgcatccagacaatgggatgtcaaatcccttattcctcatgattacctccttacccctccctaattcccgttttcccacacatagttacatttcttccctgctatatagaaccctaactttagtctgtcagggagaaggatttgagactgatctcccatctcctcagctgcagcacctgattaaagccttcttcttggcaacacttgtttccgccattggctttctatgtggtgagcagcaggacctagactgaacccctggtgtttcagtaacagtaatcaatcaataaatgtgtttattttatttttatttttattttgagacaaagtctcactctgtcacccaggctggagtgcagtggtgcaattatggcccagtgcaacatccacctctcggggtcaaggagttcgcatgccttagcctcctgagtagctgggattacaggcacctgccaccacgcccagctaatttttgtatttttagtacagacggggtttcatcatgttggccaggctggtctcaaactcctggcctcaggtgatccgcctgcctcagactcccaaagtgctgggattacaggcatgagccaccgtgcctggctaaataaatgtgtttataaacagtggaactcagctagcaagaatggaaacccattgattaaaccagcccctgtccccagacctccagggccctgctgccaccttgcctgcctcctcaaagtccctgtaccctgacattctgaagtaaaatattcacaggatggactcaatgacagaatatattgcatgtaaaatataaactttcctttcttccagatgtatgctaactatgccaacacaaacaattttttaaagaacccacttgctccctactaatttggataattccctttctcgtttataattccatctcttgtccctccattaggttctgctgatcttgtcttgggttaacaccatactgttttcattacagtcagtttagactacactttattatctaatgggccaagtcacccttccctactatgttttatgtaaaggtacctgtcctctgaccgattaagcaagagtcgtgtgctatcaaactataactgaccttcattgtagagcaaccctggctctctaaaaccaggttacataaataacaacgttccaatttctgtttcacatcaggcttaaatgataatcccagcccctggatctatcgagagctcaaaagatccttggataagacaaatgccagtcctggtgagtttgcagtctgcttcactgaactccagcagaagttttttgacaaccgtcctggaaaactaaaggatttgatcctcttgataaagcactggcatcaacaggtaattttccaactgtctatatatggttatcattcatttcctttttatcgagataattgacatccagtaaagtgcaacaatcttaggtatacagctcaacgcattttttacaatcttaccagcaacacccaaatcaacatagggaacgtttcgtgtaccccagaaggtgcctcaagcccattgtccccctagtaatcctcccaaacaaacccctattctaacatctattaccaccgcagattagttttgcttgattttaaacaaacaatgtaagtgggattatatggtacatacttcatgtctgccttctttggctcaacgggatgtctgagagactcattcatatggttgcagggtcttgctctgctgcccaggctggagtgcagtggtgggatcttggctcactgcaacctgtctcctgggctcaagcaatcctcccatctcagcctcccaagtagctggaactacaggagtgtgccaccatacctggctaatttttgtattttttgtagagatgaggtttcaccatgttgcccaggctggtcttgaactcctgggctcaagctatgtgcccacctcagcctcccaaagtgttgggattacagacatgagccatggcacccagccatagtagcactttttttcattgttttcccatattcaattgtattaatgtaacacacatttatccattctgctgctttgggtcattttcaaattggggcaattttcaaatagatgattgggtcattttcaaattggggcaattatgaattaggttactatgggtatttccctacatgtctttttgtgaatgtaagcattcatttctcttggataaatatgtagcagtagaattgctgggctatccagtgcacatatatgaatgttgtgtacatatatgcgtgtaaatatataaaatatatatgtagtttgtttttttgtttaaccatagcaaatcttgccgaatcatttccaaaatcttaccaaattatactcccatcagcaagatgtgagtttcaggcatattctcaaacccaactggggatctgcccacccagcgcagcaaagccaaacagactttgggattgcagtgagagagtgaagcatttattgcagggagccaagcagggagaattgggcagctcatgtttaagagccgaactccccgatggcttacaggtaagggttttaaaggtgaggggacagaggttacaggcaaagccataaatcaacacatggaggctgtacattggtttgacctaaaaaggtgggacgtctccaagcaggagggaggaggaggatgggtggcgctggtcacaggattcaaagactttccaatttgtgatgggtgaaatgggcgaagctttatctaaaaatttcagatcagcagaagggaacgttagctctggctcgtaggtgtgacctcctccaaaaccctcaggaagaaatttagaacaaagaacgaggtcagggttcaatcctcagtttcccctcatctgaggtctacctgccagtggatttgcttggtgggggcctgagtttctgaaaatcaactcagggacatatgctaagatgttatctttagtttctatagggaacaaaacatcttttgactctaacttccttggctactgttttaagtgactattaccttcttttttgttgtttttgttttattgggttttttttcactgctcctgtagaccctgaactactgtatttttgcttatcgagttgctcattgacttttcaaggctagtaaggtgcctggaatttccctcgaaagaactccagattttcctttattttcatgcttgtgggatgggagcagtgggtggcctgcagacacctaagagaggtccctgctccatcccagttgttccacatctttgtcaagacttggtattgtcagtccactgaactgtaggcattctagcaaaggacaatgacttcctgtagacctctggtttcttgatttcagatccctgacatggtaagaactagatcccccaatgagctgctaccctttccttatcccacagtgccagaaaaaaatcaaggatttaccctcgctgtctccgtatgccctggagctgcttacggtgtatgcctgggaacaggggtgcagaaaagacaactttgacattgctgaaggcgtcagaaccgtactggagctgatcaaatgccaggagaagctgtgtatctattggatggtcaactacaactttgaagatgagaccatcaggaacatcctgctgcaccagctccaatcagcgaggtgccaagcttctcacaccctatccctgtacctcatcatccgcatgccaggcatacctctttggaatgagatctcagccttgccctatcaagccagtgctggaccagaagaatggcagccaccatgggtggggaggcagatgggtctgtctgaaagaggggaggtccagccagtgcttttcacattccaaaccatagtcacattttgtcccctaaacaaacactggagagacacttccccttatagaaggaaggagctaagagagaaaggggatggggggcaggaagaggagaccactttgttattttattaatagaatgtctctgtaaagcagcaaacccagggccagaggggcttgatgtcgtagacaaaatccctcagcagcttggaggagctgcaggaatccaaattcaagttgccggattcccactccaggcctctttccccaaaacagattttgcctcccacaagcagctcaactgactttttttaatctaatggaatacacaggccagtaatcttggatccagttgacccaaccaataatgtgagtggagataaaatatgctggcaatggctgaaaaaagaagctcaaacctggttgacttctcccaacctggataatgagttacctgcaccatcttggaatgttctggtaagagggttttccaaatacagggtgtttcatgctgcaggaaggtcttcctgacacccaggctaggtcttatctgagagtactctatattcgtttcctgtattgctgttacaaagttccacaacacagatggcttaaagccacagaaatttattctcttaccattctggctattacaagttcaaaatcagggtgttggcagagccaagctctctgcaggccctagggaagaattattccaggcttcctgcagcttctggtggttgccagcagtccttggcttgtggctgcatcactccagcctctgtccctgaggtcacatgcccttctccctacatgtcttcacatcaccttccctctgtgcatgtctgtcttatcatctcctcttcttctaagaacaacagtcatactgaattagggcccaacataatgacctaatcttcactagatcccatttgaaaagacactatttccaagtaacacacattcatcgatactgtaggttggaaccccagcatcttttagggagacacagttcaacccatcacacaccatcagggcaatgactgtgaagtgcaaaatggaacaaagagaaaggggggtacccaaagatgcgagatctcaattaatttttgcaagagagaaagctggtgagcaggtggagacatgaaacggagcattgctcagagaagggggtggcagtcaggcctgtggatgccaggacaggctctgagctccgttcaggcaggtgccgggggcaacagtcagaagtgcggccgaaacaagagaaccaattaaggcaccagctgtgaaacaggtgcactggccttccccctcccatccccaaaaggagaagtaaatctgtcaacacaaactcccctgcatgctcagtgcttattagagaaaagccatccaagaagaaccttcccaggttagaccactgagccctctcagctttcctgggaaccgcactggagacaactgtattaattgaggccaaagaggccaatcaaattccacagttcacagacagattaatttatattcaagttatgggaggcggaatctataccccgtttgcacagaagtttgaaggctaactgagtaccaatctggcatgtaaatgaagatgtaaatgagtttagcaaacttcacagaggttggggagtctatgaatggggaacttccctaactggacccagaaggatcaggacgctctgagcagtcacccctgtgcccaccctaacccctactttcactggacccctggtctttgctctctgaccccaattttcccggcttcttcagacagattttttcaaaaaattatccccccgacctgacatcttattctgaagctttgaaacatttaaaaagttagaaaaatgattcagtaaactcctatgatcccctcacatagatgcagtacccatgtgcaacatttgctatgttacagtttgtgtgtgcacacgttattattgttgttgttacagttgtttttaatctttttttaagagatggggctataactcgctacattggccaggctggtctcaaactcctgggctcaagtgatcctcccacctggcctcccaaagctctgggattacaagcgtgagccacctcacctggcccattgttatagttgttgtttatactgagccctttgagagtagactgccagacatctctttacccttaaatgctttcatagggatctctgagaacaagaatattctcttcaataacctccatgccatgatcaaattcaggagactaggagtcatatattattgtcccaatacagcccattgggatgatttcgacagtcattccaagaagggcctttataggacattcttttccaacccagaagcacatgtggcatttagttccaaacatctcctaaaccatcttttgatactcactgtggctgtttttgttctgctatcccatcaacttctattttgagaactgtgagaccatccctgtctctgcagttgttgaagaaaatttaggcccaggaaccactgcataaggcggtccaaacattgggggctcatgcacacatacacacacacacacacacgtacatgcatacacaaacatgcacacacacactcacacatgcacacacatgtactcacaccatgcacacacgcacacacgcacacacatacatgcatacacacatgcatacatgcactcacacacatgcacacacgtactcacaccatgcacacacatgcactcacacacatgcacacatgcactcatgcacacacatgcatgcacaccatgcacacacatgcactcacacacatgcacacacatgcactcataccacgcacacatatgcactcacacaccacaaatattctgccctgtggaaggggcagtgttggcaatgaatattccttcaataggcaccgtcctcagcaactataaggccaacttacaacatctgagaacaaccaaggttggccttcaactttcaagctgagtgcccttccccacctccaggtgagctagcccatcttgtctgtgttgccagcaaaagtacaatatttgtatagaacagtaattacttgcctcttactgctgttttaaaaaaatgccctaaacttagtggcttaaaacacatgaatttgagccaggcacagtggctcacacctgtaatcccaacactttgggaggctgaggcgggaggatcacttgagaacaggagtttgagaccagcctgagcaacataacaataccccgtctctacaaaaataaataaataaattagctgtagtcccagctagttgggaggctgaggcaggacgatcacttgagcaagggagatcaaggttgcagtgagccatgattgtgccactgcattcagcctgggtgacagaacaagaccctgtctcaaaattacttttgcaccaaccaaaaaatatatatatacatatatatacacacacacatatacacatatatatacacatatatacatatatacacatatatgcacatatatatacacatatatacatatatacacatatatacatatatacacatatatacacatatatatacacatctatacacatatatatatacacatatatatatatacatatatatgcttcctcaccttttcaagctccttgaggttgtccaaatttcttggctcatggccccttcctccatcttcaaagccaatagcatagcatcttccagcctctctctctacttccaacatcacaccacctaactctaactccaacaccaccacactccaactctaaccctcctgcctccatcttataagtacccttgtccttataagcacagtggctcacgcctgtaattacagcactttgagaggctgaggtgggaggattgcttaagaccaagagtttgagaccagcctggggaacctagtgagactcccatctctacaaaaaaaaaaaaaaaaaaaaaaaaagctaggcgtggtggcacaaacctgtagtcccagctactcaggagactgaggctggaggatcccttgagcccaggaattggagactgcagtgagctataatggcaccactgccccccagcttgggtgacagagcgagacactatttctgaaaaaacatgggttagaatcatgggttggaaggctacctgttgggttctatgctcactacctaggtgatgggatcattcatacaccaagcctcagcgacatgcaatttacccatgtaaaaccccacacatgtacctccttgaacctaaagtaaaagtggagaaaaatgtattaattaattcaattaaaaattaaaattaagaggaaaaagacccctgtgataacatcaggccaaaccaggtaatgcagaataatcctcccatctctagagacttaaccacgtgtgcttcagagggagcacagctgtgccaaaacctggactttgaactgttggcctccagaactgggagagaataaacttctgttgttttaagccacctagttgtggtcacttgttatggcagcctttggaaaccaacacacccgcacatggcgtgtttaacgcaggctgatacaaccttaagaaaggaatggatgtggtcatcagcaatctccaatacctacagcaaatgggaagacagggaaggaccagaggtgtaggtaaagcaaaaagccacaggtcattaggaagtgatgctccaactgggcatggaaaaggagtttggagttaggaacacgacagatctgtctggacaaggatccagatctctcctagggggaaggaggggcaactaggacagtttttgtgtctgtggggggtcttgtgtgccactccaaactctcaggtgtgttcttgggatgtatttgtgcaatgacaaaagacggaaaagatgccagcccacgagcaggagggcagttgggagaggcagggtagggggcccagtacaggcaggaaaagaagccttgggtgggcttacaggtgccactcacacttggggtcttccttccttccccagcctgcaccactcttcacgaccccaggccaccttctggataagttcatcaaggagtttctccagcccaacaaatgcttcctagagcagattgacagtgctgttaacatcatccgtacattccttaaagaaaactgcttccgacaatcaacagccaagatccagattgtccgggtgagcactggcctttctcatgtcttgttggaatgatgtaatattgggcattcctggaagggaggtaagtgggcattgtagctctccaggatccatctaccttcagaaacttgaggaagggaagccaggagttaagggaactaggacactagttttcaggggggttgtggatagactgcctaggtcattaacaacacaactttgattctgtattgtttttcttggagctgttggccgtccttggggctcttgggcctggagacacatcactcccgtctctgcctctgtcatcaccttttcttctgtgtcctcccccttctcttcttttctaagaacacttgtcataggatttagggcccagcctgatccagaatgatctcatctccaggtccttaactcagttacatctgcgaagaccctttttccaaataagggcacatccacaggcccccagagcatgtatttttaggggtccaccattgaacccactgcagattctaaggagcttagaatctccttctcctttgagtgactggagcccggcttgccccatcagctgagctagagatttagaggcttttgtcattcttgtccgtggctcaaaggccacggggctgacatgtttctctctgtttactggtcacacgaccagataaacgtgtccccgtggtcacaagaagggaaggaggaaaatgttattatgtacgcgtaaatttctgcgttgatgccagaacaaatctgtgcaactagagaagaggggcctgggaaatggcaccaatagccccagggcaatgagtgaactgtctcattgaaggtcactggagtgaaaacaggactgagtttctgatcagtgttagaattgtcaaagcatgtgctttctcctctccttcctgaaaccccattcacatgatagtcagtgaaaaataaaaggtatatgacacatcaaagaagaaaagagagccatcggcagataagacattgctttccatcttcctgaagttggttgaaggtttctctgcttaggccagaggaaggtgacacctagagattgtaaggaaggggctacagtctgagaggagccgccgaagcccacctcttaaagacaaaggtggcctgcatgaatgaagggggctggaacagggatgaattgaggatctgcatacaggaaatagaacataccctttcctcacctccttaacccatgtaatcaggcatttaatacccatggataaaataaaacatttttctctacagaaactaaatggaggagaaagaggaggaagaggaggagggagggaagggagaagccttaatggcagagacataaatagcccacaaagcctaaaatacctactatctggcccttttgcagaaagtttaccaaccctgtacctcaattatggatattcacccaatgatcgccagacctgcaggagaaaacacacatcaaagaacagatgagcaccttcaccataattattgcattccgctcgatttatttggttacaggaatccaaataaagctaaatatgtctttaggaaaatctttaggaaattgacctgagaagcaggtaacttgtaactagcccatcagttgttcatgtataaaaggcaggagaataattgccttgggaactgtattgtttaataactgcattatctattagtttgtaaaagaaaaccctttgctttggactcagccctcactgaaccctaacgcagaacttggccttggaaacagtgtcagttagcccaactggtgccagcccacgggggcacgggactcctcggttaaggaaattctggatctcaaccttcctttcttccttagggaggatcaaccgccaaaggcacagctctgaagactggctctgatgccgatctcgtcgtgttccataactcacttaaaagctacacctcccaaaaaaacgagcggcacaaaatcgtcaaggaaatccatgaacagctgaaagccttttggagggagaaggaggaggagcttgaagtcagctttgagcctcccaagtggaaggctcccagggtgctgagcttctctctgaaatccaaagtcctcaacgaaagtgtcagctttgatgtgcttcctgcctttaatgcactgggtaaggctccccagaccttagcttggaagtgatggtggacagaaggtggagggagagccacgtgacttgattacgggctctgaaaacatgtgccactcatgggtccctggccccagcaagtggcattagtcatggcagtaatacttcacacttgtagacaattttggtcccatttctcttttccaagcatggggctgtgtgcctataatcccagtaatcagggagactgaggcaggagaattgcttgaacccgggaggtggaggttgcagtgcgagatcgtgccactgcactccagcctgggtaacagagtgagactccgtctgaaaacaaacaaacaaacacacaaacaaaacaagcagttgggctgggcatagaggctcacacctgtaatcccagtatcttgggaggccgaggcgggaagattgcttgatccaggagttcgagaccagcctgggcaacatagtgagacttcatcccaaaaataaataaataaataaataaataaataataaacaaagttagccaggcatggtggcacacgcctgtagtcccagatacccaggaggctgaggtgggaggattgcttgagcccaggagatggaggctgcagtgagctgtgatcatgccactgcactccagtctggggcaacagagcaaaactctgtctcaaaaaagcaaaaaacaacaacaacaacaaaaaaaaaaaaaaaaaaaaaaaaaaaaaaaaacaagaagcagcgcaccagatttagcccagggggcggtagttcacaaagtccagatcagtgtcgtcccagagatctttctgtgatcatgaaaatgttctatgtctgggttctacaactactgagagcttgacatgtggctacagcaactgaggaactaaatttttaattttcattccctttaatgaatgtgagtgcaaatggccacattgctggtggctgctctgttagtttaagtctagataatactttaataataccagctgcacctgtgtagaccacataatttttacatatctcattattctggagatgctccctgtgtcttagacatcagtcttttaaatatgctaatactattcacagtaatttccaagaattaaatcatatttgtcaaaaatgttttggaatctgttacttactatgtgtattaaagcaggatgtcaatctctccctcatgccaggtcagctgagttctggctccacacccagccccgaggtttatgcagggctcattgatctgtataaatcctcggacctcccgggaggagagttttctacctgtttcacagtcctgcagcgaaacttcattcgctcccggcccaccaaactaaaggatttaattcgcctggtgaagcactggtacaaagaggtaaggacagtctttgttctgaccatggggttattatttttaccagtaagccatgaacattaagccctgttgcccacaatctcccatgctgagggctgagccactttggagaatctgcccactggatatctttacgacgttcccatcactaaccctattcatttgggtcaggcgttgatggcttctgcccatcaaagctgctacatgtggtttactttgccctcacactggccaaagaattctgcaggaatccaagtgaccttgcctacagagggtgggtggaagctgggattcacatgcccacacattgccaataggacttttctgcttcccggcgcacatgctctctctcagaaggcaggttgaagctgtaggtggaaccggggctgcattttctatacacccagctcacaggagcttgaacaactggtcagcccctgagcccctactacaagtgatcctcaggcaggtaaccccagattcatgcactgtagggtgctgagcagcatccctagtctctacccagtttcccctcacttgcacacaaagtagcttctgaacatcctcatgacagtaaacatcaagcacgatatcagctcttcctgagatgcctcctttctgtgtccagctccctgaaatgtgaaaccaagaccaaactctgtagttttcatcccagaaaatcagagagctggcatggcgtgtcagaagacttggggctgtggcgtgaccttgagtgagtcactccacttcccgcagcttcaaagtcttcatctaaaatgcaggtcatgctgcctgcattgtggggaagattaggaatgatgtgggtaaatgcctgggcccatagctggcatgcagtgggtttctagtaaactgtagctatgttattgtcctaggaaggcatatatggtcaaaagcacaacaaagaaactcaaatgtgctgctgccaggtggactcctgtaggctgtacaatttagacatccaagctgcagagtgtgagcacaccagcacgacactgtgactcagttgccttgctgtggtccctgtgcggctctcactgagctcctaggctaaccagttcgtctgatgttcccactcttacctagtgtgaaaggaaactgaagccaaaggggtctttgcccccaaagtatgccttggagctgctcaccatctatgcctgggagcaggggagtggagtgccggattttgacactgcagaaggtttccggacagtcctggagctggtcacacaatatcagcagctctgcatcttctggaaggtcaattacaactttgaagatgagaccgtgaggaagtttctactgagccagttgcagaaaaccaggtgccttcaccctagccccgtacttttcttaacctgattcccttgaacactgtctcagcaacctggattttcctctgctggggtcacgattcattccttgcatgacgggggaaagtgctagccaacagaacctgtcacagtctccagggataaaacctagcaggggcaggagaaaatgctgttcagaaaaaatagagaaggaaggttcaagataccacgtccctgagctgctttcatctaagaggtgttagagttggaagtgtgtccctaagaattaacgctatcattcacgggccgatttatcctgcagggtttttattgggttagggtttatctactctttcagaccttcaagaatagtaagaaatcatatccatctgcttagggccaccagcaagggacaaaaacaatggaaaccagaggaaaggaaagagagaaaataaaggagcgttgaaaaagaatagaggagaagtaagagagaaggagacccccggtgggttgcctaccctgggttcttggcaacattgtatttgattaaattatgtatcatattttagctgacatagcaaggaggagatatttagactatgccttcattatgccttcatgagtatagcaattaacagctttcaaaacgcttttggcaaatacaatttaattctaggaagttgctttggttttggcttttgtttttgtttttgagacagagcctcactctgtcacccaggctggagtgcagtggcacaatctcagctcactgcaacctctgcctcccgggttcaagctggttctcctgcctcagcctccgaagtagctgggactacaggtgcgcaccaccacgcccagctaatttttgtatttttagtagagatggggtttctgcatgttggccaggatgttctcgaactcctggccctcaagtgatcctcccacttcagcctcccaaagtgctgggattacaggcatgagccactgcacgcggcctctagaaagttactttgaaccctactagtaaatttgagttgctgacatctaagctgtaagaacacattgtcttattgctgaaagtattataggatggaccccaaattctgaagtcactgggatttggaatctcctaatgccttctaacctctcattcaggcctgtgatcttggacccagccgaacccacaggtgacgtgggtggaggggaccgttggtgttggcatcttctggcaaaagaagcaaaggaatggttatcctctccctgcttcaaggatgggactggaaacccaataccaccttggaaagtgccggtaaaagtcatctaaaggaggcgttgtctggaaatagccctgtaacaggcttgaatcaaagaacttctcctactgtagcaacctgaaattaactcagacacaaataaaggaaacccagctcacaggagcttaaacagctggtcagccccctaagcccccactacaagtgatcctcaggcaggtaaccccagattcatgcactgtagggtgctgcgcagcatccctagtctctacccagtagatgccactagccctcctctcccagtgacaaccaaaagtcttcagacattgtcaaacgttcccctgggttcacagatctttctgcctttggcttttggctccaccctctttagctgttaatttgagtacttatggccctgaaagcggccacggtgcctccagatggcaggtttgcaatccaagcaggaagaaggaaaagatacccaaaggtcaagaacacagtgattttattagaagtttcatccgcaaattttcttccatttcattgctcagaaatgtcatgtggctacctgtaacttgaaggtggctacaaagatgactgtggacgtgggttgcactggccacccaaggatgtctgccacacctctccaaagccctccctacctaccaagatatacctgatatattccaccaggatatcctccctccagatatacttggttctctccaccaggttctttctttaaagcaggatttctcaactttgatacttactcacatttggggctagacagttctttgtttggaggctctcttgtgcattgtaggatgttgagcagcatctctggcctgtacccagtagatgccacccagttgtgacaattaaaagtgtcttgagactttatcatgtgtcttctgccctaggtgagaacccttgcactagaggaaccctacaccccaaccctggggggaatgtagggaagaggtggccaagccaaccgtggggttagctctaattattaagatatgcattataaataaataccaaaaaattgtctctggcaatagttaccttcccagatacaggtccccccttttttcccctaactcttttaagcaatgattgtaactattaggagacattgctctcccacgtatgtttttctttttagacaatgcagacaccaggaagttgtggagctaggatccatcctattgtcaatgagatgttctcatccagaagccatagaatcctgaataataattctaaaagaaacttctagagatcatctggcaatcgcttttaaagactcggctcaccgtgagaaagagtcactcacatccattcttcccttgatggtccctattcctccttcccttgcttcttggacttcttgaaatcaatcaagactgcaaaccctttcataaagtcttgccttgctgaactccctctctgcaggcagcctgcctttaaaaatagttgctgtcatccactttatgtgcatcttatttctgtcaacttgtattttttttcttgtatttttccaattagctcctcctttttccttccagtctaaaaaaggaatcctctgtgtcttcaaagcaaagctctttactttccccttggttctcataactctgtgatcttgctctcggtgcttccaactcatccacgtcctgtctgtttcctctgtatacaaaaccctttctgcccctgctgacacagacatcctctatgccagcagccagccaaccctttcattagaacttcaagctctccaaaggctcagattataactgttgtcatatttatatgaggctgttgtcttttccttctgagcctgcctttctcccccccacccaggagtatcctcttgccaaatcaaaagactttttccttgggctttagccttaaagatacttgaaggtctaggtgctttaacctcacataccctcacttaaacttttatcactgttgcatataccagttgtgatacaataaagaatgtatctggattttgtgcctagttcctagcacacagcttcaaaaattctagagtttcctgataggagtgtcttttgtattcataacaagcccttttcacccatgcctgggtttatgctaacaaggttacccatggtgggcccttagtttcaaggaaggagttggccaagccagaaagaccaagcatgtggttaaagcattggaattttcagccccatcccacccccaatctccaaggaggtgatggggctggaaattgagttcaattttaacatggccagtgatttaagcaatgctgcctatgtaaagaaaccccaataaaaactctggacagtgaggcttggggagcttcctgattggcagacattccaatgtactaggaaggtagcgcatcttgattccacagggacaaaggctcctgagctctgggcccttccagtgcttgccaccctacatactctttgtctggctcttcatttgtattctttataataaaatggtgattgtaagtagagca

SEQ ID NO: 2653 - DNA, 34807 bp, Homo sapiens
  source 1..34807: mol_type = genomic DNA
gttcggagagccgggcgggaaaacgaaaccagaaatccgaaggccgcgccagagccctgcttccccttgcacctgcgccgggcggccatggacttgtacagcaccccggccgctgcgctggacaggttcgtggccagaaggctgcagccgcggaaggagttcgtagagaaggcgcggcgcgctctgggcgccctggccgctgccctgagggagcgcgggggccgcctcggtgctgctgccccgcgggtgctgaaaactgtcaaggtgaggtcccacctcggggtctttatgtgtccaaaggggagtcctgggaggacgcttaagcctcacataggcttacggtgggggtggctttatccgcttgtgcacctcattcatttctttaacaaatacttccaatgtgccagccccgtgctaactcccccgaacatacgagccaggtaggtactcttaagcccgcttgacagatagagaaaatgaggcacagagaggtacagtgacgtgtccgatcctgtaagaggcccagccaggattcaaatccaagtagcctgattcctgcatctctactctcagaggctgcttcttatccattcattcactcattcactcattctcccagtcattcaaacagactgtgggcctcacactatgccagaccttaaggttacagaagtaataacactccgcgtaacagccagagtagcccaatttattgagacattatcaaataacaatgaaaattatctcattaaatgagtattacctcatttcatccccacgttcagtgaggcaggtattattgtacctgttttatggatagggaaactgaggctagacgctaaattactactctgagtcacatctttttttttttttttttttttttttttttttgagacagggtctcgctctgtcacccaggctggagtgcagtagcatgatcttggctcacagcaacctccgcctcctgggctcaagttattctcacacctcagcctcccaagtagctggcactacaggtgcacactaccatgcctggctaattatttgcattttttgtagagatagagttttgccgtgttgcccaggctggcctggaactcctgggctcaagtgatccacttgccttggcctttcaaagtgctgggattacaggtgtgagccaccatgcccaggtaatttttgcattttttgtagagacgggatttcaccatgttgcccaggctccgggtcactttttgtcacttaaatacagccacactgccactgtgatcccaggacactcgcagattcagggaggagacaagtcatgagctaccttatcctcagggtagatttgggggtgccaggagtggattgatggagggaacctgggtgtgctagaggaggttgtcaggagagggagtgaaaacgcagagtagaaatggcctcagagcacctagtggtttcctggggctgactctcagcttgggaggtggggaaggaggagacacttgtcgcctaggaggtgtgaagtcccgtttctaccttggagatggacaggagggatttctgtgcagcaagggaaagccctggcatccttagcttccctggaaaggggtgggagggggttctggagcacaatctccctgtgctttcattgtctcctttgtaaagtgagcacggtgcaatctccctgtgctttcgtttcctcttttgtaaagtggtaccttccttctggggctgtgaggaaggttcaatgagatgagagtgtgcaaaacgtgcaggaagtgcccagcctgtaatattccctgttcccactttgtcagcagcccccagatggtgggagctggtagtaaaaggactggcataatcatcgggataagtagggggtcccagtttgaggcaagccttgctcctggagggctccatcctggttcttgctgtttactggctgtgtaactcatttcaccatctgagcctcactccccatatctgcagccacatgtaactacatcacagttgttttgtgttggaagtgagattagagacgtcagatcccagacacagaacagtggctctgacaatgtttaggagtttcttttccaaatcctcaggttggaagctttgccgaaagaaacactaatcacacaggtctcagaaattgagtcataccacagttctgtacccattctgagcaaagattgcaaatgtgtgttctgcaaagcagaatttgttttacctgcggtcttgagtttttaaaaagttagttgccaacatttaaaaatcatggatataggcctggcatggtggttcatgcctgtaatcccagcactttgggaggccaacgagggcagatcacttgaggtcaggaattcgagaccagtctggccaacatggtgaaaccccatctctactaaaaatacaaaaattagccaggcatggtggcgcacacctgtagtcccagctactcaggaggctcaggtgggaaaatcacttgaactcatgagatggaggttgcagtgagctgagatggtgccactgcactccagcctaggcaacagagtaagtctctgtctcaaaactaaaaataaaaataaaattacaagtatggatttagcccagcacggtggtgcatgcctatagtctcagacacttgggaggctgaggcaagaagatcactcgagcccaggaattccaagctgcagtgagctacaatcgtgtctgtgaatagccactgcactccagcctgggcaacatagcaagaccccatctctttaaaaaaatgtaaaaactagccaggcatggtagcgtgtgcctgtagtctcaactacttgagaggctgaggcaggaggatcactcgagcccaggagttcaaggccgcagtgagctatgtgttccagcctgggtgacagaacaagaccctgtttctatggaaaaaaaatcatgagtttacatgttaaaattgcttctcttgaaatctcgagcctggctaccctgggcccacattcccgcgtggcttcaatgcctacagccatgtggccacagtctctccccagcacacttgcctcactcaagttgcctgccaggttgcaaggccactagaattggacagtatgaaattctgagttatttttctttgcccagggaggctcctcgggccggggcacagctctcaagggtggctgtgattctgaacttgtcatcttcctcgactgcttcaagagctatgtggaccagagggcccgccgtgcagagatcctcagtgagatgcgggcatcgctggaatcctggtggcagaacccagtccctggtctgagactcacgtttcctgagcagagcgtgcctggggccctgcagttccgcctgacatccgtagatcttgaggactggatggatgttagcctggtgcctgccttcaatgtcctgggtgaggggttcctagaccattccagggttgggggcaaaagatcattgggaacaacacaggacttccaattctagcccagccaccaacttgctgtttgacctgggccagcctctacccctctctcagcctcagtctggggactaaacatattggacttgtgccagacaaaggcagagaaaccccagttcctcctggatctgtggtcctgctgtcaagatgcttggccctcccacaggcatctgggagtttccctcagccactgcctggagcggttactgctcagcccttccacaaatactcccgaaagctaagccaagtggacatgtggctagcagtaggggcctggggacgaaaccagaattctgcaaaatcttgtattttatgttgaaaacatcaatgtgatttttgtgttctccttcgtaatacacgtatgcttgagttaagataaaaataggcctctgtgtcctcatctgtaaaatgaggataatactaatggggataatagtaatcttatagagttgtcagaagaattaaatgcattaatatatgtaatcaagcttagaagtgtgtctagtgggccaggcgcagtggctcatgcctgtaatcccagcttcgggaggccaagttagagactgcttgagcccaggagttcaagatcagccttggcaaaatagcaagatctagtctctacaaataataataattttaaaaaatagccaggtgtagtagtacatgcctccctctgatcccagctactggagaggctgaggtgggaggattgtttgagcccaggcagtggaggctgcagtgaattgtgattttgccactacaatctgtctgagtaagactcttcttaaaaaaaaaaaagaaataagaatgtctagcatgtgataagggttgtaagagtgtttactattattattatttctattattgttgttgtttctattattattgttattattattattattattatttaccttgatgatctgggggatagctttatcctttgggcagatagccacatcccctatgcctggtaccctaagcctagtgtacccacatactgggtacacacacacacacgcacacacatttttaagacagggtctcactctgtcacccaggttggagtgtggtggcatgatcttggctcactgcaacctccgtcctgggttcaagcaatcctcccacctcagcctcccgagtagctgggctacaggcatgcaccaccatgcctggctaatttttgtattttttatagagatagggtttcaccatgttgtctaggctggtcttgaacttctgagatcaaatgatccacctgcctcagcctcccaaagtgctaggattacaggcacaagccaccccacccagcctgggtacacatatattaatcataatagttactacttattaaatgcttaactattccaagaacttgacatgttttatctcatcaattcttcacaacaaacttatgaggtctgtactgtttcagcttcaattttaccattggggaaactgaggctcagagacatacagtgacccacccaaagccacacagcaggcaagcggtagcagcaacctcagggaattatggaaagtgtttacttctcccaagccatgcccatgggagtggtggcggaaaaggcgcaccctgcaaagtccactggctctgagctcaaatcctgcctccatcgcatgctggctgtgtaaccttgggcaaatcatggaatttctctgtgcctcagcttcctcagctatcaagtgggatgaagaactgtacttgcctcatagggttgtggtggggatacatgtaaagaccttctgtccagtgcccagtatgcagtaaaaaaaatatatatttttttctaagacagagtttcgctctgtcccccaggctggagtgcagtggtacgatctcagctcactgcaacctctgcctcctgagttcaagcaattctcgtgcttcggcctctggagtagctgggattacaggcgagtgccaacatgactggctaatttttgtatattttgttggccaggctggtctcgaactcctgacctcaggtgaacctcccaccttggcctcccaaagtgctgggattacaggtgtgagccacagcgccaggcctgtagtaaaaaatatcaacaaccactgctaaaggatcagggctttttgccttttatttcttgggcatcgttttcctctccgtgacacctcttaattaaggatatgtagagtggtgttttgaggaaggctcagggaggagagagttgccaggctgcaggcactgctgactcagctggaagcaactttcctgtttaaccatcttggaatgcagctgctcctctttgagctgttgctctagggactgcctggccatttgggatggagggactctcccactgcattctggagtgccgctcttcttccctgcctcctgaaaagctccaggctctcttcccagtcccccgactcccatgttaccagatttcttcccctctgaattcttcccactctctctcagcgccccaggctgagctcggcaccaacaccgccctccatcctgtgtcctcagtgccctccctaactcacagcgcttcacaccaacaggtcaggccggctccggcgtcaaacccaagccacaagtctactctaccctcctcaacagtggctgccaagggggcgagcatgcggcctgcttcacagagctgcggaggaactttgtgaacattcgcccagccaagttgaagaacctaatcttgctggtgaagcactggtaccaccaggtgaagccacttggaagggtttctccagacatgtgactgtttgctttgtgctttcatagtcgtgaaactgttgtcttacatttagtggccattcatgttctctctctgggaattgtctgtttatgtcccttgtgcattattttctcttgggttagctgtcttgttactgatttgttgaagctctttatatattgtggatactgatccttatttagttaatataatgcattcttccaatagtcttccagtctgtgtcttgggcttttgctttgtttaaaggttatttgtaggacaaaatatctacagtttaatgtactcagatatatcctttgaaaaatgagttattctttgtgtgtcttaagaagtctttccctatcctgccaggtgcagtggctcatggctggaatcccagcactttgagtggccgaggcaggtggatcacttgaggtcaggagttcaagaccagcctggccaacatggtgaaaccctgtctctactaaaaatacaaaatgtagccgggcgtggtggtacacacctgtaattccagttactcgggaggctgaggcaggagaatctcttgaacccaggaggcagaggttgcagtaagccaagattgcaccactgcactccagcctgggtgacagagccagactccatctcaaggaaaaaaaaaaaaaaaaaaaaaagaggtctttccctgtcctgactttgtaaaatgactctttcatatttcctgccatcatattgtttcctattgtatttctgttcatattcagggctttggcctgtctggtatggtatgaggtatatgcggagttggtacacttccctccctagcctcagggatgctcccttgctctgttcatgtttgttgccagactcttatgcactggggaaagtgtgcccagcctatgcctggagatgggggaacaggctcccccaaaatcttgcagcacatggaccagtcatcataagcaggtctctcaaggaagagattctggattccagttctggctcagccatcttcttgctgtgtgaccctggacaagttcctagccttctctgggcctctgtttcctccacttgcacataaagaaatatatgcatcggcaaatcttactcaggttctttccatgtaagattctccaggggcagaaaatgctaatagcctggtacttcctaaaagggcaaactgctgggtatggtggctcacgcctgtggtcctctccacgcaggaggctgaggcgtgaagatcacttgagcccaggagttcaaggctgcagtgacctaagattgagccactgcacttcagcctgggcaacagagtaagactctgtctataaattaattaattaattaatacaactatggagccagcctggttgggcgttagaaattctatcttgatctgggtggtgggtacacatgtgcacccacgcatgtttgtcaccccagagagagggggtgagcggagggagtgtggagatgctgggtgcttctagccaggggggtcactttctggcatgctgaagcatcccctctggagttacccagaggcctgggattcttgccttggcatggagtaatccctccctggtacgtggagatcccaagtatatggtgcacaaatagaaatcatgcattttgggatgggggatagacggctggagtgaggagggaaggacagagttctggcccgctgccccaccccactccaggggtgaaagggcgacaacttggtgtccttctccaatcagccacgcaactgggaccccagatctgcttcacctttatttgaggatagatagcaatttcagactacccttggcttctctctgactgctccctgcctccttgggacttgaaacttacacccctccctcccaccactcccccatcatatgagccaaccacttggctgaagctaccagtgagggctggtgagaaatgccacttgttcttggaacaggcttggaacacagcatcttgcctcaggctcggcctggaaggtccccagtctggttatgcagagagctggctctctttcctccccttcttccttctgagtcccctgccgatgccctctcacaggtgtgcctacaggggttgtggaaggagacgctgcccccggtctatgccctggaattgctgaccatcttcgcctgggagcagggctgtaagaaggatgctttcagcctagccgaaggcctccgaactgtcctgggcctgatccaacagcatcagcacctgtgtgttttctggactgtcaactatggcttcgaggaccctgcagttgggcagttcttgcagcggcagcttaagagacccaggtacttcctaatagcccaccatctgctctcctgtcccggggccagggggagataattgacaaggacaaaaccggttacatctactgagtgcttgggtatagaggccaaagcaaaatgctacatgtacatgttttaattcactggactcagcccagatgcacattagaattacctgggggagttttaaaaaatataccagtgcctggccccacaagttttatgcgtgaatgttttgctgatgtatagcagaaagtgcatgttctgatgactgtgtgaagaccgcatactttgaaaccaccacccagatcatggtagaatatttccagcaccccactggtcccctctcagtcagtaaccttccaaaataaccccacttacacttttataattacagttgtgccttttcttaaatcttatttaaatggaatcatgccacatgtacttttgtgtctggcttctcgttctgttctcaagattaagtctttgagatttagctatatagttgtggatcattcttttttgttgctgtatagtattccattgtgtgaatttatcaaaatatgttgtctattctactgatgatggacatttgagttctttcaacttggaactattacaaatagggccatcataaacattcttggacatgtttttttggtgcatatgcatatctgttggaaatatacctaggaatgaaattgctgaattgtagggtgtaactcaagagcccttgagagtggatcctggtatcttgtgattccaacgtgcagccagggttgacaatgataagcaggcaatgttgttttcctcattttgcggataaggaaatcgaggctcagagagggtaaatcatttgccccaggtcacacagctggaaagtagcagagatgcgattggaaccaggtccgtttcactccagagccctcttgctaaccagaaccttcttgtctctctgaaattgcaggcctgtgatcctggacccagctgaccccacatgggacctggggaatggggcagcctggcactgggatttgctagcccaggaggcagcatcctgctatgaccacccatgctttctgagggggatgggggacccagtgcagtcttggaaggggccggtaagtgagggggccccaggacccttgggttttgcactttgtttatgtgtccagtgtttcctgagcatctactatgtgccatatggtgtggaacaggctttaaaaagcaggggtggccaggtgtggtggctcacgcctgtaatctcaacacattgggaggccgaggtgggcagattacctgaggtcagaggtcaggagttcgagaccagtctggacaatatggtgaaaccttgtctctactaaaaatacgaaaattagccaggcatggtggtgggtgcgtgtaatctcagctactcgagaggctgaggcaggagaattgcttgaactagggaggcggaggttgcaatgagctgagatcactccattgcactccagcctgggtgacagagtaagactccgtcccaaaaaaaaaaaaaaaaaaaatgcacagggcatcaggcatgtaaaacagtcttatcaccaagctcaagctgaaactgcccgggggaaggagtcctttgtttttctgcagctatggtctggttaccagacctttctgcccatcacaagggcacccattttgcagtttatccctccagaaaggcacctttttcaactctgcccaaagatggccatgtgcgttagccatggccctcccacttcccctctctgagcctcagtcaccctgactgtacaaagggcgggagctggggagagaaggcattgggttgatgcagaaaccactgcgcctggctgaggcagctccttcaatgaccttccagggccttccacgtgctggatgctcaggtttgggccaccccatccagctagaccctaaccagaagacccctgaaaacagcaagagcctcaatgctgtgtacccaagagcagggagcaaacctccctcatgcccagctcctggccccactggggcagccagcatcgtcccctctgtgccgggaatggccttggacctgtctcagatccccaccaaggagctggaccgcttcatccaggaccacctgaagccgagcccccagttccaggagcaggtgaaaaaggccattgacatcatcttgcgctgcctccatgagaactgtgttcacaaggcctcaagagtcagtaaagtgagttgggccagtggagacacaggggggaccctatcgagggatcagcgtggggaagggaaggagttacagcaatggagctgaggttgggctggggaactggacggcccaggaaggatgatttgctggcttaaataaaatatatttaagtgccagcttagattttcttttttttaatgatacagtttttaaaacactattacaagaatcagatcacttccctcctcagctcaaaattctccatggtttcacagggcgcagaggcctcaagtcctacaggatgggccctggtctccctctggccttgacttactccacactggcctcctggctgctctgagcttaccaggtccacagaacaattcaaggcctctgtagtggctgttttctcttcctagaagaaaatgagaattctcttccccaaccatttggctctctctctctcgctctctctgtctctcctcttcaagtttcttgatctgatgtcctcgtccactgaggcctgaccacacgatttaaaattgcagtcttgcccgggcacggtggctcacgcctgtaatcctggaactttgggaggccaaggtgggcagatcacctgaggtcaggagttcaagaccaccctggccaacatggtgaaaccctgtctctactgaaaatacaaaaattagctgggcatggtgacgggcccctgtaatcccagctatgcaggaggctgaggcaggaaaatcgcttgaacccgggaggcggaggttgcagtgagctgagaccatgccactgcactccagcctgggcgacaagagtgaaactccgtctcaaaaataaaaataaataaaaataaaattgcagtcttgcactaccagccccctttctgttctgcacagcacttagcattttctcaggacctattgtttattgatggtcccttccttccctcccccagccagcatgtaagttccagaagaacagaaattttgtatcctctcttcttctttctttcctgcaacaaacatttagtgagcacttacatgtatcggatatgtgtgatatcccgtgtgaaggagggagggagggagggaattgatggaaacagggcaacagaggacaattgcaggccctattagggcttgggacctcaatttgcaactgctggcccagatgtgcagtcagtagatgctgcagatagtaggctaaaatgtttggtcgctgcccctacttaatcccacctccattatctgttgctgcagtttggtctgacttagctcagtcttcatggatcagagggcaggtgcaggcagatacaacttgactctctgtcacaattctaagaggtcacaggacccatgcagtcgacctttgtcatagtccccagacctgacatcagcaagagggcaggttccaggctgtagatggggcgcaggtgatgggatcgtagtccgactcccaggctcctagagggtccctgatctgagctgttcttccctccacaggggggctcatttggccggggcacagacctaagggatggctgtgatgttgaactcatcatcttcctcaactgcttcacggactacaaggaccaggggccccgccgcgcagagatccttgatgagatgcgagcgcagctagaatcctggtggcaggaccaggtgcccagcctgagccttcagtttcctgagcagaatgtgcctgaggctctgcagttccagctggtgtccacagccctgaagagctggacggatgttagcctgctgcctgccttcgatgctgtgggtgagggcgcccagcctgtcccttggagagtgatagggacctcaggcgcccatctaacaggggcacctgccatcctctttgtgatcctaattctcctacttgaccaagcattgaaaactactttgagatactgaaagtaatcatcaccatcaaatcttacaactatttagtgctttaactttacaaatattttaattatgaaatgtttcaagcatacagaaaactacagacgtcacacacccatgtagcccaattcagatttaacaaatgttaacagtaggcatatctgcttggtatttttttaaagaaatttctcatgttataattttcctccttattttaaagggtttactttatggttcatttttttttaactttcggaggtgaatcttagcttagtaattatcagttttagtcaatgcaattaaagctacccatttccctttcagtatcacattagctacagggcaaatcttttgtttgacatgcataatttttattatcattccggtctaaatatttagtacttttaattatgacattattgtttgttctttcatccatgaatatttggaagtagctttccaaatgaatgttttggagatttgtttgctttcggcatttacttattatgttttttaaaactgtagtcagaaaacatactttatgtgatatcaattctttggaatttgttggcatttcttagattgcccatggttgaaaagaatgcatgctttccatccaggcatggtggatcacacctgtaatcccagcattttggaaggccaatgcgggcaggtcacttgaggtcaggagttcgagaccagcctggccacagtgaaaccccatctccactaaaaatacaaaaaaaaaaaaaaaaaaaaaaaatagcctggcatggtggcacgcacctgtaatcccagctactcgggagactgaggcaggaaaatctcttgaacctgggaggcagaggttgcagtgagctgagattgcaccactgcactccagcctgagagacagagtgagactctatctcatgctttccattgctgaatgcagacttctatataggtcctttagatctagcttatgacttcttgctcggataattttttgtttggtctctcaatttctgagtaaaatatcttaaaatctcctgctctgaatggatatttatcccttgttccttgcaattctgtaaattttgtttttaatattttgaggctatgttattgggaacatataagtgcataatattatattttattggattgttcttttattattaagtaataatcttcatttctgaaagttatctttgtcttaaagccttttgtctgacattaatagggctttagtcctcctttgtcagcattttcctgacgtaccctctctactctttatttactagcatgtgttattaaattgtacccattacaggcagcacaaagctaaaagacaaaaatgaaagaagcaacaatgatataatgatcttcaagggtttgataatatcttggaactaaacttccagacactaataataggggagattatttcttttgtttttgtttttacaatctatgcaaattaaaccctattaatataattaacaaattttttcaccattgctacttgatttcctgttcttccttctggattcattttccttcttacagaaatacatcttttagtactttttcagaaagggtttatgagtgacaaatttttctcagactttgtctaaaaccatttctgtttcacctccatgcttgaatgggatgcttgacacttgttttccttagttctgctgtcttcttacctgttgttgctgatgagaagtctctgtcagttattgattttttgttgttaatgatctgttttctgtttgcatgcatgaattttgtttgttcattttcttttgatttccctttcagtggcttttaagactttctcttggttcatagtatccttcagtttctctttgatgtatctgtgtatagaattctttttttctatgatttttttattatactttaagttctagggtacatgtgcacaacatgcaggtttgttacatatgtatacatgtgccatgttggtgtgctgcacccattaactcgtcatttacattaggtatatcttctaatgctatccctccccactccccccaccccacgacaggccctggtgtgtgatgttccccaccccgtgtccaagtgttctcattgttcagttcccacctatgagtgagaacatgtggtgtttggttttctgctcctgtgttcgtttgctcagaatgatggtttccaacttcatccatgtccctacaaaggacatgaactcatccttttttatggctgcatagtattccatagtgtatatgtgccacattttcttaatccagtctgtcattgatggacatttgggttggttccaagtctttgctcttgtgaatagtgccacaataaacatatgtgtgcatgtgtctttctagcagcatgatttataatcctttgggtatatacccggtaatgggatggctgggtcaaatggtatttctagttctagatccttgaggaatcaccacactgtcttccacaatggctgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttacccactttttgatggggttgtttgatttttttcttataaatttgtttaagttctttgtagattctggatattagccctttgtcagatgagtagattgtaaaaattttctcccattctgtaggttgcttgttcactctgatggtagtttcttttgctgtgcagaaactctttagtttaattagatcccatttgtcagttttggcttctgttgccattgcttttggtgttttagtcatgaagtccttgcccatgcctatgtcctgaatggtattgcctaggttttcttctagggtttttatggttttaggtctaagatgtaagtctttaatccatcttgaattaattttgtataaggtgtaaggaaaggatacagtttcagctttctagatatggctagccagttttcccagcactatttattaaatagggaatcctttccccatttcttgtttgtctgtttgtttgtttgttgttgttgttgttgttgttgtttgagatggagtctcgctctgttgcctaggctggagtgcagtgacgcgatctcggctcactgcaagctccacctcccaggttcacaccattctcctgcctcagcttccctagtagctgggactacaggtgcccgccaccacatctggctaatttttttgtattttttagtagagacagacagggtttcaccatgttagccaggatggtcttgatctcccgacctcgtgatccacccacctcggcctcccaaagtgctgggattacaggcgtgagccactgcgcctggccccatttcttgtttttgtcaggtttgtcaaagatcagatggttgtagacatgtggtgttatttctgagggctctgttctattccattggtctatatctctgttttggtacagtaccatgctgttttggttactgtagtatagtttgaagtcaggtagcgtgatgcctccagctttgttcttttggcttaggattgtcttggcaatgcaggctcttttttggtttcatatgaactttaaagtagttttttccaattctgtgaagaaagtcattggtagcttgttggggatggcattgaatctataaattaccttgggcaatatggccattttcacaatattgattcttcctatccatgagcatggaatgttcttccatttgtttgtgtcctgttttatttcactgagcagtggtttgtagttctccttgaagaagtccttcacatccattgtaagttggattcctgggtatttcattctctttgaagcaattgtgaatgggagttcactcatgatttggctctctgtttgtttgttattggtgtgtaggaatgcttgtgatttttgcacagtgattttgtatcctgagactttgctgaagttgcttatcagcttaagaacattttgggctgagacgatggggttttctaaatatacaatcatgtcatttgcaaacagggacaatttgacttcctcgtttcctaattgaataccctttatttctttctcctgccttattgccctggccagaacttccaacactatgttgaataggagtggtgagagagggcatccctgtcttgtgccagtttccaaagggaatgcttccagtttttgcccattcagtacgatattggctgtgggtttgtcataaataactcattattttgagatgcctcccatcaatacctagtttattgagagtttttagcatgaagggctgttgaattttctcaaaggcctttttggcatctattgaaataatcatgtggtttttgtctttggttctgcttttatgatggattacgtttattgatttgtgtatgttgaaccagccttgcatcccaaggatgaagccaacttgatcagggtggataagctttttgatgtgctgctggattcagtttgccagtattttattgaggatttttgcatagatgttttattgaggattttcgcatagatgttcatcagggatattggtctttttttgttgtgtctctgccaggctttggtatcaggatgatgctggcctcataaaatgagttatggaggattccctctttttctattgattggaaaagtttcagaaggaatggtaacagctcctctttgtacctctggtagaattcggctgtgaatccatctggtcctggactttttttggttggtaggctattaattattgcctcaatttcagagtctgttattggtctattcagggattcaacttcttcctggtttagtcttgggagcgtgtctgtgtccgggaatttatccattttatctagattttctagtttatttgtgtagaggtgtttatagtattctctgatggtagtttgtatttctgtgtaatcggtggtgatatcccctttatcattttttattgtgtctattctatccttctctcttttcttctttactagtcttgctagcagtctatcaattttgttcatcttttcaaaaaaccagctctcggattcattgattttttgaagggttttttgtgtctctgtctccttcaattctgctctgatcttagttatttcctgccttctgctagcttttgaatgtgtttgctcttgcttctctagttcttttcattgtgatgttagggtgtcaattttagatctttcttgctttctcctgtggtcatttaatgctataaatttccctctacacactgctttaaatgtgtcccagagattctggtatgttgtgtctttgttctcattggtttcaaagaacatctttatttctgccttcatttagttatgtaccaagtagtcattcaggagcaggttgttcagtttccatgtagttgagtggttttgagtgagtttcttaatcctgagttctagtttgattgcactgtggtctgagagacagcttgttataatttctgttcttttacatttgctgaggagtgcttttcttccaaccatgtggtcaattttggaataagtgtaatgtggtgctgagaagaatgtatattctgttgatttggggtggacagttctgtagatgtctattaggtccgcttggtgcagagctgagttcaattcttggatatccttgttaactttctgtctcattgatctgtttaatgttgacagtggggtgttacagtctcccattattattgtgtgggagtctaagtatctttgtaggtctctaaggacttgctttatgaatctgggtgttcctgtattgggcgcatatatatttaggacagttagctcttcttgttgaattgatccctttaccattatgtaatggccttctttgtctcttttgatctttgttggtttaaagtcccttttatcagagactaggattgcaacccttgcttttttttgttttccatttgcttggtagatcttcctccatccctttattttcagtctatgtgtgtctctgcatgtgagctgggtctcctgaatacagcacactgatgggtcttgactctatccaatttgccagtctgtgtcttttaattggagcatttagtccatttacatttaacgttaatattgttatgtgtaaatttgatcatgtcattatgatgttggctggttattttgctcgttagttgatgcagtttcttcctagcatcgatggtctttacaattaggcatgtttttgcagtggctggtaccgattgttcctttccatgtttagtgcttccttcaggagctcttgtaaggcaggcctggtggtgacaaaatctctcagcatttgcttgtctgtaaaggattgtatttctccttcacttatgaagcttaggttgactggatatgaaattctgggttgaaaattcttttctttaagaacgtcgaatattggcccccactctcttctggcttgtagagtttctgccgagagatctgctgttagtctgatgggcttccctttgtgggtaactcgagctttctctctggctgcccttaacattttttccttcatttcaactttggtgaatctgacaattatgtgtcttggagttggtcttctcgaggagtatctttgtggtgttctctgtatttcctgaattttaatgttggcctgccttgctaggttggggaagttctcctggataatatcctgcagagtgttttccaacttggttccattctccctgtcactttccggtacaccaatcagacatagatttgatcttttcatatagtcccatctttcttggaggctttgttcatttctttttactcttttttctctaaacttctcttctcacttcatttcattcatttgatcttcaatcactgataccctttcttccacttgatagaatcggccactgaagcttgtgcatgcatcacgtagttcttgtgccatgattttcagctccatcaggtcatttaaggtcttttctatgctgttcattctagttagccattcgtttaatcttttctcaaggtttttagcttctttgtgataggtttgaacatcctcctttagctcggagaagtttgttattaccaattgtctgaagccttcttctctcaactcatcaaagtcattctccatccagctttgttccattgcttgcgaggagctgcgttcctttggaggagaagaggcgctctgatttttagaattttcagcttttctgctctggttgccccccatctttgtggctttatctacctttggtctttgatgatggtgacgtacagatgggattttggtgtggatgtcctttctgtttgttagttttccttctaacagtcaggaccctcagctgcaggtctgttggagtttgctggaggtccactccagaccctgtttgcctggatatcaccagtggaggctgcagaacagcaaatattgcagaactgcaaatattgctgcctgatccttcctttggaagcttcgtctcagaggggcacccagccatatgaggtgtcagtcggcccctacggggaagtgcctcccagttaggctactcgggggtcagggacccacttgaggaggcagtctgtccgttctcagatctcaaactccatgctgggagaaccactactctcttcaaagctgtcagacagggacgtttaagtctgcagaagtttctgctgccttttgttcagctatgccctgcctccagagatggagtctacagaggcaggcaggcctccttgagctgcagtgggctccacccagttcgagcttcccagccactttgtttacctactcaagcctcagcaatggtggatgcccctcccctagcctcgcttctgccttgcagttcaatctcagactgctgtgctaacagtgaatgaggctccgtgggcgtgtgaccctccgtgccaggtgcaggatataatctcctggtgtgccgtttgctaagaccattggaaaagcacagtattagggtgggagtgtctcgattttccaggtaccatctgtcatggcttcctttggataggaaagggaattccccgaccccttgcacttcccaggtgaggcgacgccctgccctgcttcggctcatggtccgtgggttgtacccactgtccaacaagccacagtgagaggagtgagaggaacccagtacctcagttggaaatgcagaaatcacccatcttctgtgtcactcacgctgggagctgtagactggagctgttcctattcagccatcttggaacctcctctctggatttctttttaatttgtcctctttgaaatgtgctgtccctcctgaatctgagagctcaattcttcctttagttttagggagaggtcttccaatagctcttcaaatactgcctctcccctattttgtctattctctacttctggaactcctgttagatggtttcttatctcatcctccatggcttttcatctctctcattgttcccatctctttgtctatcagggctgtctgtttttcagtttcttggacctgtcttctggtttataaactctattcaaataatgtctactctgctgcttatccttaattttttaaaatttcagtgactttttcacctctaaaagttatgtttctctctttcttaaatcaatcagttatttgttcataggcttcgattctttcactgtggtttcagtttctttgatgtcttcaataatttccaacatgcttattttagtgtctcagattgtcctattaactcaaattcttgaggtgctaattttcctatttgttgtgtcacctgactctccctcatggtcaatcatttcctcatatagtttgtaattttttattgtgaactcatctttggggtttgtggagattttgttgtctttgcttttcctgtggaagttccttgtgccctgggttggagaaatattacccttgggaccaagttttcacttcatttctacctggactccaagagtttcactaattcccaggctagattatgcattaatttaacagtctgggatttcctcaccatgcagatactgtaaatttggacttcacatccacatctagcacaggatcggggtcccagtttctcacaggggattttcttttttcccccacccagagccctagcagcaagcttccttgaagcccctctctgccagtggacaaccttttgcagtcacttttcatgaagaaggcatttattttagaggccagccttatgaaagtgaaggacaagactcaattgtagcttcctctctgtgtcttgtttttctttttctggaagataacgttaataatagcaataattactgcttattgagcatatgatgtattctacatactgttctaagcacttcacatgtagatttcaattgattcttacaatagccttagaaggataggtgctatttatgatctcccttttacagatgaggaaactagacccgaagaggtaaaaatcacacagcttggatttgaacccaggcttatctgtctccaaagctcactcctttaaccactatgtgacacagcttttctggctcaagattatccatctttcagctttcagggaaaatttaaaaaacaaaaaataaatagaagattatccactgtgcagttactggatggattagcaaaaaatattgaaaagcatccagtacagaattgatactgaaaaaatgatagctctgattgttattcaatgttatagtgtattattgattgcaatgttaggtgattaatgttagaatattcataaaggctggtgaatggatgggttggtaaatgctgctgtcttcaattggagttgcacactcagggtgtttcaaacttctacagggcagctcagttctggcaccaaaccaaatccccaggtctactcgaggctcctcaccagtggctgccaggagggcgagcataaggcctgcttcgcagagctgcggaggaacttcatgaacattcgccctgtcaagctgaagaacctgattctgctggtgaagcactggtaccgccaggtgagttgcccctggctcctcccaggaagccaccactgtcatggcaaccaccccagccaatcagttcctcctctacacccacatctcccctcctttgcttcttattggtcatccagagcagaaggaccggcctcctccatcctccatttcctgcccagatctggaagccactgttagaaaaaaatctcttctccatcaagtctaaagtcttcatttcttgtacctggggttcactttagcccatccacttctctcttttgacactgcaaatgttttctctgtttttcccccacctccaagccgttgcttatgatattacccccaccacatgtctatttttagaaaagaaaactcccctttctggaagcctagagctggcaatgaccaccatatggtaagggcctgtccaagacagaaaaaccagagcacttgaacagaaaagatctgaacagaaaagctgatgactccttatgggcttctggatcaagctgtgcctgaaagcagatctactccaaggcttttgggttacatcagccaatacattctttcatagccttttttttttttgagaaagtgtctccctttgtcatccaggctggagtgctgtggcacaattacagctcgctgcagcctcgaccttctgggctcaagtagtcctcctgcctcagcccccgtagtagctaagactacaggcatgcactactacacctggctgatttttgtactttttgtagagacaggagtcttaccatgttgcccaggttagtctagaacttctgggctcaagtaatccacccaccttggcctcccaaaatgctagaattacaggcacaagccaccatgccccagccttgttgcctcttttgagttgcactaaattctgaacatccttcggagctcccttactaaatacttctctgaattctgacttgtattcatgcatccctatattcaacaaacatctatcgagcacctgctatttctaacttgtgatggacactgggataccaagatggatacattgcagcccctattcctgtacaaccaccccatgttatgtgattaatgttaaaatattcctaaaggctgctgatggatggattcgtcaatgcttccgtcttcaattagagttacacactcaagatgtttcaaatttccaatttccttgaggggagacactaggcaaaagccacgtctgagctctcagtctcactgtatgaccttagacaagtcactaccctcctctgaacctcagtttacccacctgtaaaatgagaagcatcagcaagtttctattctttctgcgcttctattttctatattcccttcctgccccaagtgcttatggccacactcagctcacatccactaatcactcatctttggttggccttgtgtgacacaggttgcggctcagaacaaaggaaaaggaccagcccctgcctctctgcccccagcctatgccctggagctcctcaccatctttgcctgggagcagggctgcaggcaggattgtttcaacatggcccaaggcttccggacggtgctggggctcgtgcaacagcatcagcagctctgtgtctactggacggtcaactatagcactgaggacccagccatgagaatgcaccttcttggccagcttcgaaaacccaggtgaagacccgcttccctttgcctggcttcattatcctccccctccccactgtcaccctggagtcagtcatccaggaggagtccaaggtagggtttggggtggcaatcccactcctcactctgcttccctctggactctttgctgaggaagtgtggacataaggagtcccaaaagaaaccagggccagttttattagcatgataaaatagtatttctcagttgaaggggccacccaatagctttccaaccaaggcagccaattgagatcgcttctgcacttgggcaagactgagccaaccctgaggtcctgacactctttccagccctcacgccccttttcagcccttccacccgcctcctctttcactgactcccaccttccccacccaccttcctgctgtgcccccagacccctggtcctggaccccgctgatcccacctggaacgtgggccacggtagctgggagctgttggcccaggaagcagcagcgctggggatgcaggcctgctttctgagtagagacgggacatctgtgcagccctgggatgtgatggtaagatggagggtcctggggggcagggggccctgcaccctgccttctagtcaggttcccttaacctgccggtgcacccatccccagctgctaggagtgttggtggctgacaactcatagccaccccttctctggagacttgcctttcatgaaatgcacagattgctacgtcccagccagtgcctgagtgacacagggttacaaaaagcctaactctgtctccaggcggaaccgattctgtgatgcaactcacgttccagcgctccctgtggaatcaggcaaacacttgtctccggctgagcacccagctttgctgagcctcttctctgccctctgctgctgtccttgttccacttctcctccaagcactgccccaattaatcatatgcacaagaattcctgccatggaccctgcttctaggaaaactgagacataagccacttgcagctcccaaaaggatatgattttatcacatttactattttgcagcagggtctcataaccagcatttaatactcaggacaatccattgagacccggacttcattattgcactcatttaaacatggggaaactgagactgtgtattgatgctggaaccaaaattcaatctcaggtccttctgatgctacctcagaacctacccaccagctgagaaggaaagagggacatgggagacagtgggagtcttgtcctcagaggacatcaaggggcagggcttgggtgagcactgggagtcccgtctcaagctggccccacctggattctctctgcagccagccctcctttaccaaaccccagctggggaccttgacaagttcatcagtgaatttctccagcccaaccgccagttcctggcccaggtgaacaaggccgttgataccatctgttcatttttgaaggaaaactgcttccggaattctcccatcaaagtgatcaaggtggtcaaggtgagtcctcagagagctgtaggcaagcagtgtcctgcaagctggtgatctctcccagcccagggccaggcttgacccacttccgccctcgtagcaaacagcaaaaagccaggcatagagaaagagctggaaagtggtcatgggaggatggcagagagagggcccagatatgtccaacaagtctcttttggttgctagtgacacctaactcaaaagacacaacaaaggaatgtattgactgatgtaactggaaagtcctgggtagggctgcttaccggcatagctagatccaggagcccaggcagcatcatcaggactcagtttttctctccagttctcggttctgctttttaatgtcttggataggcccttaacatatggtggtctttggcagctctaagcttccagaaaggggaacttgttttttcttaaaattcaaataaaagtcttggaattgagtctcattggcctggcttgggtaacctaccaacccccaaactagttactggggctagggagacattatgctctggatggccaagactgggtcacatggtgaagtggcccccgcctagtcctcatgggctgagtgtggggtaggagtggtccctccaaagaacaccaggatgctgatcccaggtggaaaggacgctgggggtgtacaaaaggtcacactgtccacggccctggatacagcctcagtccacagttggagagacaagtgagacccagatcagctcagaaagagtgttagcataaagccagccagtgaacagtgccagggatgctggtttgctgtgtgaccataggcatgtaccttcccctctctgatcctcacgttcctgatttctaacacttgaggagagtggcttggatcactggctctcaactctggctcccctggcttgaccttggaattacagttttttaaaaatatgctgatgcccaagccccaacccaggaaaacttaaatcacagtcttgtggggtgggagccagccattagtcgttggtaaaagccttccaggtgcagacaggcttgggagctgcaggcccaaaaaaccaaccaacaaacaaaacacttctcaaatcctctccagtcacaaaacatgatggaatgagaaattttgcatttgttgaagggtttaaacttacctcttgcacgcttctttttcttacaatcttaaatacagtctttcttaccatattaaagatctaacacagagaggttagatgacttgtccaaggtcacacagtaggttttctaactcacagtccagaaccgacaggctaagccatgcttcaagggttgagccacctgccatgtcctctccagggtggctcttcagccaaaggcacagctctgcgaggccgctcagatgccgacctcgtggtgttcctcagctgcttcagccagttcactgagcagggcaacaagcgggccgagatcatctccgagatccgagcccagctggaggcatgtcaacaggagcggcagttcgaggtcaagtttgaagtctccaaatgggagaatccccgcgtgctgagcttctcactgacatcccagacgatgctggaccagagtgtggactttgatgtgctgccagcctttgacgccctaggtgaggtgccctggcgtagacctgagagggggaaatacagaggcagggccgccatgggcagttgtagaggttgcacagtacacaaccaggccacatctgttcgcatcattgcaggcattgtagttgtgtatgttcatcacaactttcctgcaaagtatctaaagaagagggcccctttttctaatttgcgcaggcactctgtgggctaacagtggcctcaagctgggttccagtctgagcaattccaccaacatgctggatgaccttgaacaagggacttccccgtcctgagccccagtgtctttatctcacatctgacagtaaggacactgatgtttcttgcacattcccagctttgaatggtttgtgtgccacccacctcctccacctgctgcagatccattcattcagttcattcaatacatgcatctactctgtgcccagtgctcttccaggcaccaaaaataaagccttgaacaaaatagacacaactctcttcatatcttttcaactctcagtttgattagcagttttcagagtgagaaattcccttgtatccgaatttatttggtttctgagtttgagggagcaggtggccaagggagggattcatgcagaatttttttttaagagacagggtcttactttatcacctggcctggagtgcagtggcaccatcatgactcaatgcagcctcaaactcctgggctcaagtgatcctccagccccagcgtcctgagaaactgggactacaggtgcacaccaccacacctggctaatttatagaattttttgtagagatggggatatgactatgttgcccaggctgatctgaaactcctggccacatatgatcctcctgcagtggccttcgagagtgctgggattacagacgtaagccactgcacccagcccagaaatttatctgaatctactcagttcttcagttcagagagcaagaatttggatattaaggaatgcctttaagtgcaatgtaaccagaatggtgatgtcaactccatacacagctctgttacctgcaggaggatgtaagactgaggcctgccctccctcggttagacagaaagataagtaagtattagagaggtgttaaagacaggctagctcccagctgagactttttccaagataggtaagcagatggtttgaaagggagcagaaaagggaggatgactgtcaccagggatttaatgtggatcaggccacatctgtgttccacctaaaaacaccctgtggcctcccagtggatcccagaccacccttaggaaaacacccaagaggtaggagatctcagaagtcctttctaagttggccccactgggacaacatgggagccggagtgatggtaaccatctccccatctccaggccagctggtctctggctccaggcccagctctcaagtctacgtcgacctcatccacagctacagcaatgcgggcgagtactccacctgcttcacagagctacaacgggacttcatcatctctcgccctaccaagctgaagagcctgatccggctggtgaagcactggtaccagcaggttcggcacatggataggccaccttcctaagttgccctgggatctgcctctggagcactttcctgggaggaagcagggcccagccctggccaagatcctgggttggtggagcagagcagaaagagtgctatatctcagctgtgggaccttagttttcttatctgtaagatgggggtgataaaactatgtcacaggatgtgatgggataatgcatggcaaggcatctggcacatgtaggtgctcaataaaagttttggggttgctttgccaagtccagaataatcccttctgtacctcatcagtgccaatatgaaccaacatatctttcttctcgttctccagtgtaccaagatctccaaggggagaggctccctacccccacagcacgggctggaactcctgactgtgtatgcctgggagcagggcgggaaggactcccagttcaacatggctgagggcttccgcacggtcctggagctggtcacccagtaccgccagctctgtatctactggaccatcaactacaacgccaaggacaagactgttggagacttcctgaaacagcagcttcagaagcccaggttcaggtctacccccaatgttccagaatttcaaacctgggatcactcactctccccactttctagattgcagagcagagatgggaaaacactcttcctagaacggattccttcctagaagttatatttgtagtacctgagggacaaacggtcaattttctggtcacccaggaatagggttgccagataaaacgcaagaccccaagttaaatttgaatttcagataaacaatgaataacttcttagtataagtatgctcgatgccatatttgagacataattacgcttaaaaatttattcactgtttatctgaaagtcaaatttaactgggcatcctggttttttgttgttgttgttgtttgtttgtttgtttttgtcacccaggctggagtgcaatggcgcgatcttggctcactgcaaccctccgcctcccgggttcaagcaattcttctgcctcagcctcctgagtagctgggaccagaggcgcatgccaccaggtccagctaatttttgtatttttagttgagacaggggtttcaccatgttggccaggctgatctcaaactcctggcctcaagtgatcgcctgcctaggcctcccaaagtgctgggattacaggcatgagccactgtgcccagccttgtatttgtatttgttaaatctgaccaccctacctgtgaacccacccaggtgccataagcatgtttcattctttgggattttgcctacctctgaaatgggtacagagataatagagatgcttttgcaaactcaagatgcatctccagtcagtggggagtggctacttagaatgatgtgttgaaaaagcttctaaggttgtgatttgactcagctggaaagagtaggctaaccagctagtagtgtccaaaggttgagcatcccaaatgcaaaaattcaaaatctgaaaatggcccagaatttgaagctttttgaccaccaaaaaatatgctcaaggaaaatgcttattggagcattttggattttcaaattagggattcttaactggtaagtaaggcaaaggtccaaaatctgaaaaaatttgaagtccaaaacacttctggtcccaagcattttagataagaaatactcaacctgtatcatggatgcaggaggggagagttgtggaaccagtgttgtgattgattaacaatgcctcccctgaataaggaaggggtaagcggtagcaccgtggttgattagtaatgtttgcctgaatgcagaatggcaaagtggccatgtgtgtcttattttctatacctgccctgtagtgtataggagcactgaggaatctctgagccctggctctagcccctgcaaagtgttagataaaaggggaaaatagtccaaccagtgccacaggtggacacctagatgttgccaggaataagactgtccctgggtgggaattgcaggcctatcatcctggatccggctgacccgacaggcaacctgggccacaatgcccgctgggacctgctggccaaggaagctgcagcctgcacatctgccctgtgctgcatgggacggaatggcatccccatccagccatggccagtgaaggtgagagatctgtggtgccaaaggaagtaccctttaggggtaaggggggagcatggtcaggggagggacatgattcccactaaaggggcagggcccagtgatggccccaggtatgcccctgtgcttccattttcccatccggctgtgtggtctcagcttctgcagaaagaatggggttaccaacatctcttataatacttccccaggctgctgtgtgaagttgagaaaatcagcggtcctactggatgaagagaagatggacaccagccctcagcatgaggaaattcagggtcccctaccagatgagagagattgtgtacatgtgtgtgtgagcacatgtgtgcatgtgtgtgcacacgtgtgcatgtgtgtgttttagtgaatctgctctcccagctcacacactcccctgcctcccatggcttacacactaggatccagactccatggtttgacaccagcctgcgtttgcagcttctctgtcacttccatgactctatcctcataccaccactgctgcttcccacccagctgagaatgccccctcctccctgactcctctctgcccatgcaaattagctcacatctttcctcctgctgcaatccatcccttcctcccattggcctctccttgccaaatctaaatagtttatatagggatggcagagagttcccatctcatctgtcagccacagtcatttggtactggctacctggagccttatcttctgaagggttttaaagaatggccaattagctgagaagaattatctaatcaattagtgatgtctgccatggatgcagtagaggaaagtggtggtacaagtgccatgattgattagcaatgtctgcactggatacggaaaaaagaaggtgcttgcaggtttacagtgtatatgtgggctattgaagagccctctgagctcggttgctagcaggagagcatgcccatattggcttactttgtctgccacagacacagacagagggagttgggacatgcatgctatggggaccctcttgttggacacctaattggatgcctcttcatgagaggcctccttttcttcaccttttatgctgcactcctcccctagtttacacatcttgatgctgtggctcagtttgccttcctgaatttttattgggtccctgttttctctcctaacatgctgagattctgcatccccacagcctaaactgagccagtggccaaacaaccgtgctcagcctgtttctctctgccctctagagcaaggcccaccaggtccatccaggaggctctcctgacctcaagtccaacaacagtgtccacactagtcaaggttcagcccagaaaacagaaagcactctaggaatcttaggcagaaagggattttatctaaatcactggaaaggctggaggagcagaaggcagaggccaccactggactattggtttcaatattagaccactgtagccgaatcagaggccagagagcagccactgctactgctaatgccaccactacccctgccatcactgccccacatggacaaaactggagtcgagacctaggttagattcctgcaaccacaaacatccatcagggatggccagctgccagagctgcgggaagacggatcccacctccctttcttagcagaatctaaattacagccagacctctggctgcagaggagtctgagacatgtatgattgaatgggtgccaagtgccagggggcggagtccccagcagatgcatcctggccatctgttgcgtggatgagggagtgggtctatctcagaggaaggaacaggaaacaaagaaaggaagccactgaacatcccttctctgctccacaggagtgccttagacagcctgactctccacaaaccactgttaaaacttacctgctaggaatgctagattgaatgggatgggaagagccttccctcattattgtcattcttggagagaggtgagcaaccaagggaagctcctctgattcacctagaacctgttctctgccgtctttggctcagcctacagagactagagtaggtgaagggacagaggacagggcttctaatacctgtgccatattgacagcctccatccctgtcccccatcttggtgctgaaccaacgctaagggcaccttcttagactcacctcatcgatactgcctggtaatccaaagctagaactctcaggaccccaaactccacctcttggattggccctggctgctgccacacacatatccaagagctcagggccagttctggtgggcagcagagacctgctctgccaagttgtccagcagcagagtggccctggcctgggcatcacaagccagtgatgctcctgggaagaccaggtggcaggtcgcagttgggtaccttccattcccaccacacagactctgggcctccccgcaaaatggctccagaattagagtaattatgagatggtgggaaccagagcaactcaggtgcatgatacaaggagaggttgtcatctgggtagggcagagaggagggcttgctcatctgaacaggggtgtatttcattccaggccctcagtctttggcaatggccaccctggtgttggcatattggccccactgtaacttttgggggcttcccggtctagccacaccctcggatggaaagacttgactgcataaagatgtcagttctccctgagttgattgataggcttaatggtcaccctaaaaacacccacatatgcttttcgatggaaccaggtaagttgacgctaaagttcttatggaaaaatacacacgcaatagctaggaaaacacagggaaagaagagttctgagcagggcctagtcttagccaatattaaaacatactatgaagcctctgatacttaaacagcatggcgctggtacgtaaatagaccaatgcagttaggtggctctttccaagactctggggaaaaaagtagtaaaaagctaaatgcaatcaatcagcaattgaaagctaagtgagagagccagagggcctccttggtggtaaaagagggttgcatttcttgcagccagaaggcagagaaagtgaagaccaagtccagaactgaatcctaagaaatgcaggactgcaaagaaattggtgtgtgtgtgtgtgtgtgtgtgtgtgtgtgtgtttaatttttaaaaagtttttattgagatacaagtcaataccataaagctctcacccttctaaagtgtacaattcagtggtgtgagtatattcataagatttatacttggtgtctattcataagacttatatccagcatattcataactagagccatatcacagatgcattcatcataataattccagacattttcatcaccctaaaaggaaaccctgaaacccattagcagtcattccccattcctccaacccattctctccctaatccctagaaaccaccaatctgctgtgtatttcatctattgccaacatttcatataaatggcatcatacaat

SEQ ID NO: 2654 - DNA, 18951 bp, Homo sapiens
  source 1..18951: mol_type = genomic DNA
cccagtgaattatttttttattttgtagagacggggtctccctgtgatacccaggctggtcttgaactcctcggctcaagcgctcctcccacctcggcctcccaaagttctgggattacaggtgtgagctaccacgtctggcctgggataactcattgtaaaactggtgaagacctgggaccttcccagtagacaatgggacagagtgattgacaggatgagttctggagtacatggcagaaatgtacagagaagtctcccagagaaaactaactggctggaaacagagcctctcctttcttcttcgagaggatgagagtgtcactgtcttggatgccatagatccccagacccaaccagtcctgcaggacttggccttggaattccagctgctgctgctttttaggaagcccctgctggtcttcaatctgctgcttcagacccaggatgaagctgttggggttgatggcataggcgtagctcccaccatcaggattcttcacgaagacctggatctcggaggggatggtctccagcagatagatgtgagtgtgggagaagatcccatatttggctaaggagcacctgctgctgagaagctgcctctcactgccaggaacctggaaggacagacgctgcaggccagagtagcccctggtcctccggattttctctttaaccttccttatgggctcataagggttcacgatgaggttgaaatctgggtaacccctctgctccactgtcaagtggatgtctcgtgccctctggaagggagagggagaaggagaggtgttaagtccacacttctttgtctgatgtgcaaatgttcccttcatctgtccttatctttacaatagtagcagcagcagcggcagcagcaaatgtttagggagtggtaagcactttccaggctgtatgctgagcaccttccatacccttaatgcattttattctcagagcatctctattagttggttggttctactgttacccccatgttattgatgaggaaactgagcagggttaggtaatttactgaacaccaatcacataggtagtaaggagcagggcagatatgtgaagtgaggttggtcagactccagagtctgtgttctcaccacctccagaggctacactccagggcctgagagccccaggtggctggagagcacctggaaaatgctggcgagggtcaggcctctagctgattctttccagaagaaatataagccttggctgggtgcagtggctcacgcctgtattcccagcactttgggaggccaaggcgggcagatcacttgaggtcaggagtttgagaccagcctggccaacatggcaaaacctatctctaccaaaaaatgcaaaaattagccgggtgtggtggcgtatgcctgtagtcccagctactcggaaggctgaagtgggagaatctcttgaacacaggaggtggaggttgcagtgagctgagatcgcaccactgcactccagcctgggcaacaaagggagactctgtctcaaaaggaaaacaaaaaaagaaaaagaaaaagaaatataagcctggcattgccaagttttctgactagccaagataaaaaatatttgcacaatgttgtgtgtgtttgttttgttttttgagacagggccttgccctgtcacctcaggctgcagtgcagtggtgcaatcttaactcactgcgccttgacctcccaagctgaagcgatcctcccgcctcagtttcctgagtagctgggaccacaggtgcgtgccaccacatctggctaagttttgttcttttttttttttttttttttcagatggaatctcactctgttgccaggctagagtgcagtggcacgatcttggctcactgcaacctccgcctcccaggttcaagcgattctcctgcctcagcctccctagtagctgggactacaggcacatgccaccacacccagctaatttttgtatttttagtagagatgaggttttaccatgttggccaggatggtttcgatctcttgacctcgtgatctgcccacctcggcctcccaaagtgctgggattacagatgtgagccaccgcacctggccaagttttgtatttttagtagagacggggtttcaccatgttgcctaggctggtcttgaactgttgggctcaagggatccacccgcctcagcccctcaaagtgctgtgattacaggcgtgcgccactgcccccagcctacaatggcttttatattcaggaaaaatccagaggcgtatattttccagcccatgggtgggcctcctcatttggccagcgggtccccccgtttatactctatgtaccttactggagcctctgattctgcttctgccttctgctccaagcagttcagtctcctgtcctgtacacatcttgctcatcccagcctcccatcctttacccctcatcatcctttgtcctctgttctgagtgtctatatctccccccggcctttagggctcatttcaactcctaactttttaaaggaatcttctctggtgacttcagttaacatttattctgcttccagacccccagagcccctggttctgctgcctcttagcagagtgcccttagttaattaacctctctgagcctcagttttctcttctgtaaaatggcaataatagtaatgatgataataataataaagatagtgataacactcgaccttcttactttacagaattgcttatgaggatcaactgagacagaccttggacaagagctttgcacactagaaagtgtgatgttaataaaatagatttttgtgatctctgcctatactataggtttggcatcatataataatatgacttagtattttttgtttgtttgtttgttttcagagtatcttgtcttctctggtaattctagcagttttgtgtaagtttgtttcatggatttgcttcctgacaacatagggtgagttctctgagagtgagggtggtgtcttttttttttctttttttcttttttttttgaggcagagtttccctcttgctgtccaggctggagtgcaatggcacgatctcagctcactgcagcccccagctcccgggttcaagcgattcacctgcctctgcctccggagtagcagggattataggcacctgccaccacgcccgcctaattttgtatttttttagtagagatgggttttttccatgttggccgggctggtcttgaactcctgacctcaagtgatccacctgtcttggcctcccaaagtgctgggattacaggcgtgaaccaccgcacctggccgagcgtcgtggtcatgtcttatttctgtgcctgtgttgtcccccagcccacatcccctaccccatccctgagaacagcactggcacagaatggctgattgagctgacttggctggacccaactcacgcaaagaatgatcaggaacacagaactgattctccagtaaattatgggaaaaagaaaggaaaggagaacaagaatttgaaggtaagaaacccaaggctctgagagccaaagaatttgtccaagttcacggagcccatgggtggtgcagctggcccttaaacggtgactctaaagttctgttctccatcaacacagaactgaatgagtaaatactgagtagtttatctgtcgttctgaccttcaagcccttgacagcccagagaggagccattaccttcacgttccagctggagatggggttctccctgttgtcatagcaacagtcctgtttcaggcactgggaggccctctgagcaacgatgtcccatctgtacccttctgccacgttgagggtggggtcggccggatccaggatgatgggcctgtaacacaggaaaagggtgcccaggctcataatggtttgaaggccttcaagccagaaaaaaaccttctcggcaattatttcgtccagccactgagaattgtgatatccacatcccggggatgttcaagagggccccaaaacaccgcaggagagtaacaggatggagacaatgctatttccaagaattcctatctgggccaggcacagtggctcacgcctgtaatcccagcactttgggaggctgaggcgggaggatcacttgaggtcaggagttcaagaccagcctggccaacgtggtgaaaccctgtctctactaaaaatacaaaaaattagccaggtgtggtggtacgcacctgtcatcccagttactcagaaggctgaggcaggagcattgcttgaacccaggaggtggaggttgcagtgagccaagatcatgccaccaccctccagcctgggtgaccgagtgagactgtctcaaaaaaaaaaaaattcttcttctttgggatagtgccttaagtgtttgcaaggaatttagggggagaatgaggccccaagaggcatgctggagtaataacagatgccctttcaggcagggggggccctgtaccttcggagcaggttttgcaagtttaagtttaaggttagagctgctgaattactttggatagtagaaacaccactgccaccaactactgacatttattgaagcacaaggccaaatcctatgcagattaacctattttaatcttacagcaattctataaggtagggactgttatttttattgtttattgttgtggttgtcccctttttacagacctccctaagttcctttttttttttttttttttttttttgagacagagtctcgctctgtcgcccaggctgaagggcagtggtgcaatctcggctcactgcaacttccacctcccgggttcagccaattctctgcctcggcctcctgagtagctgggattacaggtacccgccaccacgcccagctaatttttgtatttttagtagagatggggtttcaccatcttggccaggctggtcttgaactcctgacctcgtgatccacctgccttggcctcccaaagtgctgggattacaggcatgagccaccggtgcccggcctagattgccctaagttcttacagccagtagatgggggctcttacccatctacctcctcaacagagcagaggttgggctgcccccaaaagtctctcctttctataaatattgaataaatattttaaagaatattggcttgaaggggatcttgggcttgcttattaacttggggtgactgcaagtccatgattaacaccagctctttgagtggggcgcagtggctcacgcctataatcccagcattttgtggggccgaggtgggcagatcacttgaggtcaggagttcaagaccaggctggccaacatggtgaaaccgtgtctctactaaaaatacaaaaattagggcatggcggcaggcgcctgtagtcccagttacttgggtggctgaggtgggaggatagcttgaacccaggaggtggtggttgcagtgagccaagatcgtgccactgaactccagcctaggtgacagagcaagactccattaaaaaaaaaaaaacaaaacccaaaaacaaacaaaaaaaacccagccctttgtactccagggcttgggagggagctgcgacttcatctgtgtaatcgaatgtgacacaggctactggaatgaactggactttgggctccaggctggctcctcccaaccctgactgctccctaaaacagtcctgcctgaaagtgccaggctgtcctatggggtggggtcactgatctaaagtggctcattctgttggctggcaggtgacccaacacatggggtctgtgtcccgtgaccaggaatcagactggttctctctggggtttggacatggggatgatggagatcccttatacctgggaggcagaggggagccggacaggtgtggagagagaagcagaggctgaggggaaaagtgctgtagttcatgagagagagtgacagagagagagagggagtctcaggtcctgatgctttctcgatttttctggccatggttataataaatcctcttttcatgagcagacctggcttttcttccttacaaaagagacccaatactacataacagaacactaaatactgtgatgttgcttacacaggcccagagcttctaacacagagagttgtctgggttgggcttcccctgaagcagatccccagataaggatttggcttatttggaaagtgatcccaggaagcacaaataagggagtgagacagtgagacagataagggaaggcagacaacaaagagtgggtattgaagtaattactactgtggtccactggaggcgatctttaggaaagagtatggaatggggcccagtgcggtggctcacgcctgtaagcccagtactttgggaggccaaggcaggcgcatcacctgaggtcaggagtttgagaccagcctggccaacatggcaaagcactgtctctacaaaaatacaaaaatcagctgggtgtgggttgtaggcgcctgtaatctcagctactcagaagcctgagggaggggaatcactcgaacccaggaggcagaggttgcaatgagtggagattgcgccactgcactccaccctgggtgacagagcaaaactctgtcttaaaaaaaaaaaaaaaaagttacgcaatgagacccagattccttccatcttttgggtgagggagctgtggtatttatccaccaactcccaccagatctggtggagggctcttctcagagtgggtctgctggcaaagggatgcaggtgctgacagctggaagtggaaccaaccttccctagaacggtaaaggccgagaggatatgaatgggacgctgacagcacatgctccaatataagcatttactcagcatctgccagatgctagatattgtggatccttaacacagattttctccaacccttacatcaatcctatgtcgtaggttccagtttactcctgtcttatggataagggattgaggctcatagcagtaggaaaatggctgagctgggatttaaacttgagtctccaagattctttccattttcccatgctagctcctacaaagcactgaaatggtcttcagagagcaagaaggccaagctaaggtggagggtggcttaggaaacaaggaacaggcttctacccgccccatggccccccagtgactttgataagccaccaacttgagatgccagctgtgttggtgtgggaggtcgatgctcaactatggtggcagccttactgcttaatacagccaatccataaaactctatgccacgttacactagcccgtctctctttttttctgtaagatttggtgggcaaacagtggtccagtacctctcttttttgagctgttttctgacacaatcctcaatgattgcattgtggagtgtgtagtacttggtccagtagatacagatgacttcatactccaggagcaggtccatcacagtggtgaagccttcgtccaacatgaaattctcgtcttcttcagtacccatttcccaggcatagatggttagaagttcaagagcatagagagggggcagattggctctgggggacctggctttcacatactgttgaaagagatgggaagacagagagagagagaccctaagattctgtgtaaggatggcgttggaccagaagctgagaaatccaagttctagtcctggctctgctgcctactggctgtgtgaccttggccatgtcacattccatctctagacataggtttcaccattttagaattaaagggctgagttagtccattgggcttcaatatatgctcaacagatgtaactcctggaatgaacttatgaacaggtatgagcagattgcgctcggtcacaaacattctagcctaagcagtcccatttaaatctattttaatgtattgagctgctgagaaatgtttcttaaaagaaaggaaaggtttccttagatagagggaaaaaatggtaataggtgagattctgtagtgaagattggggttgcctctctagcagacattctttccttccccattgcatagtagccatgatgtttggaaggggttgacccccacccgcagctccaggatgggccctgactggcacagtcctatcagcataaacctttcccccttgcaagtgattgcttcaagagaaggcatgcgatctaagttggctcaactagagtaaagcctagttcttttgttcagtggttgaaagaagagaagtcctcccatgtgtgaatatgagggcaggaatagttgtggccattttgccaccaagagggaaacaagccaaaggaccaagctgacatatagaggaatgagaagctgagagaattccagagaaacagagccagtgccctcaccagtgcctgaaacccgccccccccgcccgccccccctactgtttaggggttttcctacataagctgataattccctttattgtttaagccagtttgagttggtttttgtgtttttctcttacttgcaaaaggaagcatcttaactgacagtggtcacttcctgtgttaagaatctcactgaggccgggcgcagtgcctcccgcccgtaatcccagcaccttgggaggccgaggcgggtggatcacttgaggccaggagttcgagaccagcttggccaacatggtgaaaccccgtctctactaaaaatacaaaaattagccaggtgtggtggcaggtgcctgtaatcccagctacttgggaggctgaggcgggagaatcgcttgaacccaggaggaggaggttgcagtgaaccaagatcatgccactgcactccagcctgggcaagagtgagaacttgtctcagaaaaaaaaaaaaaaaaaaaaaaagaatttcactgatacattgatatttagccagaaagtgaaaaattttggtcaaatattcagtagtttgatttgtggaagtaaaactgacatattttcctatggccatcatatatgaatattagctcccatcccaaagtcagaggagaaaaaaaaaagctataacactttggccttgaaacaaacacagaatcatcttgtataattctcatctcccaaataaatgaaaccttgggcctttcctataggtcactgacttactaacaaaaaaactttatccttgaccttagaaattcaattttgaattaaaatgtatttataaggctgggctcagtggctcacgcctgtaatcccagcactttgggaggccaaggcaggtggatcacaaggtcaggagatcgagaccatcctggctaacacggtgaaaccccgtctctactaaaaatataaaaaattagctgtgcatggtggcgggcacctgtagtcccagctactcgggaggttgaggcaggagaatggcatgaacccgggaggcggagcttgcagtgagctgagattgcgccactgcattccagcctgggcgacagagcaagactctgtctcaaaaaaaaaaaaattataagttaattaatttgttttgtaactttttgcaaattcatccttaacactcaattttgtaaaccataactaataacattataattttgttagaaatttaaactcatggtaatataacttattttcttcaatattagtgaaatgttacattcttaaaacttagatgatatataaaatgtaggatgcctgtaatctgtaagatgtaagccttagtgaatagataaaaaaaatacccagctcaacttacttcacctccggggctcaagtgatccttcctcctcagcctcctgagcagctgagactacaggaacccatcaccacccccagctaatttttgtatttttgtattttttgtagagacggggtttcactatgttgctcaggctggtcttgaacccttgggctcaagtgatcctcctacctcagcctcctaaagtgctgaaattacaggcgtgagctaccacatttggccggtaattgttttttctttaaatccctgttatattttattttattttttgagacagagtcttgctctcttgcccaggctggagtacagtggcgcgatctcggctcactgcaagctccgcctcctgggttcacaccattctcctgcctcagcctcccgagtagctgggactacaggcgcccgccaccacgcctggctatttttttgtatttttagtagagatggggtttcactgtgttagccaggatggtctcgatctcctgatctcatgatctgcccacctcggcctcccaaaatgctgggattacaggcgtgagccatcatgcccagcctattttatttttattggatcaaatctttccttctgctgtctgattcccttgtaacttctctgcaagttctatataataaatgatttttgtctctgagttctgttttgcagttggagtttccgttatctcggaggaagattttgtttccaaaactgactgagctgctgcctgagaaatgtccctgagggctgtttacactcacacatgccctcttttcgactcctggggtggaattaaagaaatccttccccttgttagtccttaacctgctgtgacgaatggccacagtacccggcgaagctgacatctgccaggcctagactgtaattgaagggtaacaagaacatgtggggtgggtgtggtggctcgtgcctgtaatcccagcactttgggaggccaaggtgggaggatcgcttgagaccacttcgaaaccaggctggtcaacatagtgagaccctgtctctacaaaagaaaaataaaaaaaattagctgggcatggttgtgcatgcctgtagtcccagttacttaggaggctaaggtgggaggatcacttgagccagggaggtcttgatccagggaggtggaggctacagtgagtggtgattgcaccaccgcactacagcctgggcaacaaagcaagatcctgtctcaaaaaaaaataataaaataaaataaaaataactagtttactgaaatactgtagagcacctatttttctccttccttctctgtttctttctcctcttcctcctcctctcctccttttccaccttcttcactgacggtttcactttacatttcaaaagactagcattctctccctctctacctgcttccatttcccctggctgcagcttcctgagatgaaaatcaggccctgcctttcctcctcaccctcttccctctccttgcccctgccatcctggcagccccctcacctgctggtaccagtgtttcaccaggcgcaggaggctcttcagcttagttggccgatgtttcacgaaatttctctgcagctcgctgaaggatgggcagaaatttccaggaccaccgcaggccttgatcaggctcacatagacctcagggggtggctgggagttgggaagagaaggccctgaggagtgaaggagcaaaggaagagattggggattgaggaagccagagggtggtaagtagtattttggggagagcctgcctttacattggaagtatccctccagggacacttgagacctcatatcttcagaaaccaaaggtttgccttgtctaattgtcctttttgtgaaattcttactctggagaaccaacattgggctttccatgcatcagacccctccctggatgtcctcaatgtccctcattttctttaatatctgttttgtatctctttcaatactcatagggaggccgggtgtggtggcttaagcctgtaatcccagcactttgggaggccgaggtgggcggatcacctgaggttaggagtttgaaatcagcctggccaacatggtgaaatcctatctctactaaaaatagaaaaattagccaggcatggcatggtggcgggctgtaatcccagctactcgggaggctgaggctggagaatcacttgaaccctggaggtggaggttgcagtgagccgagatcacggcactgcactccagcctgggcgacagagcgagactccgtctcaaaaaatatatatatatataaactcatagggagaaccaggaaccagttccatggtacacatcactgagacatcccagcactctcttccttgctaaaatcagatcctgtctcttataccttctccaaagagcaactccacgcagccagccactacagctgataggagttagcacatgagatgaaacctctaggatctgggcttgcagcatgtaggttttacttcaaacacctaggactctgcccgaggacaaacaacaggggccagtgagttagtgctcccaaagcagcccccaaccagtgacggctgggaagctggtgagtaagcacgccagcgtcccacttgggatcccgaagaggttcgctccataatgggactgtgagttctcccaggacatgaagctcagggtggtgacttgcccatggacgcacgttgtattgaattcttgcctttcccatctcagttccatacttccctaccggtgtttcctgggaggaatacccaaataaactgcgtatcctcacatccatgtcttaggatctgcttctataaaatgcagtgacagacccccactcccacttttagctccttcccctcactgggtgtcagagcctcctgaatgttgtttccccagaaagtcacttcctgagcaccctttctgtggttacccaggccaccccattctttttctctgagcatttacaccatttgcaatcatgtttttttgtttgtttttttgttttttgtttttttgagacggagtcttgctctgttgcccaggctggagtgcaatggcgcgatcttgactcactgcaacctccgcctcctgggttcaagtgattctctgcctcaccctcctgagtagctgggattacaggcgcccaccaccacacccagctaattttttgtatttttagtagagatggtatttcaccatcttggccaggctggtcttcaactcctgacctcatgatccacctgccttggcctcccaaagtgctgggattacaggcgtgagccaccgcgcccaggctgcaatcatgtatttatctctgcaattctttggtcaatttctgtattccaagttgagcaatatgatagccagagttgagttaatcctgtgcactgcaataacccagccccaagcataggacacagatgaaatgaataaatgtgggtgtgtgcacgtggccatgagtaaaggtgagacactgggaagtctcctggggtgggcaagtgtgtgagtcgggtgagcttcccctccccttacccagggctctgtaggcaggcacaatggtgaccgtgatgggctccgcagtccccctggtctggatggtgaagacgagagcatcggggactctctgctccatcctcaggtcctcgagcccgaggtccagcaggtcctggctttgccacatggttttccatatcagcctcagaacatctttgtgatgcttggctgcctcctggaagctgtggaaacagctcagaaacgccaccagctccacctctctggtgctcctgagaaccgtgccattcccgaaggagcccacctgcagaacacagagccccgtcaccctgaggcccactgccatgagccaggcaacccctgcggcacttcacatgcactgtctcactgaatgctcaccacccgctgagggatgggttgtgggtagtactaatacccacactttacaggtgagaaaactgagatgtctggaggatctcgagacatgggatggagaaatggggcagcctgaaaaagatcttgacacttccctgtttcttagctaggtaaatgttctgactcctaagaccttcatctctaaaatgaaagcaatggcagaatatgagtcactgggctactgggaggatcagatgaaataatgtatgccaagggtttggtggggtgcctggcacacaggaagtcagcaacacatttgtctttctcctcattagtcatttgtctcaggtctcgcagtttgcagccctcagagcccagactctttttttttttttacacagggtttcactcccgttgcccaggctgggctgcagtggcatgatcttggctcaagcaatcctcccacctcagtctcccaagtagctaggactacaggcctgcgccaccatgcctggctaatttttgtattttttgtagtgactgggttttggcatgtcgcccaggctggtctcgaactcctggactcaagcgatttgcccccttggcctccccaaatgcccagcttcttatctactacactgcattgcttctgagacccagtcttcttacccacagagtaaggcctactccagaggaatggtagcatctactccatagggttgtttgaggattctgggggtggtggtggggctgaataatttcatgacattataaagcaaggagcaagtttgcctggtggatttaagagccataggctgtgaaatggagcagcctgaaaaagatcttgactcttccctgtttcttagctgggtaaacattctgactcctgagaccctcatctgtaaaatgaaagtaatgttggaacaagagtcactgggctactgggaggatcagatgaaataatgtatgccaagcgtttggtggggtgcctggcacacaggaagtcagcaatacatttctctttcttctcattatccagctgacttagacaatctcttctgctgccggggggtcagttttcctgttagtaatggaaggaggtcgagaagggatttttcgatgttttgagattctagatgagctctccaggccctggtgcctctggtatgcaaagcgccacaactctctggcctcctctccttctcattctgtgttgggaggtggaattgctagggaggcatcagacccccagaaggctacttttcttggtggttggagtcactgcacaagaatcagattccagctgttgccggatgatataacatgccctgtgtgacatgagcacggatgctggatgacatgagcacgccctgtgtctggcacccataagagccctgtatacatattattccttttaatctttacttcccagccaggcatgatggctcatgcctgtaatctcagcactttgggaggccaaggtgggcggatcatgaggtcaggagttcgagatcagcctggccaacatggtgaaagcacatctctactaaaaatacaaaaattagccaggtgtggttgtgtgcacctgtaatccgagctactggggaagctaaggcaggagaatcgcttgaacccaggaggcagaggttgtggtgagctgagatctcgccactacactccagcctgggcgacacagcgagactccatctaaacaaaacaaaacaacaaaaaaaaacgccttcacttcctgtattgaggtgggtactaggagaattatctccaatgtacagatgagaagactgaggcagtgaggagcttgccatggtctcccagccagaaggcagcagagtcagagaaagagccagaactcaagtaggggatggttcttccgcctctttcttcctcgtgacccaaggctgtgagccaggccctgcttccaagggaccatgggcattcagacccagcacctccaccccctgggagagggttggagatggcaccctgtgtgtgaatgaaggacacattccccccgaaggccagtctagacttccctttctttttgagacagggtcttgctctgttgcccaggctggagtgcaatggcacgatcttcactcactgaagcctcgacctcctgggcttaagcaatcctcccacctcagcctccggagtagctggaactacaggcatgcaccgccatgcccagctaattttttatatatatttttgtagagtcgggggtctcaccattttgcccaggctggtctcgaattcctgggctcaagcaatcctcccaccttggcctcccaaagtgctgggattacaggcgtgagccactgtgcctggcgtagacttccctttctgcctttcccactggtaagatccaggcagagagaaaagaacacatccagaacaggcttcctgatttgcttcagttttaaacctatttaagcacaattcatttgaagacgagcattcccttatgtggaccagctccgctcactagattttcagagggtggggaacgggagggtttagactctaaataagatatattattcctcattagtcatggctcactggggattgctaccatttagtggtttcaagaggaaaagtggctatgatgtgcaggaagtatttgaggcttaggtaaatagcatttcctgccgtaaaaactcattcttggccgggcgtggtggttcacacctgtaatcccagcatttggggaggccgaggtgggtggatcacttgaggtcaggagttcgagaccagcctggccaacatgatggaaccccgtctctactaaaaatgcaaagattagccaggcgtggtggaacacacacacacacaataaacttattcttgtagcatcctcctcttaccagacattccttattccctccactttattctcaagtttgttggggagggggtggtctaggagggtctgccagagtcagacttgagtcccaggcccagaagaaagcttggcaagaattataatgatgcttctgtttctgagcatttatcgtgcatgaatcattcagcctgcattgcaccactggcttggtgagggagagatgatgatgatgccccaatcacagatgaaaagaatgtgggtttgagaaagaagagtgggaaggtcaaaaccacacagctggtaaaggaagaagcgaagagtctgtctaatatcaaaatttgtggtttctcacttataaattgtatggcctcaggcttcatatgctggggataggtgcaaagaacggataggggcccagggcttctagatccctctgtgagttggttgcccctagagagagaacttgagcactgggctgggagtcaggggtcctaattctagtcttgcctttgccaccaactcgctgtgtgaccttggggtatctctcaccctctctgtgcctcggtttacttaattttttaagtgagtcattggtgagactgtctgattctccaaagtctttctagctccgaccctcttgaattttgatcttagctagcacaggcggtggcatgaaacagctggaggaagggcttgggggaaaatctcagtgaggggggcttgggtcccttgagtcaagttcaaatcccagcttcaacactgtgtgaccttgggcaagtcacctcacctctctgagcctccattaaaaaatcattttaggccgagtgcagtggctcactgtaatcccagcactttgggaggccgaggagggcagatcatgaggtcaggagatcgagaccatcctagccaacacggtgaaaccctgtctctactaaaatacaaaaaattagccgggcgtggtggtgggcgctgtcgtcccagctacttgggaggctgaggcaggggaattgcttgaacctgggaggcagaggttgcagtgagctgagatcgtgccactgcactccagcctggtgacagagcaagactctgtctcaaaaaaaaaaaaacaaaaacaaaaatcattttattggccggccagacatggtggctcacacctgtaatcccagcactttgggaggccaaggtgggcatattcttgatcccaggagttcgagaccagcatgggcaacattggtgaaaccctatctctacaaaaaatacaaaaattagctgagcatggtggtgcatgcctgtaatcccaagctatttaggaggctgaggatcacctgagctcagggagattgaggctacagtgagtggtgattgtgccactgcactccagcctgggtgacagagcgagaccctgtctctaaaaaaaaaaaaagtcattttattatcaaaaagttaaaacacatagaaaaatagatgatacaactaacactcatatacccaactagttgattcaacaagtctaaattcctggctacatgtgcttaatctaagccacgttaaagtaaattataggcaccaaggaactttgtccctaaaatacttcagtgttcgtgtccaaacaaaagacaaccttctgataaccacaaaactactgttacacctaacaaaatcaacaatgatttcccatatcagatatatgtactatctgatatctaggccagttgtccccaaactatattttacagatggttcattcacactaggatccaaccaaggacctcgcattgtattggttctgagcctccatttgctaatctgtaaactgggcaaagaatagtacctatctcacagagtgcaagaattagagatagtgtatgttaagaggttagtccagtgagcccccaaatgtgagctattattactagactcattctactcaaggcagtggtgcagtggggtgtagacagctaggtgggatggggtattctgagatgtcatcagcatgggctagggataaggaggacaggggtccccagcatccccagggacgtggactctgatactgggttttgtcttgcgtgggggctggaggagcccagtcttaccttgactaccttcagcacccgcacatcctggtccagcccacgcttcccctggaaatgctcctgcctcagaaactcctccacggtccgcacagcgtctagcacctcttccttccactcccggtggggctgcagccactgagccacgaaggagtccagcctggaggctggtgtgctatacagttcctgcatcagtgccatctctgtcccgagagtaccgctgctgggcagatatatagccaggctcctacccagctccctggcacacacctccttttttaaggtagctcctcctcagctgccctccagtgctctgtgggaggagggaccctagcagagaggaaaccaggtgtgacgggctgactccaggtcccccttcttggagacacccttgctgcagtaggggcacaggaggactctgggctgaggctggaatatctggggccaccttaacaggctggccgtctagtca

SEQ ID NO: 2655 - DNA, 18951 bp, Homo sapiens; identical to SEQ ID NO: 2654
  source 1..18951: mol_type = genomic DNA

SEQ ID NO: 2656 - DNA, 18951 bp, Homo sapiens; identical to SEQ ID NO: 2654
  source 1..18951: mol_type = genomic DNA

SEQ ID NO: 2657 - DNA, 90351 bp, Homo sapiens
  source 1..90351: mol_type = genomic DNA
actttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatgatttgcatatgcagtttttctttagctatgtttttttttttttttatactttaagttttagggtacatgtgcacattgtgcaggttagttacataggtatacatgtgccatgctggtgcgctgcacccactaactcgtcatctagcattaggtatatctcctaatgctatccctcccccatccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtgtttccagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggataaaatactggcaaaacgaatccagcagcacatcaaaaagcttatccaccatgatcaagtgggcttcatccctgggatgcaaggctggttcaatatacgcaaatcaatgaatgtaatccagcatataaacagagccaaagacaaaaaacacatgattatctcaatagatgcagaaaaagcctttgacaaaattcaacaacccttcatgctaaaaactctcaataaattagggattgatggggtgtatttcaaaataataagagctatctatgacaaacccacagccaatatcatactgaatgggcaaaaactggaagcattccctttgaaaactggcacaagacagggatgccctctctcaccactcgtattcaacatagtgttggaagttctggccagggcaattaggcaggagaaggaaataaagggtattcaattaggaaaagaggaagtcaaattgtccgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagctactgctcaaggaaataaaagaggatacaaacaaatggaagaacattccatgctcttgggtaggaagaatcaatattgtgaaaatggccatactgcccaaggtaatttacagattcaatgccatccccatcaagctaccaatgactttcttcacagaattggaaaaaactacttaagttcatatggaaccaaaaaagagcccacatcgccaaggcaatcctaagctatgtgttcttaaagaggggagtggtagctttgtaacttacagtgaggcttacaccttgacaactgcaagaatgaggatagtggtgagtgaagggagatttgttaattatggcatttccctctattatcgtctaaacagattatattcccactaaagtatgtgtgttggtcctgccagtattagaaaccagaggcttgttggcattgtgtcacacagtacacaccaatggattctcagattttctagggtaaaggtgaaggatggggcagcacttaggttatggtggtttgaaagaaactgaattgctttctaaaccagatgaggatcagagtgcgaaccatggtgaaatatgcatggaaactacagaaagactgaagtgtttcttacggtgttttctgcaaaacgtgattcattaggacattaacaggtattacgttttcaacatatacagcattatgatacagtaagtttggaccaaacaggtattcattccccagagcctttcacatgcacgagaatcagtcattttaacaagaattccgtttctgctgggccacttggatcccttggattcagatgtaaaaacacactgaaatattcctcctttcacctgcttttcagtttgaggtaatcagattgaaaagcaggagttcatgcattttttggttctatttttcctcctctagtaaatgaagaaaataagctatatgtataagtttacattattcttgaaccgctttttaaactagggtttttcatatttgtttttattgatgacaattaaagcaatttaagagacgaagttagctcaaaactcttgcgaatagattttagcatttttgtatgagggaatatggaaaggccaacaagcagcactgttcctccccacaaaaatgccttgggaatataataggcgtacacttcatttgtgtaacttttcctaatgtatttttttttaatttgctttataacggtttcatgtttacctcaattggtacttagtcttaaaatctttctttatacttggttattgatggatcttctgcagctcttatgtagccaatgagacagatgagggctgtcagcttttaagtgacatcttaagctaataagaaattggaatcctcaagtcatttcatgaggctgttaccctttaagacaaataatactttcctcaaatagttcagaaaatttttaaaaggatcacttagagcataagtgtaaaattcttgcttctagtatataatagtgatgttaccatgtcaagtattttggtgaaatatcccctaaaaatgtgtagactacggcacagattgagtatgcaagccttagcttgaatgagactgctgagaagtaaatgacagggatctgaatacttagcaggcttaactttttgcagggaaggaaaggctatgtatgcaaaagaataggttgtaactactgaagagctactttatgctcagaaaccttttattccactttgtatccaagatttcattaaaacattgttccttagagcatactttaaaaactatttggtaaggaatccactgttgaacttcaggtcttaatagcactggctttggtgctaaactgagttgaattccaagcctgttggccattcccagcattgccactgctgtgttagttttctcatctgtaaataactgcctacatctcacagggcctctaatagttaaatagattgtaagctgcacaagcatagggacagtctgtcttttgtaaacctcccatgcacacaataggaaatcaaatattcttgaacaaatgaagtcactaagtgctcattaaatttcattttaaatatatgcctctgttaattcatggatcttggaacttacttaaaagacaatgctttgacggacatttccacattcctcatagggatttactttttaatacaaacaggttcagttaacattgccatacacatctcattacttttgggagtgcttttccagaaatctctggtagtcacgtcacttcatgatggggctacgttctgagaaatgtgtctttgggtgatttcatcactgtatgaacatcacagagtatacttacacagaccctgatgatatgtatatagcctgttacacacttaggctatacagatagcctagcctattactcttcagctatagcactgtacagaatgttactgtaatcatactgtaggcaactgtaacacaatggtaaaacatttgtatatttagacatagaaaaggtacagtaaaaatatggtataatcttatgagaccaccctttatacaatgtcattgaccaaaatgttacgtggtgccatgactatacttgttaagaaggaaaattccagtccttttgacctatggtaggctcaacaatctgtaattttagaaaatcctacaagggattctgatgtggatggtatgagtaccacattttgagatgtctagaagaaaaatcttcaaactccttggcctttttcttccatggaaccatcttctgactaagctggttagtcttctgaactagaaaacctgggtctgggatagaatccaaaatttgcatgtggacagaaaaaaacactgcagcaaacctgctgtaccaaaggttacttattatacttcagtgcttaccattgttttttttactcctttggtttaaggtttgtaaagacatctagctgttaggttgaagtgagctcttcaaatagaccattatatatataagtgttaaaaaagcacatggtctagtccctaaaacagtcatattttattcttctgaacagctacttacaaagtaatctcaatcagtgaaattataaatcatgtaactgttcatgattaaaaggcaagacacagccaagacagtagatgggcaagtctcacataaatacaagaatgtttatagaatgtttagcatatcatgttaatggacaatagttttccgttctctacagaagtatgaatgaaatgccaaagttgaagtcactggttatattcataaccagcttagtgaggatgttgcccactgcctcacatctgtaggacagttgggatatttctgcagagcattcataatttgagtattatccaaaagcagtttcatcagctggtactctctctgtgaatttcctgaagttctttccatgggctttattaattctaattgctgcaagtgttcaaaagcctgaaagatgaaagaaatagtttaggttgaataggagaggagagtgacaactctcctgttctctcccagagaacagttagcattttggtcagctgcagaacagagtactgggaagcaaaatgtaacaacaatcaataggattaaaaaaactctcacaaccccatgaaaactcatattatcaggtaaaacagtgtcagtgcacacttacttgtccatatattgttgaatgtaaacacggcaaactttaattcaatatatacaatatggttttcttcctagcctcattctctatcatagctcctcctagtactttaataaatagtttccagttctctgtaaaaacctaagaatcagataagactttctgatcaattccctaggctactcagatttgcatttatattttgtctgtctctatttttgctttgctatgtaaaaaggtaacacagctgtaacagagggaggcagaaaaagacccttgagtcaactagacatattcagctgatcctgtaagtaaaggattcagcaggctagtatggacatggaggagaagggacaggctcctgtttcctctaagaagtctgactgagactgtcacaaccttcttccatcttccccatcttaatagggctctttcttgtctacttcctcttatccttaatattcacctattatatcttttctaaccttgagtgttgtgttaggtacgttattaggttatgaaaaaaaaaaccattaaatcatgatatactaaccattaaataatgatacactgaaatagattcctgaggattctattatattcttacaactcactgtaaaaaacatcactggaacatattctctatgtatcacataaattcttctgatagagaaacagctcagataccttcatatctgaacatgagaaaatactggaggctgcaggtgttaagagctgaatagaactgtgcagatttaaaacatttctaaatagcaaaatacttcataattgaaaattcagaaatgagcagctacaaattattgagaatttaaatgcaggctgggcgcagtggctcacgcctgtaatcccagcactttgggaggccgaggtgggcggatcatgaggtcaggagtttgagaccagcctgaccaacatggtgaaacactgtctctactaagaatacaaaaattagatgggcatagtggtgcacgcctgtaatcccagctattcaggaggctgaggcaggagaatcgcttaacttgggaggcagaggttgcagtgagccaagattgcgcccgccactgtactccagcgtaggcgacaggagactccatctcaaaaaaaaaaaaaaaaaaaaaatttaaatacttgggtaacctttccattttcacagctctcacaaaataagactattaggggaaaaaaaccctccagtattgtaaaatacttttcctgtttctttgaagaaatggcaatgctctgtactcatttttgttgctacaagaaatgaaattctggttactagggcctataagggatgccaatggacttggggaatccactgttttaaaagtttctttccttaaaatcttcaagagctgcactgtccacgctaggctactgagcacttcaatgtgtgactcaatttttttttaaacttaaaaatggatatttagttctattagaaaattctgagcatgtttagaacaatttcaaaatgtaaatttactttctcagctatacattttatggaatctaaacagcaagaatttccagtaaacatttaggccattgagatgtgcttaaatataatgtacaccaaatgttaaagacttaattcaaaagaatgtaaaataccttactgttcttctataatgattatagaatgacacatttttgatatgttgcattaaatatataattaaaattaaacctttttatttttcttacaggtactagaaaatttaaaactacattacatggctcacattatctttgtagtggacaatggtaatctacatgaagtcctgaagttgtaaaactcatgactcagcccccaaataacactttctctgtatgccctcacaggccaataagattttgtcttttaagtttcttaatggctctaattttcattgttttctccttttactgctgagattataaaagccaatccttgggttggaaagggaaaggttatatcacacactatactgaatagttgttttcgggatgcaagtgctctgaagagacagcagagggcagtatacctccacaaactaaaacaaccggtcacttcctcagatttttccaaaatatttcatttttagataattttcttgttttgaaaaaaatctctataatacttaatgtttaaaaatgaaagtgcaattttaatacataatcaaattggatgtaaaaaatatacttgtctgtagaaaaatgacagcaaactaaatcttaccttcatgacaacaggtttttcaaaattataaacggaatgtgctttcctttgaacaaacttctgaaactctgagtagaaagcaatgacaacattataccttcaaataagcagtggggaagagtcagaaaaaagctacttaagtctcatctcaccattatagaccatttgaaaattaaatggctcttcctcatagatgtcatttaaatgtttcattgctattataagacagatttccaagactgatagacctacagtaaaagggaaaaaaaactatcagtttaatgacatataagactgaaataactgttctccaaagaatacaatatagtgaaagatctatggttctgaggggtgaagaaggtcaagattcttctagatttcaatgtgtttcaattatctatataaatttaagttacttaacctccctgagcttagtttttttcctatctgcaaaataaggatatttttaaacttttagaaatgtcacaaagattggcgaaatattatcaggcactcaccatatggcccacagtaaacaaaataaacttcaattgttatgtgactttaaatcacacagggcctttgcgtaggatttatctagagacttcctaaactcctggaaattatatccaaatctgtgtattccttttttccccggagaggaaaaggttcattacatttggaaaaggaaataacaaacccaaaatgactgaaacccagagaatgctcttcagtagttcttgatacaatgataacatcagcaacacagtcttacctggatttccaatgtggcaaaagaggcagagcgtcaaatttttttttcactttaaatgggagtgatagtacctttaaaaggactaagttaaaggctatatggatacgaaagtattttataaagcattatgcccacgttaattgtaattttaaaaacattccattatctaaattcaaagttttaaaaaccacaatttaaaaaataaggctgggttctcaccatgtacaatatttgctttcgagtccatgctacacagttggcttgcttccattagatctacggcagtcataaatgggtgcgatgctgttactcgatttaaagcaagcatctagggaaagacagatcagaaaaacaattacgtatttacatgggcattttggagatactgtgcaaaacttctgaatttgtatagttaattcttaagggagagtaaatattaatgcttaggaaggtattctcaaattcagttgtattaaaatacagtatttcaatttgtgtgtcacataactgcagatgtaaagcataaaaaaagttcctgctgctctctctaacccatcccagttgcataacttgtttacttactgcttggaagaacaatgtttaaagaggagtaggtcaaggagaagaaactgaaaataattaagaatacttactaataaaagccccaaacacaagcccaaaaggcagatctacgccttacttgttaactttttcaccacccaatcatccagccaggttagtattaatttagacagaagttagctgttttatgttcaattgtacaaaaaagaaaagaaaatagcacatttatactcaggaataactctccttgaaagcacagtctccttctcttgtgctgcttctctgttcaaaaatgaacagaggtcctggaccagagttgctactcaagtatttgaagatttccttccttccttctttatttgtatttttcatgaaagttaaatttggtcatttagggttacaagatttagcagataaaaatgcatgacctctggttaaatttcaatttcaaataaacaataaatagtttcttagtagtatgtgccatgcaatatttgggatataattatccaagaaactctccttcaccttaacaagggcgcaactgattagctgggcagagagtttggcaatccttgtccttcattctcctactggttgggacctagattgccagtgctccctccctttctctctcctttcctttttcctttagttattaattttttaatttttattttttaacttcatttttccataagttattgtggtatgggtggtatttggttacatgagtaagttctttagtggtgatttgtgagactttggtgaatgcatcacttgagcagtatacactgcatcatatttgtagtcttttatccctcgccccactggaaaacaatgtggagattccttaaagaactaaaagtagaactaccatttgatacagccatcccactacagggcatctacccagaggaaaagaagttattatttgaaaaagaaagaagtcattatttgaaaaagatgcttgcatgtgcatgtttatagcagcaaaactcacaattgcaaaatcgtagaaccaacccaaatgcccatcaatcaacgagtggataaagaaactgtggtatatatatactatggatatggataaagaaactgtggtatatatatactatggatatatggatatatatatatatgtggtatatatatactatggatactacacagtcataaaaaggaatgaactaacagcatttgcagtgacctggatgagactggagactattattctaagtgaagtaactcaggaatggaaaaccaaacatcgtatgttctcactgatatgatatgtgggagctaagctatgaggacacaaaggcataaattttttttaacatatacaaaggcaacagagaataataaatatctatgactactttacctgcttaagaaatatgattttagagttgaagcccatctcctccggattggactctactcttccccacataaaacaaccaagtatgtctatactattaggttggtgcaaaagtaattgccattttgggcactgaaagtaatggtaacttttgcaccaacctaatacttctactacatatacatgtattatacaacagagtaattttcaacttttatataaatatattgtatcttcacaactctcttcactgtgaggttttacccatgttgaggcagtatcaattctggtttattcattttttcattatatttctttgtatatatccacgattattcatttcctaatttcctattgacagacatctttcatttctttttttttcccaattataaacaagactgcaataaacaaccttggacatgtcttcctgtgcattaggtaactagactttctctaattagtatgtttctctagttacctaatttgctaaataaattgctctccaaagcacttacacatatttacattggcagcagcaataaatattaatagtcacagtcatgataccatcaagcataatctttaacacccactagattggcaagaaaaaaaaagtttaattgtagtatttctctggttactggagaggctgaaaatctgtaatctataatgagcttccacagtaagacaatgacaacaaataatgggatgagctaagaatatgagtaagcagccctcaaagtagaatcccatatgacaaaaaacaagccattatttaattcattaccatgaattaaaaatgtaatagaaaaatggcagaacaatggccgttaatattgacaatactgaggcagagatattttcccagatggagatgtgtgtgtatatatatatacatacacacatacacacacacacccctcctctaaaaattactagtccccaaattccttcatgatatgctgaaaatggcagtatgcttttgacaatagaagaaaagtaaatagggataaaaagacttaaattcctcagcagaagcagcaatgaggaaagaaaacttgtatataaacatgggtgaaccatacagccaagtaggacacaaacttgaagccagagagctttggattaagtcctggctttgttatctactagtagtgtgaccttcggcaagttacttagctttaaggagcctcaatttctttaggggtaagaataaaaaataagattattccaatggccagacataatataggtactactagcatcaacagtacttggctcatatgccagtccataaatggtagctactgtcattattattctattattattaaaaatgacctttctatgaaaccaaaactatcttgtctttcaaaggtatttgccataattttctagaaatattagactaaaaccaaatactcttagtgaagaaagttaattttcagaacaattaagtacttcttgtttgatattggtattatgtaagcttaagatataattacttggcaaaacatcataaccaggtaggatttattccaggtatataaggctggttcaacactcaaaaaataacataatcaaatatatcaacaggttaaagagaaacatggtcatgcgaaacgatcgagaataagcatttgacaaaatccaacacccatttataagaaactctcagcaagttacaaacagatgaggattacctcaacctgataatgaacatgtataaaaaacctacagctaacattatacttaatggtaaaagtttgaatcctttcttcctaagactgggaacaagaaaggatgtccactctcactgctctaattcaacataacactggaaattctagccattgcaaaaaagcaagaaaagaaataaaaggcatacagattggaaagaaaaaaaaaaccgtcactatttgtgaaaaatgtaatggtctacatcaaaagtcccaaggaatctattaaaaaacctcttagaataagtgagttcagcatagactataagtcaatcacatttctatatattaatgtgtatatatataatcaatcacatattctatatgtaatgaatatgtgggaaatgtaatgaatatgtgggaaaccaaaatttcaaaacccatttacaattgttctaacaaattaaatattggtatacacattaaataagtacatcatctgtgtagtaagagctataaaatgctgatgaaagtaatcaaacaagaaatcaaataaaaggagatatgaaccctattcagagattggaacactcgatgtagtgttccaatgcatgtcgattctcccaaaatttacctacaggtttaatcaattcccataaaaacttaattatctaatgaaagatagaaaatgataaaagtaggctgggcacagtggttgatgcttgtaatgtcagcacttagggaggcagaggtgggaggatggcttaaggccaggagttcgcaaccagtctgagcaacaaagtgagaccccgtcactattaaaaacaaaaacaaagcaacaagcaataaaacaaaactaatacaaaccaatagcatgtgtaatgaccgcaggtttttgctgatattgaaatgcttctgtagtacttcttgcacacttctatcttctgagagatactaaaaggaaaaaaaaaaaaaaagccaaaattgaggaaagatgtagtttaaaacctaaatataatcctgtgccttactggttggtgtaccttagtaactctatctaatattaattcattattaaatagatgttggtcttatttgtagaacactaaaaccaaaataaagtttccagtctactgattttcttatcctgttctttacgttaattcaataaacacaatgataaaacaatcctggctaaccccaaattcgtacttgaataagggaaactactacacagtcatactagtgaaatgaacaaaatgcagcacaaaaacagaagtgcatgagttactgtacctagggatacaaggtaaagtattacaaagaatgcttaaactggatgagacaagagatttaaaaaagaaggaagaacattccagttacagggaacagcatgagtagcaggaaaattatcacattggcagaaaatgagtagtcacgtactggagtttcaattactggcaaagtgaatgtacaaaaagaaaaggcagaaaaacctaactggaggtagctgtccagacaagaggtaaagtgggtcggaattatctgagtgttatgaagaaaaaagaattaagacgtttataggagtacatctggtagagaattaactggtagcagaagagaaggaagggtttgaaaggtagaagataaaaatcaaacatgatctatgggaaacaaaatggcctgtgaaaagtgaaatgtggtcaaaaaatgaatcttggattattaatatttaagtagtaggtgggaaaagagaaaaactaagaaattaagaaagataccaaagactggaagagaatctaagacagagtagagatctagaaaacaagggaacaaagttttaagagagaagtgaggttcaacaatataaactactttgtaaaaagatatatttgagaagaggctaatggctttagaaattcaaagatcaccacagccctttgagaaagtaccatctaaagaggcaagtgactgcagtaattagggttgaatggaaggtgaggaacactggcattgaagaaaagattagatgaaaaaagagtaaattcagaagtagcagagccaagaaaggcctggaaaagattgtcataatttttcaaaaatcatctgcatggaataaggattcttttaaaaaaaaaaaaaagcccagaaaactaagcatttctgtattttctagagctgtaattatatgtctttactttgtccactctaagaagaccagattcagaagtaagttctagtctactggaataaaattttatactctcaggaaatatattatcttaattatagttcccactcccttgctattgtttctagtcttctctttgtattttaaaggacttctggttactatatctttttctatcacaaacacggtagaatatccttggaagtacacagggtgaacataaaaaaaacaaagtaataccttttggaaattaaaaaaaaatttgtttagcttttccagttttaaaattgcaatatggaagatatgtggctaaatatcacaggcaaactatagtcttggtttctgtaatctgtaagttgtaaaagttgatgtggtaaaatcggagcacttaggaaaactaaagaaaatcacctgggacaaaattgaagaaattttctctgcaagaatcaattatttttaaaacctgcatttgcctctctttgacatgatgcttcaaaggttaatcttctatactccaccttcctactttatctctttattttttagtggtttgactccaattccccctctttctaaaagctatcgccttcttgcttctataattacttattctgctttttaaaatgcctaccttatctacatgagccatttaaacaaaaaaaattgtctaacctcgttcattatatttttaattccatcttgattcaaacactatactctatttgaggataaggctattatcaacaaccacataagctacagtactttgggagatttcatttgaggagaataaggtatgattcttttaaatgttcttttcaaaggatccctcttatactgccatgctaagatagagtctactttgcttatttgactcatttgaagtagggctaaaacaaaccttcaaattaggcaggatatcaaggttcaatcttatcctgaagatatttcttggatgagattccatgtgtgacctgttatctgtatcactgctattggcttaatcctgccattcaaaatagcttcctggataatcggcactaagagaaagaatagctcccttaatgcagctaccaccctactccacaaggcagggactctgaccatggtgctgacagatttttcaagtgaagctcattttattcacataccaaagacaggcacaagatgatcaggataggggaagaaaatattagaactcagagacacaaacaccagtgatgctggttctacttaatgaaactgactattaagactatcaaaatgatgacaagacagtgctcacatgcaggggatttaaggtctgcaacaaaagtccagaaagtagattagttatgctactaacacatggttatcattttctaagtcacgcagttatacttcttcaccagtaactcccagcatcctctttatttatagactcaatttgagatgctcagaatgcaacacagttgggaaggaaagtggatgaaaaatggcacagtgcaacctagaccatgtagttaccttaagaagattaagtgtgagcaggtatggaaaaaaaaaagcccatggaaagtacagacatttaaatactatgaaagactacatttgaatctctaaaacagccagaaaaacatactggtggaataagacaatcagttcaggagttgtagaagatgaaagtctgtgaggcactgaaaagtagatctaaaagctgaagatccagaggtctggttcacaccagaccccagtaaaaggggacaatgtgggagtaccaactacaaagaaggtgctcctatagatggaatcctataattagaaatagtatcaaagacacttggtcaggtaattgaaatacccgagtctcaggaaagattgagtggaagggaggatccatacctaattatatcaaggcataatatctgaattttaaagataatgtcagctatttttacatacaattatgtatagttgtattaagaaaaagaacagggaattattaatcataacaatgggaaaaaagtaatataaaaatatgtaggctttgagtcctttatgtaaaaacaacatatttagcatgtatataaactctgcaatgttgtagaccaagtaattattccatagtagaagaaaggagaattgatatagtcttaagggaaacttccactgtttatcatgtattcttttgcactaattacattttgttcaataaacttttatgatattttaaaaaaatgaaatgtgtcaaaatactgcttacatgagcagactatattttataatcaaacaataatcatttaaagaacaaactaaatgcaaaacgcttccaatttagtattagtatttaaaaattcacggtaaaaatacaatctaccactattgctttaaaataaaatgatcctttttatagagtcagtgaatatagactgtgtaattctattcaaagatctaattatccttaccggtattttaacattataaatcagtttttcccaattccttcagagccagggactctatattattttccactctcacgaggccaatattttttgagattctagcataagggacttattcattaatgatgtttttcaattatattattaaatacacacacatatgcatacttcctcctttctctttgccaactgaaactttttgacagcgtaagattaaaatgctagtgtgttgagaatattttaagcacaggtaaatttatagtctcaaaggtgtggcaaatctttaaaacaacatatgaacctgcctttgtatctaagactctcaagtctccagggactgtgagatgtgatcacctattagataatataactggaggtgccacagtctgtactgcctcttaaggcccaacaaaataaaagctgaagttgctaatgaaaactggaagaaaaaaaatatccacacataataggtatgagtcattaacatttatttatcattatttactatttattattattgctaaatatgtaaaatatataaaataaaattatctaaaatataaaccacatacagataaaactaaagcctcattaaagtttacttcaaactaataacataaatcctaaagcttaactgtgatgttcttttgagatagaatttaggagaaatgacatttcaactgtctaagaagaaaatttttaaaaagtatataatttgtattactgcagcattatccttcagcaatattagaaactttgtgttaatttactaatttctaaaatttgtgttttaattgctttaaatcatatagcaaggaacatttagctttattgccttttaagatacctgaacattttcattccacttctcagcaaaaaccttgtctggaaactctgcaggtagagataactgttctttaaatattttaacatactgtggaaaaccaaatgaattcattaagtgtatctgccggtgagaaaatcttgacttcactcttttttctaagagttccaaaatatccttaaaaacaaacagaaatctctataaggaagatgaatgtttttaaaaaaacaaaaacactgtaccaatgttagaggtataagtaaactatcacctataattagtaatgtttagtctacaatacataattaaacatttaaaacattttatgcaaactaaataatccacctccaggcatttgctggcttggtgatgtcatgcctttttcccaccatgttactctcagctaatctgtaacattccaagacccaacatgactgtttaaaaaaactgacaatattgaatagctatatgtcacaataacaccaagagtgtcaataaggaattctgtacattctatgaagaactgagattaaaaaattaatagcatgataggcagcaggaaccaactttaggagaggaaagtggcagaaatgcaacatggcattcgtaagttatcttccggcttttttttttttatagtaatgcttttagactctatttgtatttgtgctatttttccttaaaaagaaatcaggaatcaaatttactgtcaaagaacactaaaaaccaaaggataactaatatgtactgcttgtaaggacatacgaagtgttcttaaatgaagaaaatacttccacaaaactgataggcattcaaactatccaagacatcaaaagcacaataggtaagctgtcttcctaagtcacatatattgcaggaactgtcattcctaaatctctttttaataatgaacttgagcaatttttcaaaatatattatagtacacagcatattatatataatatatataatttatattatatatgtatatatacatctatatatatacagtatagtataatatatatttattacttaagttacactccaaggtatacaaccaagacaaatgaaaccagataaccacaaaaaaagtgtatgtgaatgtttgcagcagtattatttttaatagcttaagaaatataaacaacccaaatgtccatcaactgatgaatggataaacaaagtgtggtatatctacacaacagaatattatttggtaataaaaaggaataaagggctgatatatgctgtaacacagatcaactctgaaaacatgttaaagaagccagtcacacaaaactatacgttgtatgattcaaaaattactaaacagtcagaaagtggattagcagattagtggttgcatagggctggggagggaacaggggatttggggtgatcactaaaaggtacgtggctcttaaactgtggtgataaatgcacaactctatgaataaacaaaaaccctgttaattgtataatttaaatgagtgagttgtatggtataaattacatctcaataaagctgttttaaaaacagtgacatgatatttgatgactttaaggaattacagctaatataacaattatattagggaaatatatttttaaagagctcttatctcctaaaaatacattctaaaatacttactgataaaatgatataatacctagtttttgcctcaaaataatacaggaatgaaaggagatgttgaggataaataaaattagtctgtagtaattgaatcttggcaatgagtggagaagggaattcagggctcattatttattctttcctatgtatattgttgaaatgttataaagatttttaaaaggggagtagtttaagcccagaaatatacatctccacatctagccagatgactctcataatacctacgtgaagaaatcatgatatagaggaaagaattcaagtgatcaaaatgggatcatggttagtttgggaaggtggacaggaaagactaatagcctgaggtaggaggtgggagggtgaataaaaaattttgaatgtttttatgaggtcaaagaaaagtatagtgccagcatgagaactaaaagacaagaaaggttatattcagagattcagatattgtacatttattttctattaagaaagagttctaggtcacccatataggtagacagtggaagtaataatctatacaagcaacaattcagaccctaaatttgggaatgaaaagagatggaagtaaatactgtctttgtagtaggcagtaatgacagaagttggcaatgtgggcatacaggaactagtaaaaacaaaacaaaaccaaaaaacaaaaatggaattactcccaatggggaagaagatgcttgctggcaaagtcactactccctctatacttttgttctctccctataaacgtggatacacagataaaattatacttgaggccaggcgcagtggctcacgcctgtaatcccagcactttgggaggccaaggggggtagatcacgaggtcaggagttcgagagcagcctgggcaacatggtgaaaccccatctctactaaacatacaaaaattagccaggcatggcggtgtgtggctgtaatcccagctactcgggaggctaaggcaggagaattgcttgaaccccgaaggtggaggttgcagtgagccgagattatgccattgtactccagcctgggcgacagagcaagactccatctcaaaaaaaaaaaaaaagaaaaagaaaaaaaattacacttgaaagaactacacagttggagaattatatatatacaataaaaaagaacatctgataacactgctaagaagttactggcattttatttggtccgttattgggtcaacaacactcaccacagccacttccacccaaaggaagatttttttttttttggcaagaaggaggatgcttctttgatccttgtcatcgcctgctgcttttggcaaggaggaataaagatatgtggagcaccagccagtgatgtatgagggatgtttatactaaagccatgtatcataagctctagagcacaggaaaggaggggcaaatgacagtcactctatagagaaacagcactggaaggaggactgttgaaatatgaattagaaaaaagtttcacttttctgaaaaagaaaaagggttgtaggaaaggagatgtgaacatgtaaatgtgcctgacacatctgccgagaatggagggggaagaggattgcaagaaagctatggaggcatggcagtcatagcatgagaaaagagacaactttgctatggtttggatatggtttgtccccaccaaatctcatgttgaaatttaattgccagtgcaacagtgggaagtcactggagtggaccctcataaatagatttaatgccttcttactggagtgagttcttgttctcatggggatagattagttcttgagacagtgagttgttataaattgaggttccaactcctatctggttcgtttttgcacatttcggttccccatttgaccttccaccatgtcatgcagcatgaaaacccttgcaacaaagccagtgccatgcgcttgaatttttcagcctgcagaactgtgagataaataaacttcttttctttaaaaattaccaagtctcaggtattatgttatagcaacacaaaatgggccaaggcactcttcaataccagttttatctgaattcagtaagttaatactacatgcgtgtaagaaggtaaacacaaaaaggcctgtactgctgtccaaaggtacacatggttcaatatgtacagagccttcacaaggcaaagtgatagtgatattgagactatagttaaaatcattctaaaatatcccatggaatgaagaagccactatctactgtcagtgcttggtagaatcttttccatttctggagatgtgtactttgaaagttggaatagtattacttagagttgatttcaagccttttcaaaatatggaaaaaaatcttaaaataaaaactattaccaagttttctcaaatattggtgagatttaaccgcctcattacttgataatgtagaaattatatttattagcataatctgatttcatacttttttcttcagtaatttcactgggaggagggaggtattcattaatgggctaaggtaactactaaactgttttcctcaatttgagttgaaagcaggataaatacaccaggcactgctgaaacaaaatttttaaaatgacctaaataagtgaaaaaaactagcagtgtcagcaattaagcttgaattttaaaatattataatcaatttttttaatgaacagaaagacttaccaatctacatgtaagaccaataactgctattggggtctgtgcagactgagaaatgtcaaaaagattatagagaagtgtttggtttttatgatgagcaaaaagatcaaattcatctaatatgaagatcactgggcaactgctagttcggtcacctaagataaaataagagcattacattaataagaaattatatccacctttcctaaatttccaaaccatttactatatttcagtttttaaaactcaattctgtaaacattctgatagcctactttgggtaggggatttactgatgcatatacgttcattcaacagaaaaaaattattcaaaggacaaacacagccccgactgctctcaagaagttcagtctaggctgggcgtggtggctcatgcctgtaatcccagcactttgggaggctgaggtgggtggatcacctgaggtcgggagttcgagaccagcctgacaaacatggagaaatcccatctctactaaaaatacaaaattagtcaggtgtggtggcgcatgcctgtaatcccagctactcgggaggctgaggcaggagaattgcttgaacccaggaggcagaggttgtggtgagccaagatcgtgccactgcactccagcctgggcaacgagagtgaaactccatctcaaaaaaaaaaagttcagtctaggccgggcatggtgactcacgcttgtaatcccagcactttgggaggccgaggtaggtggatcacctaaggtcaggggtttgagaccagcctggccaacatggtaaaaccccatctctgctattaaaaaaaaaaaaaaaaattagctacttgggaggctgaggcaggagaatctcttgaactgcggaggcagaggttgcagtgagctgagatcacaccattgtattctagcctgggcaacaagagtgaaactccatctccaaaaaataaaaagtgcagtctagttcctagactctagtagagtttgttgttgaaaaatgtcaaaaatcatttaaatgactaaagactattatttttataattacgtaaatataattcttatttaatgattataaaattgacagagttttctatacctacacagaaccaaaacactttaagattaaaatataaggggagtcactaattaatgaacaaaactaatgctttaaaagagagttgtttatttagtagaaatacaaggtacatttcttgtagaaatactttttataaacaaacttgtagattataaagttcaactaaagccacttaaactcccttgaagcacaacttttagcatttcaactacaatgcttttcatggggaaagttccacatcaccctctggttacatttttctcacttcaataatggaaacaactttagtaaaagaatcccttttaccttaggcttaacgcctttatatttgtgttaaaaagtgaaacaaatatctgataaaagaaagacttatttcaacaaataacaaatacagtagcctaaatgacttaatactggtacaaaaccaaagggattactcaaaagtctagaaagagacttatgtactaatatagaattttagtatttgataaaatattgcattatacatcagtggggaaaattagtctattcaaagtcagatccctactttacaggtaaaatcagaataaattccaaacaaattataaattacaaatatatatatatattaaataaaaagatggatcaatgaatgtttttataatctgaaggagagaaaaaactttctagataaacttaactatgtggaaaacataaaactttagatcagcagaaaagtccaaaccaaacttaagggaagagaaaaataaaacacaaaaattccgataaataagcataacataaacattaccacaataggtcaaagacccaacaggaaatacagtcgtgtgtcccttaatgacagagatacgttctgagaaatgtattgttaggtgactgcatcgttgtacaagcatcctaacagtgtacttacccaagcctagatggtatagcctactagacacctaggctatatggcatagcctattgctcctaggctatgaacctatgagcatgtgatagtgtagacaactgtaacacaatgcgaagtatttgtgtatctaaacatatctaaacacaggaaaggtacagtaaaaatatggttttataatctaataggaccactgtcacatatgtggtctatcattgaattaaaggttgttatgtggcacatgactgtacataaaccaggaaatttcaaaggtcaataaaaatatgaaatgacaagcatcaccactatcagaattatgcaaattaagtaaccagaattatgcaaattaaagaacaaaattattcaaattaaactaagagctgaaagtttttctattatatgggcaaacataaaaataataattgtttttgaggttgtgaagaaaaaggtattatcaaatatttttacaaattaaacctttagggtagtttttaaatgttaaagatggtgccttttaacccagaattctacccacagaaatttatcccaggaaatatctggatgatcatcaaagtatctcttcttaattataaaaaattagaaacaaaagcccataattggtgattaataaatagcaccttataaaacaagaaccataaaaatgatgatgcagatcaaaatcttattacaaaataggtaaaataattttattgttgtaaaaaatcacatttatctctatcaataatatactgatataaagatcagtatatcattgaataaagataagaaaccaaatgctaattgagataatcactgttatagtggtgggaatacagtgaacattgtattctttttaatgtttctgtattttatgagagcttttttttttggcaaaagcttgtattacctttataatcagggaaaaaataaagttaaaacagatcttctgaaacggctgaatatgttaatatttacctttttttaaagcttccagaagaaatgaaaggttttcagcaaagcttccctgaacaacaaaatgagataaaatgattaaaagtttagtgaaataaagaacaaaagatggctgtctgattctcaaattttatataaacactgtatatcttctagttattagagtcattgcccagactctgctgagtgtctctatacttcctatctaaaacttaaatacttaagcaaagatggcacatcactgaaaatggcaattacaatgtcatctttgaaattttatattttagaacttgaggataaaacggtcaaagaagaaaaagaaaagtaagaaattttatattttccggaaaaaatctgaaagaatgttaaatttatttgaaggtagttttgtagaattgccatattctaaatatagtttgagacctagaaatggattctactttgtgtcttcaaacacaatggggtcttgcaagtctctaatttgtactggtaaagaaataaccatgaatttaaatgagaaacaaaaagaaaaggcttttttgaaacattagatactataacagtgtttgtctattcaagagtatactgaagaatttatgtatatcatatcatgtttggctatgtttacttggaatatagccaaaacatttttggatactattaaatattcttgatgaaacttagtgtagtagatgcattatccaggtgctccagattgtgggtagaagccccattaaaatatttgtttcattaaaattattaacttttacttcattcagagttcataactaaaagaaacagccaactttaaatttgaggagatataaaggagaaaagaaacacacttattcactctccagttgagagatctaacataaaaatagcataaaggttttaaaactttcacatattgtgatgttgttatgctatttccaaggcaggcagaccaagaggtgttatccataatttaccgtaatataacaaatcctcaaagagacaatctgttgggaaatcagtggtcagttactcaaaggtagcttgtctttcaggctttttgcttaaaagattattacatctgatactaagtatatgcttctataaatacgtatttgtgcatgtataatatacatatatatgtctgtttatatcaaaccagaaaagctgtgggttgaattaagtgacttaggttcttataatgtccaggctctgccattttatgaccttcggcaacctaattatgctctctgagcagaagccaaatttatataatgaaggaattaaactattaatttctatagcagtatttctctattcaagagtacattgaagaatttatgtatatcgtatcatgtttggctatgcttactcggaacacagccaaaacatttttgggtacaacttaaactaataatctctatatatgataataatagcgaagattagaacagaatgataaaaaattgtcatttttattatttcacataaaaccaatatgaatatgtaacatttaaaaatgtcagaaacacctacccagatcaactgggaaccaaaagccaaactgagcatacttaacaagaactgtctttggctcagtataggccactagcttcaacatcacattctaaacaggaggtagaatattagatttatagatggggcattttgaaactgcacttcaaagacctacagactttggaagggacaaatttactcaaccttttagattagattaacattttatattaatatttttatagattaatatattatattaataatttagattataatctataattacatataataaactataattatatataatctattagataattatatagatataacctattatagaattacatagattatataattatataattatataattaataattttatagagtatataattatataattaataattttatagattgattattaaagaaagaaactcataaatgctaggagtcttacacaactatggcggtgtcattgcagcacaaagcacacagttcagaaattagagcgatgccaccgcatggtcaccagtaaccagaaaatgaagttggaatgtgtataatccactccaactgcataagcagtatgaggctaggtaatttcatcatgaaaattcaggtaggtgcaaaattaaattatcatgttttccttaggccctatatattaggtgaaaggtaaaagtttaatacaagtttcaaaacatttcaagtcagtttcttttactgatgttgttcactgccctgagactataagatgatatgataatgaagtatgaataaatttctgaaaacagaataactgacatttgtacagcacattaccatccagcaaattattttttaagttaaatgatgtgtaatgttttctttcttcttcaaaataatcctgtgaagtatggataataaaataacgcccaattaacatgtaaagaatctgaattcagagatacttgttagctcaggattatcaggcagtcaaagggttgtaaggcatgactgaaacccacctattgcagcctcaaatttagcacattttctactatacacaggctactcaagtctcaaaaaagtagaaataggctgctggagcatggtatttttaaaaatgtgttaatctatctccagagatacagaatcaaagtattcaccttacagaaaatgaaataaactcagaatatctacataaacttgggtttcttagctattttacagctactataacctactatggaaaaatccaagtattgtagacttaatgactaaatgtatcctatacattacacatttttatgaaagaatctcatatatttcaattaagaatttctgaacctctccctacccttccagaaatataaaaatatacatggtataaagacattaccttaaaagtctatttaataaaataactgaaatgatacttacaaaaactttatctccaactacattttccagatttaactgccttgtgatttcctttagggcgattttgtcattgatctgcagcagtcctaaaataaagtccatttaaaagtatttaattaaaattaaacatgtatttgatacagcaggttgttttccagttaagtaaatcttcccagtcaaagcctgtgagttcatatcactttcttcttaaaacttagcaataaagacattcggtagaatcaaaaaacaatcctccttgggattagaatgattaaaaaaaaaaaaaccaaaaaacccacaaaaaccagagtccttctgcgactccttcattattattattttaatttctaaaaatactgcatatggtgtgctaagtaaaacatggatctagttttcaaaatctaactattaaaatggatttgaaatatacaagtcatataaaaaccccacaaagtttacataatctccaatggcaaaataatggcatacttaccatttaagtgaacttgtaatacattttcactcacttcttctatttccatgagttctttcaaagcatgatttattaactaaatatgaaaagtttatgaaataataataggtaaaagataaaaataagtccatattcgtttttaaactacaagcagtaagaacagaatataaataaattgacctctttaacaagtaagttttcaaattctttacagataaaaggtttaactagaacatctcatatctgactctttttaagaaacaagagccaggactgatacaatattctctcaatcacctacccgaacttttaatacaaatttagaaacaaccaagttttaaaataaatatttctctacatgtcacattaaacatgtgacatggcccttataaacttcatgtctcagttagtacattacacatctctctgacaattactctactaaatatcattgtaatcagttaaaagcccattgaattaaaggtttctatgaagcatacttttttaaataacattgtattgctcttgtactgtgatatcatacatatctcttcatattaccaatgcattcttttttttaaagaatttgaaaatgaatgtaattaagaaaagccaaaaacctatttaaagagtaaagatggactgttccttccaatattaaaatataggtactatcataaataagtgaactgggaaaagcagttgtatacacaaaatattaatagagatggcatcaaaacttaggacaaaaagtattactcaacgaaggcactgggacaactggtaaactattttccaaaacaaaatactgtttgtatttgcaatatgctacttatttgtcattgcaacaccttatctaaaaagaaaaaagcaaatatgatcctcattttaaattacatatgtttcataacaagacaacaaaaataaaaaaaatttcctgttatacctgcatggtttttaaagcatagggaattccaggtcctctgaaaaggagacaatctcaagatatcacctgtcatactaccagtaatagcccaactgagaagtgacatttaatgagaagtgacatttaatgagaagtaacattaaaggactgcatagaggtacttcttcacctctggatcaggtcagacactataataagagtacatccctagatgatacagagttggtctctcaaaacagtgctttcagcaaaaattttttattttttattttttttgcaatccatggtattttctttcttccatctcttgatattttgcttaatatattttttcctaggttatgattttgttttaattcatacaatgttttatgttttgatgaattattcaaaaccatttcaaatcctttgctaaaaggaatggggattttaataataccttccattttatatatgcataaggagagttgtaacagatttatagctttctttccactcaacttactttaaacaccaacttatgctttgcttggatcagcccactaatattttatgggttgtgtgtatggtctgaaatgataaatatattagcaagtgagtcttcaaataatgttagttctaatctgggtattgctaaaatttattgtttatgcaatcaaccatttaagttagcttttttcttgaatatgttatcatttcaaatatttaaactacattatacactaaaaatatttagttggttattaatatcacactgaccaacataaccaaatttggtcatctcctttccacattctttgtgcctaaaatttaattttacaaacatactaagataattttcttagacctcccaacatccagtaatttttatgctcaccaacttatactattcccaaatattataataaacacaggtttcaccaatatgcaactaggagaaatatcctatttaaccatctagcaaatttgtctacagtaaattgcatgtgtaagagcattttctaagggtcggtacagtgggtcacacctgtaatctgagtgctttgagaggcagaggcaggaggactgcctgagcccaggaggttgaggctttagtgagctatgattgagccgctgggcgccagcatgggtgacagagagcctgtctcttaaaacaaaaaaaggtattttctaggggtcaatctgtcacttgaagccatatcaattttttttttaaataaaatgcttgtaatattataagccacactattgcctttttcaattaactatagagttagcatttttgtatttcagacagtttggccaagtatagtgttttaaatatactataatcttagggttaggattaggggttaaaacaaacaaacataagactacagtcttatgttttaaaatttgaatttatataattatactaatgaggctaggcacagtggctcatgcctgtaatcccagcactttggaaggccaaggtgggtggatcacttgagcacagcagttccagacaaacctggtaaacatggtgaaaccccatctctactaaacataaaaaacttagctgggtgtggtggcacatgcctgtcccagctactcgggaggcaaatgtgggaggattgcttgagcccgcgaggcagaggttgcagtgagtctagatcgtgccactgcactccagcctgggcaacagagtgagactctgtcaaagaaaaaaaaaaaaagaaaagaaaaagaaaaaaattatactatcgagagttattgtctaaaaataaattatatctgacaatttattcaatctatattttctctcaggatactcccacacatacaacaaattacaaaagtagcacaagtcaaacaatgctcatctcttcaacctgccagcatcagagtacatcaggaatatatgaaactatatcaaaatggaatgccatgcaagggactcttccagattccactatagtgaaaataaatgactgcaaggcaccacaatagggctctggtttaaaaagcaaaaagtagataaactgtcagtgtggccaagaataactgatccattttattaactgataaatactatgatttaatgcttttgcctttaaatttcagtacattgattaaacctataggggtttatgaaaaggtgctataacgtggaagggaacaacaagcagattaaaaagattaagttcagatttaaaatattaagcaagatggctgattagagactcctggtgctcgtactcccaacaagaaaggaccacagcaatgaatgaacagctaagatttgactggcgtgttgaagggagagtactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggaaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttccagtactaggggtccatcttcattccaccaagcccacataggtggctgaacacacaactctagctgcacagagactgagcctataattggttatgactctggtcctacacagcaaggaaaccaaccccttgctgccacacttccagccagagaaccaatctggcagtcccacccagggcaaactctcacttgaggtgaccaaaccagggtggggctctctcccaagaaggagaggcccccgagcatccaagcagctgatacaccccttgcactggcagagcggctatgcacccacactcagaacctgagaaacagccccacaataccgtgcacccctccctcccgcagacatacccctagcttgcccagtggtcctgtgcccacaatcagagcctgaaaaatagcccagaaggttacccctggcaggcatgcccccagcccagccgagcagccatgagccatgacctgtacctgagaaacagccctatgggccacccatggtgaatacacctcccacagggtggccaagcatccctgtgaacacatactaggcctgagaagtagcccttcaggccattcttgagcctgccaagcagtcttgtgctcacctcccaaacctgacaaacagcacagcctccctataactccatcagacatgccccaggaccagccaagcaatcatgtgcccacgtcgctaacctgagaagtacacttgccaactgcccctaacagacacattaccctagctggctgagcagcattacaccttaggcctacaaatcagccctgagggttgcctctggcagacactcttttgggccagtcgagcaaccctgctcctacttcccaggtctacaaaatggtccagtgggccatctgctgcagaaaagttcccaggccagccaagcagcagtgtcacaggcctgagaaacagcctcacaggacgcctctagtgggcatgcccataagccagctgaatagccttgtgcctgcatcctaaacctgagaaacaatcctgtggaacccctcagcagatacggccctaagccagtcgaggaactgtatccctacacctctgttgggatcaagcagccttgcacctggatcccaggcatctcctgggcctgagaaacaaaccagtgagttgttcctggcaaacattcaccaagactggctaagcaaccacatgactatgctcctggccacattaatagccccatctgccagtgtgtcagatcccaaggtgattgacccaccatatgcatgcatatgcccccaaactgagaaccagcccagcaaacccaccccttgcaaagctgtacaactgccaccacaaacaactctcagcctaggccactgagacacttgtaaatgacactagtgtggattacagctgaaaaaactacacaaagaccacactactgtatccaactagaaccaaggccaatgaaccacatcaaactgacacctcgagacacattgacacaaatcagtacttccttacgagatcaattctgtaagattggaaaagacaattttacttttctacctgaggcgtatcaatcaacatagggacacattaaacataaaaaagcaagaaaacatgacacttccaaaggaaaacaataattcctctagtaacagacaagaatcataaagaaatacagaaaatgccagaagaatttaaaataataatcttgacaacactcagtgaaattcaaaagaatacagatagaaaattgaacaaaatcagaaaaacaacttgtgattcgaataagaaattaacagagataccataaaaaaacaaacagaaatcctacagctgaagaagttaatgaatgaaatagaaaatacaactgagaccttcaataacagactacatcaagcataagcatttcttaaattgaagacaaattgtttgaaataacacaggcagacaagaaaaaaaatagaatgaagaaagtctacaggatttataagacttcaataagtgaacaaatatttgtattattgtactttcaggaggagaaaagaaggaaaaggtgagaaaaacatatttaataaaaccatagttgaaaacttcccagttcttgagagaggaatggacatccaaaggaagctcaaaactccaaacagactcaacacaaacagaaggtcttctctgaggcatattatagtcaaattgttaaaagtcacagacaaataattaaagcagcaaaagtaaagtgtcaagtcactataagggaatccctattatactaacagtagatttcttcttctttatagcagatttcttttttttaattaaaaattttaaactatcatttttttaaatgatattttaaaacatctttcatccttcttgtttacattttagctgattgtcagaatatacaacagcagatttcttaagagaaacctgacaggacagaggggaatgggatgatacaatcaaagctcagaatgaaagaactgtcagctaagaatataatacccagcagcttcagaaataaaggagaaataaaatctttcacagacaagcaaaaactaaagcaatccgtcatcactagaccagacctataagaaatgttcaagggagtctaacatccacaaatgcaaagatgatgaccaccatcatgaaaacagggaaaactataaaactcactggtactgcggatacataaaggagaaagagaaaggatcaagccttatcactacagagaggcacccaactggaaaaataaatgagaggaagtaagaaacaaaggatatatgaaacaaccagaaaacaatcactaaaatgacagggtaagtcctcacttatcaataataatcttgaatataaaccaattaagtttcccatttaaaaaatacagaacagataaaaaaaaaaactcaattatatgctgctacaagaaactcacctcacctgtatagacacacagacttaaaggtatgaaaaagatatcctatgaaaatggaaaataaaagtgataagaaagttgtaaaaacaaagaacattatataataataaaaggatcaattcaacaacagaatataacagttgtacatataaatgtacccaacactgaaacactcagatgtataaagcaagtattattagatctaaagagagataaattgcaataaaataataggaacttcaacaccctattctcagcattggacagataatttagacagaaaatcaacaaagagacattgaatttgaacttcaccatagaccaaatggacctaaaatacatctatagaacatttcacccaacaactgcagaatgtacattcttctcatcagcacacagaagattctccaagactgacctcatgttaggacacaacagaagtcttaaaacatttttttaaaaaaagcaaaatcctatcaagtatctgatctggccacaatggaataaaactagatatcgataataaaaacaactggctaggtgtggtagctcacacctgtaaccccaacactttgagacgccaaggtgggaggatcccttgagcccaggagtttgagaccagcctgggcaaaatagggagacctggtctatattttttttaaaaagtaataataatgacaggaacattaaaaactatacaaaaatatggaaattagacaacatgcccatgaacaatgggcaaaagaaattaagaatattacagattcctagaaacaaaagaaaatagaaacacaacttactaaaacttaaggaacacacagcaaaagcagaattaagaggcaagtttatatcaatatatgcctacatcaaaaaactagaaaaatttcaaataaagaatctaacaatgcaatccaaaaaattagaaaaattttaaattaaaaaatctaacaatgtattccaaagagctagaaaagaacaaaccaaaccccaaattagtcaaaggaaataaatatcagagaaggaataaacaaaattgagactaaaacaatactacaaaaaatcactgaaacaaaagttgcttagctagactaagaaagaccaaaataaataaatgagaaaagaaaaaggagacatcaaactgaatatcacagaaataaaaaggatcattagggactactatgaagaactatacatcaataaattacaaaacctaaaggaaatggttaagttcctggacacatacaacctttcaatattgaagcaagaagacacagaaaacctggagagaccaataacaaataatgaggtagaatcaggaataaaaagtcttccaacaaaggaaaatccagtactggatggctttgctgctgaattctactaaacccttaaggaattaatgccaattcttctaaaactattccaaaaaattcaagcagagaaaattcttcctaattcgttctatgaggccagcataaccctgacatcaaaactagacaaggacaaaacagcaacaaaaactacaggtcaacatctctgatgaatatagatgcaaaagtcttcaataaagtattagtaagctgaatgcaaaaagatcattcaccatgatcaagtgggatttatcccagggatgcaaggatggtttaatatacgcaaatcaataaacatcatacaccacatcaatagaatggaggccagaaactatatcatctcaatggatgcagaaaaaaacacgtgataaaattcaacatcccttcatgatagaaactgtcaaaaaggtatagaaaaaaaacaccacaacacagtaaaggccatatatgacaaacccaaaaccaacatcacaccaaatggggaaaaactaaaagtttctcctgtaagaactggaacaatacaaggatgttcactctccccattcttattcaatatagtactagatgttcaagccaaagcaatgggaaaggaagaagtcaattcattcctttttgcagatgacataatcttatatatagaaaaacctagagactctaccaaaaaactcttagaatttcagtaaagttgaaggctacaaaatcaatatacaataaccagtactgtttgtatatactaacaacaaactacccgaaaaaaaaaaatcaagaaggcaatcccatttataagagctaccaaaaaaacgtaattactgaggaataaattcaattaaggaggtgaaaggtacagttttgtacaaggaaaactacaaagcactgaagaaagaaattgaggaggatacacacaaatgaaaagacacccatactcacatgatagaaagaatgaatattgttaaaattactatattaccagaagcaatctacagtttcaatgatattcctatcataacactaatgatattcttcacagagatagaaaaaaaatcctaaaattcatatgaaacaacaaaagatgccaaatcgctaaagcaatcttgagcacaaggaataaggctggagtcaacatactgccttacttcaaatatactacaaagctgtagtaaccaaaacagcatggtactggcataaaaacagacatgtagaccaatagaacagaatagagaacccagaaattaatctgcttatcaacagccaactgatttttacaaaggccaagaacactcactcatcagggaaagggcaatttcttcaataaatggtgctgagaaaactggatatgcagaagaattaaactagattcccatctctcatcctgtacaaaaatcatttcataatagatcaaagacctcaatgttaagacctgaaactataaaactactagaagaaaacataggggtaatacttcaggacactagtctaggaaaatatcttatgaataaaaactgcaaatcacagacaacataaaaaaatagacaaatctgctaacatcaaactcaaaagcttctgcatagcaagggaaacaatcaacagcatgaaaagacaatctacagaataaatgaaaatatctgcaaagtattcatctcatagggattcatatccagattacacaaggaactccagtatctcaaaagcaaaaaaccaatttgcttaaaaaacaggcaaattatctgaacagacatttctgaaaggacatacatatagccaacgaatacatgaagaaatgcttaacatcatcaatcatcagggaaatgcaaatagaaaccacagtgaggtatcatctcactccagttaggatgtctattttcagaaaaacaaaaaataataaatgctggtgaagatgcaaaaaaaaggaacttttatacaccattggtgggaatgtaaactagccaatattgaaaacagtacaaaggttccccaaaaaccactacaaatagaactaccatatggtccagcaatcacactactgagaatttatataaaggaacggaaatcattacatcagagagacatctgcagcccgtatttattgttgtactattcacaatagccatgatatggatcaacctagttgtccaacaacagatgaatggataaagaatatgtgtatatacacacaatggaatactgttcagccattaaaaaaagaaatgaaattctgtcattcacagcaacatagatggaactggaagaagttatattaaatgaaataagccaggaaaagaaagttaaacaccatgcgttttcactcatctatggaagccaagaaaagtaggtcttacagaagtcaaaagtagaagagaggatagggtaggaagggtaggaggaaaggagggatagtgagagattcaataatgaacacaaaattacagcaagataggaggagtaagtaacagtgttgtactatcatttttctgtaactataggatgactataattaacaataatattttccaatagctagaagaaggatactggatgttccccacataaataaatgataaatgtttgagatgattgatatgctaattattctgatttgatcactatacactatatgcatcaaaacatcactatatatcccatgaaagtgtataattattatgagtcaatttaaaaataaagtataaaaaggttaattactacctaaaatgactattttatgaaataaatgttttgagctatttaagccagacttagacaagaagaaaagattcttagaaaactgaaatgcaatatcagattagaagaagcaaatgacagcactggcagtaaagaaaatcacattggccatatgacagaatgctgagagagggggaaaaaacatgaaaaagatggtagacatggaaaaatgaaaacaaagatttaagaactgaatattctaatattggatattcattttttctaatcataagaaaaaatgaaagaatattcaaaaataaaagaatattattctttagtgaacaataccctctaaatttatactaaatcagtatgcagagtattagtgaattttatgattaactgttagacatagtctatgaataactaatgcaataaaagaagaaaaggaatagaagtatggagatagggaaggaataattaaaactgtctttgttgacagataacataactgtctaagtaaaaaaatctcaaagaactgacaaaaaaactaatggaattgagaagcaattatagcaaggttgcagaatacaagcaaatatagaaaagccaagtgtttagctatctactagcaatgaagacttagaaaaggaaataaaaaacacagtactattcgcactagaaccaaaaaaatgaaaaattaggtataaatctaacgaaacatgtgtaagatctttattaagaaaactacaaaaactgacaaaagtcttaaataaatagatactccaagaacgggaagactaaatatagttaagatgtccattcttcctattgtgatgtataaatttaactcaaaatctagcaattcacaaagattcccagaattttctggatatgtacaaagtgattctaaagttaatatgaaaaggcaaagtatgcagacagccaacacaatactgcagaagaacgaggtcagaagactgacagtacttaccttaaagactcactaaaaatctacagtaatcaaaacaatgtgatattggcaaaagacagacaaagcaagggaatagaaagagaacctaaaaacagaaccacataaacatagtcaactgatctttgacaaagaagcaaaggcaattcaatggataaaagatagtctttctccaattgggcattcatttgcaaaaaaaaaaaagaaaaaaaaacgaatctaaacacagaccttacatctttcacaaaaattaactcaaaatgaatcacagacctatatataaaatgcaaaactataaagcttgtagaagatacataggaaaaaatctacatgactttcggtttggtgatgaagcttcagatacaataccaaaatcataatacatgatagaaaaaactgacaaattagattattaagatcaaagacttcagttgggcacagtggctcatgtctgtaatcccagcactttggaaagctaaggcaggattgcttgagctcagggttcaggaccagcctgggaaacatggggagacctcgtctctacacaaaattaaaaaaaaaaaattagccaggtgtgatggtgcatgcttgcagtcccatgtactcaggaggctgaggtgggaggactgcttgagcacaagaggccaaggctacagtgagctgtgatcatgccactgcactccggcctgggtgaaagagcaagaccctattcttgtaagtaagtaagtaaaataaataaataaaaactactctaccaaagatacagttaatagtatgaaaagacatagcaacatcccatctcaaaaataaataaataaataaatgaaatcttctgctctgccaaagacaatgttattattaatagtatgaaaagaataatattcttttaatattatgaaataatattaatagtatgaaaagaaaagccacagactgtaagaaaatacttgcaaaacaaaactgaaaatcagaaatataaaggactcctaaaacctatcaataagaaaacaaataacccaaattaaaaatgggcataagacacctcaccaaacatatatagatgaaaaagaagtgtatgaaaagatgctcaacagcatatgtcattagagaattacaagtacaaacaatgagacaccaatatatacctattagaatggttaaaataaaaagtttcttaaatttaaaaatttaaaaatttgaaatttaaaaacatttcacatagccctcttgtgaaaactacccaaaataacagtgaattcaaatgcaaagaaaaaccataataaaaaactcaagaatgaagaaatagtgattatagaagctgagtatgaggactaaaacaaattaaacatagatttgaaactaaaaaattactgcaaatatgattatatataaatgtgacaatttgtgaaatattgaaagaaattacctagatctaaattctcaatttatattaaacaatacttcagatgtgataacagtaaaatcctaacgtactcatcttaataatgtaatttcaatatacattgcttaaatgttaaaaaaaattttgcttctcatccatttttttaaagtacattggtcaaaaattgaaatttattgtatataatacatgagaacagattttacacagactacttagcattgaaattaattgctttcaaaagttaacacccataatttgtctcctatattgcataaaggatatcaaagaaaagagtaaagggaaataagtaagaatatctttttgaggtaactaagcaaatatgataaagagcaaaaggagacaagaatgatataagatgtgagcatgcactgaaaaactgtgtaagttagggttaaacaaatagtaatgatgtaggaaaaataaaaagaatgcatgatatgatagttccctaacctataacaaagggaaaaaccctaccgtgcagtgttgatgtaaagaataaatgagagaacacaataaaaagacacatagtacatgctcaatacatgctattttctttttccactggaaatctctacttctttaaggacaaaagaccatgttggaacaaacatcaattgacaatttttcactaggaggacaaataagggggaaaaaggtctgctacactcaaatataccaccctaagtttataaagttttacatgtcttctgtgattaaaaaagaaaaaaacaaaaaagtaaaacattacaaaataatgaaaagtattttcagtattacataaaataagatttatatatgaatttatttattcttatataaaataagaatcatcacatgccaacaaacaccagaaatcaacagcttttaccatagtttttcctgatcctcggggtccgataataaggacagagttactctctccatggagagcagttcttttcagcagctcacttaagtgtctaaaatgatataaataggacaaaattttaaaaatgaagctggaatactttgttatgttgtagtttttaaaaggcatatttgaatatgcacagaaatttcctctcttctctccctctgggtacttggcctagcttctgaatggtcctaaatagaaaaatacaaaagaaatagtagggcagtattgattctctgaaatcttcaggtgaaaacgtagtcagattggaatatattgatttatacgatagtaggggacaagggacaatagtggcaactctcgggacccttggattcaaatctcttttcctactaatactctggacttttactccatagctggctgctgggtattaagggcaagatggctagaattctctccacagtatcagataacagaaacaaaacaaaattgaaagttaaagtgctattgcattatggaaatatttgtatctgctcctgcttcatgctatgtggtgtttctattcacaaagcaaaattttttatttctataaaagtgtttgttagctttatttaatatcaaatttgtacaataatttttgcaaaacctggaaggcatctgtaagtaggtccataacagtcaagaggacagctagacttacttgtattgtacttgcactccaaataggttactatgtggactctgacgacaaaatctttcacgtaaaattctttgtacctgatgaaaataaagtgaataaatataaataaaaatattacacatgatataaaaaataaataagaaagcacatttacaatagtcagaattaggtattaatgaatcaattcaaccctccctaaattcttatcctctagagttctggcaccattttcatatgttaaaaaattaatggatttcttacctatctcaagtcccataggaagaatgagaatttagttgtgaaggtttcaacaagagggagaatcactgactttagctatattagcaacttaagggccattgtaatgcatgtgaacgagttaagaaaagaattcttgtaagcagctatattttgaggtcatcttagaactaaggccttagacttagtcatgaaaaattatgtcagataatctaccatactctttaaaaagatggaccattaaagtcgttccttttttggatctgcagctaatacagaggtctttcaaggacaacaacctgagggtgctatctcagatttggccccatgaactggaataaaaaggctccaagaatatttgcttctcctagactgacagcatggaactaatccttcatgtaccaaagaagtaaatctgagttcttgttccatgtacagaggcaaagcaaagaaaatgattcattagggacaaaacaatacatacttgttcattatcgaggaagttaaagagtaaggacattggctccagaagagtctattatatgaattttaaaaggttaagtctgttctaaattttaatttctgtatctataaaatagggacaataacatcttatggcaggcctgtttgaaagattaaaaaagggggctggccgctgtggctcacgtctgtaatcccaacactttgggaggtcgagatgggcagatcgcttgaggttaggagttcaagaccagcctggccaacatggttgaaatcccttctctaataaaaattcaaaaattagccagacgtggtggtggatgcctgtaataccagctacttgggaggctgaggcaggagaattgcttgaacccaggaggcagaggttgcagtgagccaagactgcaccactgcactccagctggggcaacagagcaagacttggtctcaaaaaaaaaaaaaggtttaaaaaaggcaattatttgtaacacaaataggctttgtacaggtaatagctaatatctgtaaaaatacataaaagaacatatatatgcctcaactaatcataatgtgtattcctctacctagatgagatcaaaagaaaaaactcaatcttttccttaaaaaaaaaaaaaaaaaaacccagaaaacctcattaaaatatcttagaggcagtaacggggtataaaatataagctagataaagctacagtgactagtcagaaggttcacaaatctcaaagtgatctggcatagaagttaaataggtatacacatgtattgatattaagtcagctgtacatggaggattcgtgcactttacatacaaaggtatgtaaagcatatttcagttaaaaatttttttagaaagagagttaaactacttccttcaaaaagaaagccaagtcgtataaaagaataccagtaacacttaatttttatttaaaaactacatggagttcaggtcaagctagataaatacaaatgccagggtagaaataccatgctcatttccctactaatctataagcttcttaaggaagagacatacagatagatgctcagcacttggaatacaatatacacttcttataacattcattataaaaacactcaacagatgaggaaacgtaacggaacttcctcaacttaataaagggcatctacaaaaaaatcctacagttaacatcatatataacagtgacagactgaatgctgctgtttctctaagatgaaaacatagacaagaatgtccattcttcccaatcctattcaacattttaaagaaagttcaagccagggcaattaggcaagaaaagggaaaaaaaaaaaaaggcatctagattggaaagaaaaaagtaaaagctagaattctgactacccagacttaataaggataaaattaaattacagtataaaacactaatattaaaaaaaatatatgaactgacaaaaagggcagagaacaatcataacaacaaaatctgttggtccacatttaattttgacagagtttggaaaattttgcttccagatgattgttcttacgaccttgtgctggcatctcgttaaggtctcgtactgatatctccctaaggttagaaagagtgattcttcctaaatgctaaagggaaaattcaggttaagaagataactatttctctgaacagctttacagggtaaaatatcttgagattaatgaaaatacatactaacctgtgaaaggcactctgtgtgaattaagctgttactctttgatttacgactgctcatttcaacaaattcaaatcctttaaaaaaattggcataaatattataaacgtagtgacttaaagagattacttaagaatttactgttctagaattaaaataaatacaagtttttaaaagtaaaaaatgctcaaaccctaagaccttcaaaatcttcgatggcttcattttgtctaagtacaggctgattcaacactctcataccacactttaggcacactttgttttactgtgctttgcagatggtgcattttttttttaaagtaaactgaaggtttgtagcaactctgtgtccaacaagtcgataggcaccatttttcaaacaccatgtccccattttgtgtctgtcagcattttttagcaataaggtattttcaaattaaggtatgtacattttttagacatgctactactgcacacttagtagactagtatactgtaaatataaattttatatgcactgagaaaagttttgggtgattcactttattgtgatatttgcttcactgcaatggtctggaactgaacctacaatacctccaggcctgtatgtggttcttacagctactcctccctttcgattaaatcttctattcaccttccctttcttcctttttctttttttaacttacatgcttcctttatgattctcccacccatccatcccacaggatcatcccttatagaaaaccttccctttcttgctccactcaccaacaatacacaaataatcattacagactaggttaaatgcctcttccttaaacactcataagtgcctgtattttgctttattattgaattattttaaacaaaattgtctgtttaattgctactgtttccaaattgagattttttatattctaagcattgtagcataatgcccaaaacaaagttggcaatgaataactggaatgaaaaaaaaattaatgaaaaaattatattttttgtaaaattctcctcaagtgtaccatactcatagacaaatgactaaaagacctttgactaaaagacctaattttcttagcactgatttcctataggaataaattttaacagatagacagtaacagcttaagcagtgtttaggtatcaggaattgttacaaatgctttgcatttatcaactcatttaatcctcaaaactatcatgtggaataactactattataatcctcttttaaggttagaagacacagataggctaggtatgttgaccaaaatcaaacagtatataaatggaagagccaggatttggatccaaccaagttaaccacttttttaaaaaagtgtattctggtctcatctaatctccagaaggaacacagctttgctaacaccctgaatttagctcagtgaaagacattttggaacttttttactgccagaactcataaaactcaaaaaaagctgacttatcatcaaatcaccaatgattaacattataataatgcgagaatgacagcagcaagatgaaataggaggcccttcagcttgtgtccccaaatagcaacaataatttcacagccacccacggacaaaatggtctttgtgttagcgttgagattcaggcaggcgtctgtgaaaccccagtggggcccaagacctggaaaagtcaattggagggcagatcttcattcacgtgacagattccccaactgtggtccaggcttcagacttggaaagggccctgtcctcccgataggaccttgttaccaggggctgtagcaggatatgaaccctatctggtcccttggcggactggactttttctaggacctcggtctgtacagtggatgaagatatgcagagaaaagacctgttaccaggtgtgtggatggtttggctttctctgggaacctgggagggctcctactggatcactgagtagattccttaacaggcagtactgccctagtccacagctgagtggggctggaactaagctacagggttgcttcagggcctacagtcaagacttaggtcttcaggcctaaggtgtcacaaacctgcatgtctcccttcaggtccttaagttagcgggcctgctgtattgagaggggctggagccacttttcaggggtgtttcagggactgatgagggacctaggtcaggtggcctgtttgcagggctatggacagccccatctccctccaggatgctgggtaggcagaactgctctctgaccacagctgagaggggcttatgccaagattcagggttgtttcaggacctgctgtgggactgaaatctgcctgcctgtcctgaggacacagaaggatgtatctcctgactacaggaggatttctgtgcaggatttctgtaagactgtggctgagtggagctgaatccccgattcagagctttttcagcatatgctatgggacagagattggcaagtctgtactgatggcacagacaggtgagtctcctagcagttccttgtgcaggcagggttgctctcaggctgcaaccaacagtggcaggagctgagcttcagggctgtttcagtatttaatgcaggaccaagttcagaaagcttgacccagggattcagacagttttgtcttcttgtgggtccttgaactgatctcagaccatagccaagttaaagtgtcttatcagggtccgcagttgggactgaggacagtggacttattttctgaggtaccagtgtgcatgaattttcccaggcctcttggtgaacagtttcggtagcaggccaatatccttgatgaatataggtgcaaaaatcctcaacaaatactggcaaatctaattcaacagtacattagatcaattaccatgatcaagtgggatttatctttggaatgcaaagacggttcaacatatgtaaatctataaatgtgatataatgcattaacagaatgaaggacaaaaatcacatgactgactcaacagatacagaaaaagcttctaacagaattcaatattccttcaggtttaaaaactgtcaatatattaggtataaaaggaatatacttcaacacaataaaggccatatataacaaactcacagctaacatcacaccccaaaggtaaaaagttggaagctttccctctaagatcaagaacatgacaagaatgcccactttggccatttatattcaatatagtactgcaagtcctagccagaggaattaggtaagaaaaaataaataaaaggcatccaaatcaaaaaagagaaagttaaatggtctgtttgcagataacataattttatatagagaaaatccttaagactctaccaaaaaactgttagtactaatacatacagtaaagtggcaggatacaaaatcaacataaaaaaatcaataagatttctccacactaataactatttgataaaattaaaaaccagtcctaattacaatagcatcaaaaacaaattagaaagaaatgtaacaaaagaggtgaaaggtctgtcactgaaaactatacaatattgatgaaagaaagtgaagacacaaataaatggaaatatactccatgttcatggactgaaagaatcaatgttattaaaatgtccctactactggaagtgaaggttcaaagtaatccatatcaaaattctaatgacatttttcatagaaatagaaaaaaatcctaaaattcatatggacccacagagacatttaatagctaagacaatcatgagctaaagaacaatgctggaggtatcagactacctgatttcaatacctagtgcaaaactaagataattcaaaacaacatggttctggcataaaaacaaacatacagaccccagaatacagagtcgagaaataaatccatacttttacagttgacttatgttcaacaaaagtgccaagaacacacaacggagtaaggacagtctcttcaagaaatggtgttaggaaaactggatatccacaggcagaagaatgaaattgaacccttattgcacaccatatacaaagatcaactaaaaatggattaaagacaaacataagacctgaaacataggggaagaaaacacagggggaaagctttttgacactggactcggcaaagatttttttgggatatgactccaaaagcagaagcaagaataatgaaaacagacataaaactaaaaagcttcaatcaacagagtgaagagacaaccttcagaataagtgaaactatttgcaaatcttacatctgctaacaggttaaaatccaaaatatgtagtcgctcctcatcagcagattcaaccaacttaagagagagaaaatttagaggggaaaaaaaatgcaacaataaaaattaatataaattttaaaaacaatacattataatagctatttacaaagcacttacattgtattagaaattataagtaatctagtgatgatttaaagaatatgggatatgtgtaggttatacgctaataccatgccaatttatagaaaggacttgagcatctacagattttggtatctcaggggagtcctggaaccagtttcccgtggatacagagggatgactgtataaggaactaaaaaaaacaaaaacaaaaacaacaacaaaaaaaacttaatagcaaggaaacaacccaatttaaaaaatggtcaaaaagatttctcacaggacataaaaatgtcaaataggtatttgagaaaattctcagtgttactaattgtcagggattttcagggaagtacaaacaaaaccacaatgagataacatttcacacctgctaggaaggctattgtcaaaaaaaggcaaaagatgatgagtgttgttgaggattatgaagaaaggaaactcttgtacactgttggtaaaaatgtaaattagtataatcattatggaaaacagtatggaggttcttgaaaaaattagaagtcaaattacatgaccggtaatcccactcctgaatatccatcaatatatacaaaggaaatgaaatcaatatgtcaaagatatatcctcactcccatatacactccagcattattcacagccaaaatacggaatcaacctaagtgtccatcaatggatgaaaagataaagaagatgtggtatatatacacaatagaacactaactcagccttaaacaaaaaagaaatcctgtcatttgcagcaacatagatgcatttgggagatattctgttagctgaaataagccaggcacagaaagacaaacaccacataatctaatttatacagtagtctctccttatccatgggagatgaattccaaggcgcccctcgcatgtctgaaatcatggatagtacccaactctctctatatactatgttcttttaatctgataacctagatggctactgagtgattatgggacacatgcaatacacagcatggatacgctggacgaagaaattatgtatgtcccaggcaagacagagcaggacactgcaagatttcatcacattactcagagtggcatgcaatttaaaactcatgaattatttatttctggagttttccatttaatattttggaacttcagctgaccaaaagtaactgaaacaatggaaagtgaaactgaggataagggagggactacaataggtggaacctctaacaggggaactcatagaatgaaagcagattttaaattttcttactacaaaaaaatggtatgtgaggtaacagatatattaataggcttaattttgtcattccacaatgtatacctatattaaaacattatgctgtataccataaatggataagatttttattcatcaattagaaaaaaaacatataaaatatacatcaaaaagcaagtaagtgcagagccaggatttgaatgatttgaacccaaataagttgtactcttatgaaattgttacgtatttagcaaacttttttgaaaaaagaagtacaaacacatttcaataacctgaaggaagatcagccaatatattttacattcacatttattaatttcatatagtgacaattagaaagcaaaccatggtaatgctgttttcttctctagaaatgttaacaggtccttagctgagccaggccttgacagacagacagcaagcaaatctgtgtcctccttaatgtgtaagccaggtagctaaggcctcagccaccaaaagtcctctggctccaggcttcctaattgaaaattaaataacagagtactcaattattgtcttgacccttaagcatcttctttcttagaagaaaagtggtcttctcagctgtcttaggataccttctagcagtcttttatatctaaagttttatcttattctattttttatttttcctaatcagtgttatgagagggaaaaacctttttagctaataaaatatcctcaactctggtttatgatgctcttgactatcagccaaaatctaaaatcacaaagaactatgtaataattgtctcctagattataagactaattaaaatgtaaaaaggagaaagggcttttgcagtatgttttattttgtagaactacattagctatcttacagtattgttagaattaaaagatattttttacccacttcatgaattaagaaagaattactcaaaaaagctaaataaatgtccacagttccaaggcaggtatctaatctgcccctttgcatcatatataaatcaggtaagctattaagataattcattttttcttcatgtggggccagcattcataaaagaaacaacaaacatgccactatggtatctaccttataacctacataaattttgactgtaaataaagttttagtccaaaggttattttgacatcttcccccttcatgtaatggtcaaatatctactatataataaagaatatttcaaagacaattctaatagtacagatgagacaagcttcagactgggagaaaatacctgcaaaccacatatctgacaaaagatctgtatctaaagaaccctcaacactcaataataaaaaaggaatcccattagaaaataggcaaaatacataagtagacatttcaccaaagatatgcaggtggcaaataagcatatgcaaagatgtttaatatcattatccgctaggaaaatgcaaagtaaaaccatagtaagataccaccacacactgattaaggcagctaaaataacacaaagatggtgaggatgtaaagaaaatgaatctttcatttaaccactggtgggaatgtataatggcatggctactctgaaaagtttcttgacagcagtttcttagaaaactacaaatactcttaccaagccacatagcaattgcactcttgggtacttacctgacagaaaaacttatgttcacacaaaaacctgtaacacgtatgttcatgataaatttattcgtaatagtcaaaacactggaaccgattcactcaatgagccaatggggttaatgaattagttccactgatgctttgtcactgaagtcaggaagtacccagacagtaagggactgccttttgaagttcttctgatattggacaatgcccctggctacccagaatcccatgagttcaacaccgaaggcttttgtccaagtggtccactggtccccaaacacaaactctctaattcagcctgtagatcagggggtcatagggacctttaaggttcattacacacagaactctatggaaacgaatgtcaacactatggaaaaacctccacagacagaacatgatgaaagtctgggaggattatcccattgaagatgccctgttgtcatagaaaaagccatgaaagccaacaagactgaaacaaatttctgctgaagaaatctatgtccagatgttgtgcatgacttcacaggatttactacaaagccaatcaagaaaatcatgaaagagattgtagacacggcaaaaagggtggggagtgatgtgtttcaacatatgggtcttagagaaattcaagagctaacagataccacaccagaggaattaacagaagacaaggtggagatagatgcttctgaaccactgccagacagtgagaaagatgcagaacagtgccagaaaacaaactgacattagacaatctggcagaacggttctgaatatacaagactactcttgacttcttttacgacatggacccttctatgatacaggtactggaatcaaagcaaatggttgaggaagggttgatactgtatagaaacattttaaaagaaattagaaaccaaaagagatagacagaaattacctgtttagttacacccagtgtgcctaacctgtcttgtctccccttctacctcctccacctcttctacccctaggcaacaagatcaacccctcctcttcctcctcagcctactcaacaggaagacaagtaggatgcagacctttacaatgagccacttcaacttaatgaatagtaaatatattttctatatatagtagatatattttctaaatatcttttctttaccttactttattataataatacaatatataatacatacataaaatatatattaattgactatgttaccagcaaggcttccagtcaagtaggctattaacagttaagtttttggggaggcaaaagttatatgcagattttcaactgcttttggtagggagggggtgtttcgacccctaacccttacattgttcaagagtcaactgcgtatggaggaaattctcattactgcagttccagagcactactatacatcagagagctactgaccattttaaatttacttctgtattgacaaaggacaaaaattataggaattgtaaaaatgtgtcatctaaagctgtctgctctctaaattgcctatgtgcatttccccatgacagtaagtcccctacaatctatacctttacaaaggaagggatgaattctgaaatatattcactgaccactacttactgtatctgtatttgaaattttatagttacatgctaactaaagcaggatgactaaataatctcaagactcaatcacatgtatattcatactcccatttttcaactgaggtggcttatttattgtaattctccattcctatgctttccaagggttgcttgttgataaattctaaaaattatgaagtacatcctttactgctcttgaggtttcatgagtacttataactcttctttctcatgatgccttcctcagatccaaaccctcactcagagcctctttgtctaccacactgattctgcataatgtattttagactaactctgtttggccaacaataatgataactattcagtaaactctctgttttttttgtttttttgtttttttgagacagagtctcgctctgttgcccaggctggagtgcagtggcgctatctcggctcactgcaagctccacctcccgggttcacaccattctcctccctcagcctcctgagtagctgggactacaggcgcctgccaccatgcccggctaattttttgtatttttagtagagacggggtttcaccatgttagccaggatagtctcgatttcctgacctcgtgatccgcctgcctcggcctcccaaggtgctgggattacaggcgtgagccaccgtgcccagccttagtaaactctcttaacatctaaagacagaattagaaaatagctgacactaacaacttattcctacatatagctcaatagccattcagatgtcaaatgttttcctaccttagaaatagaacataaaagccctccatttagtttgcacaactaacttaagctcctcatcttaggttagttctaatcactgttttttagactaacataatcctaaactttgtgggagaagcaacctggatgaactcctggtgacagtccttcatgtcaaatttgaagtttggtcaatttaccaaatacctctctgcttgctgactagcaatggtatacaatgacctgcccaagatgacatagcttacttaacagcagcagtagctgttaggtctattgactcccaatcagaggttggttagtctcaactggcatgaaaaaaaaccctgcaaacatcagaaagttcatcaaaatcatcactgggcttttctttaggagacaaaacatagcagaggaatacattctgaaagaacacggttattataacagatgttcaataccaacaattcacttctctttgaatgtctatgtgtacaatttgtatttttttctgtacacatctttatttttaagatcataaactttcttcccatcgctaaaaaggaatacatgtttcgtacagaaactctggaattttaattaggaattgtgcagataaaatggtaaaaaatggaatcagagaatctttctcctctaataaaacaaaacaaaaaactgttaaacagaaatactttagcagtaactaaacaaagagacaagttaataataaacaagcctagaaaattctacaggagttctccatagttcctaactttaacctcactcttaaaagctatacttgcatcaataaaatctcctaaactctcatcaatgtatcaaatatgaaaagaagaaaactgataaaaactgtaattcaattattaaatttcaagcctaaaaaaaagaattcactgggactcagcctgaaaaacacctacaagggagaaaaaaatgctaaaatatggtgtcataatatctacaaagttctgagagagagaccaagactcatacctagcaaagatgtcactcacatataaaggtaacaggtatagccttatcaaataagaatgaacttatttagtacacagagccaataaagccttgtgtggagtgtgtgtgttgcaggaggatatggggaactcaatgacaaaatccagccaactaaagcataattaaaaacacaattttatacagacacacacacacatacacacacacacacacacacacactagtgacctttgaatccactaaaataaaaaactaaaaccaaaaaaaggtaaataattatagtagcaggtggaaacataagtcgttacacagtgaaaataatcattcaacaaaaaaatgaaaaaaaagtggcatgaatgcatacggttgctaatttcattcttcagagtagaaagaaaatgtctaaacttaaaacatgaagtgtaaaaaaggaacttaaaactattttttttttagacccagggtctcactgtattgcacaagctggatttgaattcctgggctcaagagatccttccgtctcagcctcctaagtagctgggtcaacaccttgagcagcttgaaactttttttaacctaagattgagatctttaaaaaaaaaaaaatctcttgggtttaataaatatctaaagtccagcaattcctataatttttattaggttaaaaatgtggcctgcctacacacacacatactttttcaaccaaaatgggctctatttcataatatttgtcatttaaaagaacaagaactttccatatatagatatatatatgtgtgtgtgtgtgtgtatatatatacacacacacacacacacacaaaaagtaacatattttaaattattttttctacagctaccataaggtaaaaaacaaaaataagaattagtggatcaaattgtttaagaaaaagaaccatgtacctcagctggataatcaaaagtactctagtattatgagcatcttactagtaattacgacgccaggagctgtaacactgtgtacccaaaaaaaagcatttaaggagaaaacaggtgtgaacatgtccgatttatttagtttcaaagttgtccaagcacaggtcaaagaggtaacaacaaacaatttttcctatctttcatataaatggtcagtaaggtggctggtgcaaaataaccctctggaataagaaagtattgtaggctgggcacagtggctcccacctgtaatcccagcactttgggaggccgaggcgggcagatcatgaggtgaggagatcgagaccatcctggctaacatgatgaaaccccatctctactaaaaatacaaaaaattagccaggtgtggtggccggcgcctatagtcccagctacttgggaggcttaggcaggagaatggtgtgaacccgggaggcggagcttgcagtgagccaagatagagccactgcactccagcctgggcaacagagcgagactctgtctcaaaaaaaaaaaaaaaagaaagtattgtaatatgtttacctataaatatctatccaaaaaataagagctaaattaaacttaactaatatttaatatatacattgacaaattttacttggtctctgtatcagcaggtcaagtcatgttactcaacccagacgccctaaggaaagggaagagttcaagatcaataacaagaaggggttccgagtggcaccatcacatattcatttactgtcagctcattaatacacaatgtaggtatatgaatccagtttggagacattactgaatccagctgacttactgaatttttttttttttttgagacagaatctcgctctgtcgccctggtgggagtgcaaggttgcaatcttggctcactgcaacctccgcctcctgggttcaagctattctcctgcctcaggagataggagctgggattacaggcatgtgccaccatgcctggctaatttttgcatttttagtagagatgggggtttcaccatgttggccaggctggtctcgaactcctgacctcaagtgatccacccaccttggcctcagttgggattacaggcctgaatcaccacgcccagcctcacttgctgaatttaaagatgttattatttttaaaatgtaagtgaaataatctcagctgttccaactgcagctttttcctggaatgaaaaatggctgcctgtcaacagcatgctgcttagtaaataaaaaacaaaaagcaaaaaaaaaaaaaagatttacttcatctggaattttaaaataaaagtaggaaagaaactgctttttagaagaaatttgtgttatagggcattttgaaaatgtttccaacactgattttatagccaaaaattaggtgttacctataaaaattctcatatctatacacttaaaacatttataaacataactttttattctattcacaaatatttctgtaaataatgtaagttttatatgtgttgacctaaaaggaaagaagttgaggcaaaattaataacatacatagagagttcatttgagccaagcttgagggttgcaaccaaggagcataaattcaagttgccctgaatatgctcattagcagcagtaacaagtagatttttaaagagaaaaagaaaaataaaaaggcacgctctgagttgttcaccaagaatctacattaaaataacaaactatccattggctacagagtggcagggggtagggagttggggtggagtatgggggcataactgaagtcccatactactcacatctctctgggcctgcatacctcagagctcagactgttctgagcattttttgttttctcatacccatttgttaaaaatataaaaacataccacttttcggctgggcgcagtggctcacacctgttataccagcactttgggagactgaggtgggcagatcacttgaggtcaggagtttgagacgagcctggccaacatggtgaaactccatctctactaaaaatacaaaaattagccaggtgtggtggcacgtgcctgtaatcccagctactcaggagacttgaggcaggagaactgcttgaacccaggaggcggaggttgcagtgagccaagatcgccaacactgcactcccaccagggcaatagggcgagactcatctcaaaaacaacaacaataggaacaacaacaacaagaaacaaaaaccatgcaccactttccaagaacactaatttatatcaagtttttcttagtttggaataagaactaacacatcaagagaagatgaaattggctaacaactcctacaaaaaccttggtaaaattagtggatgagactagaaaatataattcaaaaatacacaaatgatcatgtattattttctctaatacccttactttgaggcaaaaccttacagctccagcagatgggggcattactttgtgaaaagaactcttagtaaattaaaaagatgtttaatactgctttctttccagatggtggcagaagaaaacaccgaaaacaataccactaccccactccctttattagaaaaaagttaaaatacaaattctattactgtttacctaggacctaacttcacacggctgacatttctcaaagataggtaagtatggacaaaatttcagaactttgcctctcttcagttcgataaaatgttcttgatttgctagctaaacagtcaaataacgtaaaatgaaaggtattttaggagaaatttgaaggtggtttccatgttttgttactgtcctttgagatgaaactgaggcaagaaaaatacatttaagctgtttttcagtccatcagaattagttttcattcttttttctcccccagttggattgtttgtacagaggtaaagattaaaatagagttaaaagaatggttgagtgtggggagaaataagggccaatactgatatatattccaagttagaaaataagtaaactctgttagttcttcctaaagagatcagctcaaaaatgctatctatatcaagttggggcacagcctctggtgagatgtttccttgagttctccagagctgaagaataattccacacaaatcaacttttggaccacaggtgaataaaccatggtaattactgacagttttgtaaaatctttttttcctcctcatttgttgccagtgaatattaaaaggacacaatttacttaaggacacattcagattaaatgattccaaggtttgataacctttagttaagtaatatgatgccatgatattttctcattgatattaaaatgaagaaaaatattttataatgtcttggtacttaaactgattaaataattgaaaaggcttgcaattctccagaaaagccatgttctctctaacctctgaatttcagtaatcttcactagtacatggcagtatgtctggaatcatatatacacagacacacacaaccacacatacatatatatacacacatatgaatataaacgtatatacatatatatcttttttttttttttttgagctggactttcactctgtcgcctggctggagtgcagtggcaccatctcagctcactgcaacctccacctccagggttcaagcgattctcctgcctcagcctcctgagtagctgggattacaggcatgcgccaccacgctcggctaatttttgtatttttagtagagatggggtttcaccatattggccaggctggtctcgaactcctgacctggtgatccgcccacctcagcctcccaaagtgctgctgggattacaggcgtgagccactgcaccccatacatatatatcttttaataagtgtacttactttataaagtacctattagagccttgatattcatgaataagccaataaagttgttttcaagaacatgggaggtaaatagttatgaaataaacaacccccagaaggataatcagagagttaatactatgatatgttcagtaaagaaagacatttagaaattactacagttggccgggcatggtggctcacacctgtaatcccagcactttgggaggctgaggcgggtggatcacctgagttcaggagtttgagaccagactagacaacatggtgaaaccccgtctctactaaaaatacaaaattagccaggtgtcgtggtgcgtacctgtaatcccagatactcgggaagctgagacaggagaatcgcttgaaccggggaggcggaggctgcagtaagcggagattgcaccactgcactccaaccagggcaagacagagcaagactccgtctcacaaaatgaaaaaaagacattactacagttgttttgattattaaccatggaatacaccttgtaaatgatacaaagtatcaattctgcagtagtgttgatgaatgaataaaaaagaaatactagttggaggacttctttaaagtatacgtcttaaaatgcatttacttctgaattatataggctaacaaaagaactaacacaaatttgcaacgtatttagaaatcctttagaagctttggaaatgcattatatgatcttactggcactgacataactacatcttaaatattatagtgatcaacagtagtctatgttctctgagcacatggaagtaggctaccttcaggatttaagcttgtgaatccaagctaatgtgtttaattggatggataaatagtataagggcgacagacacttgaatcaacgaaaacttttttttgtttttggtttaagagatggggcttccctctgtcaactagggcagtggcacgataatagctcactgaagtcatgaactcctggcctcaagcaatcctcctgactcagcctcctaaatagctgggattacaagtgtgaggtactgcccctgacaaaaatatcatttttgtgaaggatggttgcattatatgggacacaagatttaagactagggcactaaaattggtgggtgagaaggcacatgtagacaaattttccttgaaaagccccaaactacacataaattacagaactgtactttcttgcaatatcaattacttcagggtatatgttcatttgagaagaataatgaatagaatactgtccactattcaaataaatttttcctttgccacgtttacagacttgagtttacttaaatgtaagtatgatactgctagggctaaggaaatgatactccaaaataaagtcctccaaagcagctctctctgaccatctcctaacttcctgtctctggcctctcattctcctgaggctagccactgaaactaccatccctcgtccccaaggtagtccacagaaaccagaactccctttccccaaagccagccacagaacctaaatatattactctaatgttccctgccctcatctttctgtgtaaaaactaactataaagacatatctgacctattctgtttgattgtaggtcataggatccccattccagaaagggtgctgttccatacccggaaggaaagaatgctgcacagagaggccaagaagaatctatacagacaggcaggccttgctgggtttccccactcagtatatggctgtccagactttgctgaacctaagcataccaatgggcagttttctcctatatctttaggtctttattctgaaggctcccatgtcacgtaacaccaagatcaaataaaatcatatgccctttctcctattaatctgccttttttcagctgattttcaaagaaccttcagaggctgaaagggaagttttttcttggcccctacaatatgctacaactccagtaagttaattagtaaatattaaactatttttggaaggaaaaaaaactgaaaataacattgctttagagataaattatttaagaattgctagaaattaccctagaaattatcctagaaaaatcttaaaattttccctaaaaacttttaggaataatacattgtttctaatgagacccttcagcttatgcaaaaagcacaggagactaaattctagagtcaacgaaacgatattctccaattctgttttgctaatgaatatgttgtccatccccccatcagcatgcttaggtaatcttgcaaggataaatggaaatgtcagttgacatttacaatgaaataggatttttagacagttgtgctttttgggtgggaaaaggagagctaaaaattagggggttgggggcttaaaaaagacagcattatatggcttagaactttggtaccctaccttcatccttttctgcaatcccttttactccccaaagttaaaaggctatcaatgggacaataattgatgatcaactatgaagaaataggctcaaatacactgttttattatatttttatcattctttatataccttttctcatcattctttgtcccaatagtatgctatgattatgcacgtagaaaatcccaaaataacaacaaaatcactggaactaataaactactgtagaaaggttgcaggatacaaggttaatatacaaattgtcaacttccttcctatgtatcagtaatgaacaactgaaattagaaattaaaataataccatatacattagcaacaacaacaaaaaacattcaccaaaaatgtagatataaatctaacaaaatatgtacaagatctctatgaggatcactataaaactctgattcaagaaatcaaagaaagtctaaataaatgagatcattcaagagtagaaaaaaattcgtattgttaaatgtcagttcttccaaccttgatctataaattcaatgcaatcccaatcaaaattctggatagttattttgtggatatgacaaactgattttaaagtatacacagaaagacccaggagaaccaacacgataccgaaggagaacaaagttggaggacaaaacctacccaacttcaagacattataaaactatactaatcaatacagtgtgataatggtgaaagaacagacaaatcaagggaacaaaacagagcccagaaataggcccacataaacatagtcagctggtcttttacgaataagcaaaggcaattcaatggagaaaagaacaatctttgcaacaaatggtaatggaaaaactagacatacacatgccaaaacatgaattgacacagaccttacaagtttcacacacaaaaaatctaaaaatggatcacagacctaaatataaaatgcaaaactataaaactccaaaaatggccgagcacagtggctcacgcctctaatcccagcactctgggacaccaaggcaggtggatcacctgaggtcaggagttcgaaaccagcccgaccaacatggtgaaaccctgtctctactaaaaatacaaaaattagctgggcattgtggcaggctcctgtaatcccagctacttggtgacaggtgaagccagctggacttcctgggtcgagtggggacttggacaacttttctgtctagctagaggactgtaaatgcaccaatcagcactcaataaaaaaacgcaccactcagcgctctgtggattaaaggattgtaaatgcaccaatcagcactctataaaaacgcaccaatcagcgctctgtgtctaaaggactgtaaatgcaccaatcagcactctgtaaaaatgcaccactcagcattctgtgtctagctaaaggattgtaaatgcaccaatcagcactctataaaaacgcaccaatcagcactctgtgtctaaagtattgtaaatgcaccaatcagcactctggtctagctaaaggattgtaaatgcaccaatcagcactgtgtaaaaacgcaccactcagcgctctgtaaaatggaccaatcagcaggatgtgtgtggggccaaataagggaataaaagttggcatggaccaatcagcaggatgtgcgtggggccaaataagggaataaaagctggccacccgagtcagcagtggcaacctgctggggtccccttccacgctgtggaagctttgttctttcgctcttcacaatagatcttgctgctgctcactctttgggtccgcactgcctttatgagctgtaacactcaccaggagggtctgcggcttcattcctcaagtgagcaagacacaaacccactgggaggaacaaacaactccagacgcgccacctttaagagctgtaacactcactgcgaaggtccgctgcttcactcccgaagttagcgagaccacgaacccaatggaaggaagaaactccggacacatctgaacatctgaacaaacaaactccagacacaccatctttaagagctttaacattcactgcgagggtctgcggcttcattcttgaagtcagcgagacgaagaacccaatggaaggaataaattccagacacatcgggaagctgaagcaggagaatcgcttgaacccaggaggcagaggttgcagtgagccgagatcacgccattgcactccagcctgggcgacagagcaagactccatctcaaaaaaaaaaaaaacaaaaaacaggccaggtgcggtggcttacgcctgtaatcccagtgctttgggaggcagaggctggtggaccatgaggtcaagagatccgagaccatcctggccaatgtggtgaaaccccgtctctactaaaaattcaaaaattagctgggcatggtggtgtgtgcctgtagttccagctacttgggaggctgaggcaggagaaccacttgaacccgggaggtggaagttgtagtgagccaagattgtgccactgcactcaagcctggtgacagagtgagactccatctcaaaaaacaaacaaacaaacaaacaaaattccaaaaatgtaacacaaaagaaaatctaggtgaccttggttatggccatgtgtttttagatacaacaccgaaagtacaatccatgaaagaaaataaaaaattgatttagacttcattaaaattaaaaacttctgctctaccaaatggcactactaagaaaattaaaacacaaaatacacatggggataaaatatgtgaaaaacacttattttgttacacaaaatatacaaagaactcaacaaggaaataacccagtttaaaattggcatccaaataaacatctcaccaaataagatacagaggtggcaaataagcatatgaaaagatgctcaacatcatatgtcaatagggaattacataatcaaacaatgagataccattgcacacctattacaatggctaaatccaaaacaatgacaataccaaatactagtgagaaggtagagcaatgggaactctcattcatggctcatggaaaagcaaaatggcacagacactttggaaaacagtttggcagcttcttataaaactaaacatatttgttttacataatctagcaatcatgtaccctggttacacccaaatgagttgaagacaggtccacacaaagacctgtaccttcctgtttacagcagttttatttataattgccaaaacttggaagtaagcaagagtgtccttcaatatgtgaatggataaaccaactgtggtacatccatacaatggaatcttactcagcatgtaaaagaaataaagccatgaaaagacatgaaggaaacttagatgtatactgctaagtgaaagaagccaatctgaagagactacctactgtatgtttccaactatatgatattctggaataggcaaaactacagaaatagatgttttagtgatcttttcactaaaagatcagtggttgtcaagaaaagagaagtatggaacatgagatttttagggcaattaaattattctgaatgatactgtaataatggatcattatatatttatcaaaatccatagaatgtacaaaacaaagaatgaatttattcatatgtttgtcgtttttaaagaaataagacatttcaagaacatttatataccaaagtaagaaaattttttatatcttatctttctttgtcaacaccaatcatcacactattcaagagcataattcctaatggttgagaagagactcttgcaatataaagcaaacaaacatattgttattttgtaagtatttaatataatgaaaacatgttatctatgattatttcttctcaaagtacatgacaaagctctatgatctcatgctgccattaaatgtataaaaacatagcttaaaaagactaatattacacatattagcatcttggaattatttctgggtgcaaaggttataggtaattttcattttttaatcacttttatactgaatgtatattatgtttgtaactttaaaaattttcttgcacatttaaatcaaatcttgtactttacaatttgaatatataaatttctaagtgtaaattatgatgctaaaattctattttaacttttaaacatgttacaaacataaaatgtgttttaacataaaattttaaaaacatgatgctcaccagatattgcagcagtgttggtataacatgctggacataattaaaaaaacaccaaagtctaatggatattagctgaaacccagctttttagggaaaatagttttggtatttactcattataaagtaagttgactgagacataaacaaaccatacaagtggtcatattaagagtgcatttaagactgacatgtctgggttatctgtattagatatttttgtaaacaatacaaaaaagaaacaaaggagaaagtgaaaatgtgcaagtgaaaagccaacagatcagaacttaattcttgaaaaagtctgacctcactttggtcatgctataatttggatttggtttctttatcaccaccaaagctaatgtggaaatttgaaccccagcgtggcaatattgaaaggtgaggcctagagggaggtgtctgggttctacgggtagatgcctcataaatggctcagtgctattctggagttagtgtgttctggctctcatgagactggattagttctctggcgaatggcttagttccttcccacaagagtgggttgttataaggccactatgcactcctcagattttcctctctttgaatgtttctttttctcctttgaccttgtccaccgtgttgtgaagtatgaaagatcttgccagaagccaggtctatgctcttgaacttctcagtctgcagaactgtgagctataaaacctcatatctttataaattacccagtcttaggtattcttttatagcaatacaaaacagactaaggcaggtcaaaatttcacactattctcaattcccctattaatcaaaaaagtagtataggactaagaatttgttatgttttattggaggtgaggagagatatgggagaatataagataaaggttaaaaagagattaggaaaaggtagcaaccccaaagcatgtttaagatcagtgctttgagcaagatcaggaatgaaaagagagaataaaacagaaatgaaaggatgggaacagctgtcaattccaggtttcatctaccttttggtttataatcttcaactcatgtcttatttttctacttatgcatttagtaaaatatacaaagccatccagtctcgtcagctaatactctaaataatataaacatacaacaagttcactaaataactggtcttttaatttgggctagaattcaatgagaaaaccatttctaaaagacttgcagtgctaacatggctcaaattaaacagaagcctctaacccacttcatcagaggccatgaggcttattttctacacagggtaagacagaagaaatctaccctgaggacacaagacacagcagaaggtgagggtatcagacaaaaaggttttgagggggaggagaggattaagagagtgtttatatattgaacgttgaggccccctagctctcttctttcacatagttctcatactactggcaatcagacttataccctaaagcagggtttctcaggataacattttaaacttgattgttcttcgttgttggagctgtcctatgcactgtaggatgtaacaagacccccagattctatgcatcagttttcaggagcaacctatctgtggcaatcaaataagtctctagacactgctaaatttctcttagggggccaaattgtcccacttgagaatcactgacctaaaggcagaagcttggagaactcttcttattagactcttattaaccctagaaaaaaggtttccaaacttaaagataatgacaccaggggtttccacccacaaaatgcccagccatattcacagagctctaaaatagctttctaatgaatctaacataaatttgaacatgcaatcaatgattgctacatagctgaggaaagcctcgattaaaaagatgaaaacatattaacagaaagaataatttggaaaaagtagagaaagcaggaagcaataaatttcaaaaccaaacaataattttaattcataaaaagaaaacataacaggatataataagaaaattatacagagatcaaaaaaggccttggaaattaaaagtatgatagcagaaatcaaagtctcaaaagtttgaaaaaggtaaattttccagaaagtatgaagaaaaaaaaaacataaaaaatgacagaaaaaaaataggtccaggaggtagaatgtttaattagagttccagaaccaaaaacaaaggcaagaaaattaaagaaaaaacatgaggaattttcccagagttgatggacacaaattgtcagactgaaaggacccataaaatgcatggcaaaatgaaagactatagactcataataagtaacatggctgtgacatttcagaactctagatacaacaaagagaaacatttgataagtttcaaaatgagatcgtataatcttccacagaggagacaaaagtgatctgaagagtgatggaagtaagaagggcttctaattttacaacagatgctatgaattccttcaaagctcttaagaacaatttcacctttataatttgaaagccagctaaactaatagttggggtaaaataaagacacttatataaatataataccacagaacacttgcctttcagaaagctactagaaaatggaataaaccaagagaatacacaagccaaaggattacataggatataggaaacagaggaactagcataggatagagactgcaccagcagcaactatatcaagcaatgggctaaaactgcagcacataagaatgctctgggagaaatttcttgatgatggataaactgataaaaatacttgatacctctgaatatatggaaaggctgttttgacaaccagcagatagtttgggtctaaatgactaataaatatttagaactatacaaatgctcaatggtcgtatatgaaaaattaaactatcaatgggaagatggggggaatggatgggatgtttgtggaaaaaggctaaatctacatcacctatagtaagtcaagagataatgcctaaaactgaaaaaacaggaggtagcaatataaaatgttatttagagatacagaagtatataccaaaagaataagccaaaaaaagttttagaagtatttccctctatttggggaaaactggggtagtgacagctaccttgtccaacatcacagccttcctgggattaagcaaataaggcgataaaggcccaatcatttcgttgcaccatggtatcaatctgaaggaaaatattctggagaacctaacctgtgacaaagaagtaagaactgtttttaatcataagctatggagaagcagttaaaaacttaagcatgtgttcttttacctttgcaacagttaaaagaaaaagagaaagagaagaaacaggctgcttaaatatattttctaatttcattaacttggcttcttatactgcagagccgaatgttattttagaaatttaaagcccatcagactaacaacggatctctctgcaggagccctataagccagaagagagtaggggccaatagtcaacattcttaaagaaaagaattttcaacacagaatttcatatccagccaaactaagcttcataagtgaaggataaataaaatcctttatagacaagcaaatgctgacagattttgtcaccaccaggcctgccttacaagagctcctgaaggaagcactaaatatgtaaaggaaaaactggtaacagccactggaaaaacataccaaattgtaaagaccattgacactatgaagaaactacatcaactaacgggcaaaataaccagctagcatcataatgatagtaccaaattcacacataacaatattaaccttaaatgtaaatgggctaactggcccaattaaaagacacagactggcaaattggataaagagtcaagacccatcggtgtgctatattcaagagacccacctcacttgcaaagacacacaaaggttcaaaataaagggatggaggaatatttaccaagcaaatggaaagcaaaaaagagcaggggttgcaatcctagtctctgataaaacagactttaaaccaacaaagataaaaaaagacaaagaaggacattacataatgacaaagttatcaatgcaaaaagaagtgctaactatcctaaatatatatgcacccaataagggagcacccagattcataaagcaagttcttagagacctacaaagagacttagacccccccacaacaatagcagtgggagactttaacaccccactgtcaatattagacagatcaacaagacagaaaattaacaaggacactcaggacttgaactcagctatggaccaagtggacctaatagacatctacagaactctccaccccaaatcaacagaatatacattcttctcagcaccacatcgcacttattctaaaattgaccacataattggaagtaaaacactcctcaacaaaggcaaaagaatgaagtcataacaaacagtctcccagaccatagtgcaatcaaattagaactcaggattaagaaactcactcaaaactgcacaactatgtggaaactgaacaacctgctcctgaatgaatactgggtaaataacaaaattaaggcagaaataaatacattctttaaaaccaatgagaacaaagacacaatgtaccagaatctctgagacacagctaaagcagtgtgtagagggaaatttatagcactaaatgcccacagaagaaagcagaaaagatctaaaaccaacacccttacatcacaattaaaaaaactagagaagcaagagcaaacaaattcaaaagccagcagaagacaagaaataactaagaccagagcagaactgaaggagatagagacacaaaaaccccctcaaaaaaataaatgaatccaggagctgcttttttgaaaactttaacaaaataggtagaccgctagccagactaataaagaaaagagagaagaatcaaatagacacaataaaaaatgataaaggggatatcaccactgatcccacagaaatacaaactaccatcagagaatactataaacacttctacacaaataaactagaaaatctagaagaaatggatgaattcctggacacagacaccatcccaagactaaaccaggaagaagtcgaatccctaaatagaccaatagcaagttctgaaattgaggcagtaattaatagcctaccaaccaaaaaaaagcccaggaccagatggattcacagacaaattctaccagaggtacaaagcggagctggtaccattccttctgaaactattccaaataaaagaaaaagagggactcctctctaactcattttatgagtccagcatcatcctgataccaaaatctggcagagacacaacaaaaaaagaaaattccaggccaatatccctgatgaacatcaatgcaaaaatcctcaataaaatgctggcaaactgaatccagcagcacatcaaaaagtttatccaccatgatcaagttggcttcatccctgggatgcaaggctggttcaacatatgcaaatcaataaatgtaatccatcacataaacagaaccaatgagaaaaaccacgattatctcaatagatgtagaaaacgccttcgacaaaattcaacaccccttcatgctaaaaactctcaataaactaagaatcgatagaacgtatctcaaaataataagagctatttatgacaaacccacggccaatatcacactgaatgggcaaaaacaggaagcattccctttgaaaaccggcacaagaaaaggatgccctctctcaccactcctattcaacatagtattggaagttctggccagggcaatcaggcaagagaaagaaataaaaggtatttgaataggaagagaggaagtcaaattgtctgtttgcagatgacatgattgtatatttagaaaaccctgttgtctcagcccaaaatctccttgagctgataagcaatttcagcaaagtgtcaggatacaaaatcaatgtgcaaaaataacaagcattcctatataccaataatagacaaacagagagccaagtcatgagtgaactcccattcgcaattcctacaaagagaataaaatacataggaatacaacttataagggatgtgaaggaccgcttcaaggagaactacaaaccactgctcaaggaaataagagaggacacaaacaaatggaaaaacattccatgcgcatggataggaaggatcaatatcatgaaaatggccacaccgcccaaagtaatttatagattcaatgctaaacccatcaagctaccactgactttcttcacagaattagaaaaaaaactactttaaatttcatatggaaccaaaaaagagcccgcataagccaagacaatgctaagcaaagagaacaaagctggaggcatcacgctacctgacttcaaactatactataaggctacagtaaccaaagcagcatagtactggtaccaaaacagatatacagaccaatggaacagaacagagtcctcagaaataacaccatacatcaacaacaaccatctgatctttgaaaaacctgatgacaacaagcaattgggaaaggattccctccctatttaataaatggtgttgggaaaactggctagccatatggagaaaactgaaactggcccccccttccttacaccttatacaaaaatggattaaagactaaaacataagacctaaaaccataaaaactctataagaaaacctaggcaatatcattcaggacataggcatgggcaaaaatttcatgactaaaacaccaaaagcaatggcaacaaaaggatacgaacagacacttctcaagagaagacatttatgtggccaacaaacatgtgaaaaaaagcttatcattactggtcatgacagaaaaggaaatcaaaaccacaatgagataccatctcatgccagctggaatggtgatcattaaaaagtcaggaaacaacagatactggagaggatgtggaaaaacaggaacgcttttacactgttggtgggaacataaattagttaaaccattgtggaagacaatgtggcgattcctcaaggatctagaaccagaaataccatttgacccagcaatcccattactgggtatatacccaaaggattataaatcattctactataaagacacatgcatacgtatgtttattgcagcactgttcacaatagcaaagacttggaaccaatccaaatgtccttcaatgatagaccagataaagaaaatgtggcacatatacgccatggaatactatgaagccataaaaaaggatgagttcatgtcctttgcagggacacggatgaagctggaaaccattattctcagcaaactaatacaggaacagaaaaccaaacaacgcatgttcccataagtgggagctgaacaatgagaacacatggacacagggagggcaacatcacacactggggcctgctgggggatgggggggctaagggagggatagcattaggaaaaatacctaatgtagatgacaggttaatgacacgtgtatacctatgtaacaaacctacatgttctgcacatgtatcccagaacttaaattataataaaaaagaaaaatttaaaatagacattgtttttccttgcagaggaggcagaacaagattgctgaagagaatcccccaggaatcatcccgtagcaggaacaccaaactgaacaactatccatgcaaaaaaaaaaaaaaaaaaaaaaaacaaccttcataagaatcagctggcacagtggtacatgcccataatctcagcactttggaaggtcaaggcgagtggatcatttgatctcagttcaagaccagtctgggcaacctgatgaaaccctgtctttacaaaatatgaaaaaattagctgggcatggtggcatgtgcctgtagtgccagctactcgggaggctgaggtgggaggatcacttcagcccaggaggtcaattgaggctggaatgagttgagatcacgccatgcactccagcctgggtgacagagtgagaccctgcctcaaaacaaacaaataaacacactaacaaacaaacaaaaaatccaaaatcaggtgagtaatcacggcacctggttttaacataatatcaaggaaagaagcatcgaagagggtaggaaagacagtcttgcgctgactacaccaaccctcctccaaccccaggcagcacagcactgagatagaatctgtgtgcttgggagagagagcgaaagtaagtatgggactttgcgctggaactcagtgctgctctgtaacagcagaacacaacacagggcattctgctggtgcccacagaaggagcatttagcttagtcctgggccagagagaaatcctccccccaaggagagtaattggttttcatcacattctgactaaagtagtctagggcccggaataaattggagtgacaggccacaaggactgcatcctttggcaagccttggtactgcactggccttggaggtaatggacttaagataaaacccagtgcaataccacccgtggcagctaagggaatccctgaggcacccctccccaactacttcagcttggggtaaggaaaaggaagagtagacagaactttgttttgcaaccggagtattggttcagtcacagtaaaataaagcaaaagacagatttctgaagcttttgatagcaagcttttgctccgggatggcatttatagattgaccctaggcaggaagggaatggctgccatgatgggatggactcagtcttggcagaattcaccacctgctaactaaagtggcctttggccttgaataaccagtggcagtcacgcaggactggccgtggaccttgggtgagccccaatactgtgctggtctgcaatgcttcagaggcaactcagcatagttccaactgtggtggctacaggaatgcctgtatcaccccccaccaacactgggcaggccagtacagagaaagactcctgattgaaggaaagggaaggtagagagcaagagactctgcctggtaacccagggaattctcccaattatcttcccaagtccatcaggactgtgtatgtaggagtctgcaagactcacagcgttcctgtgctttggatgctccttaatgccaaaatggctgcagtgactacaggcttaggtcacaacactcaatctgctttgatttcctggaaagccccctggagagtgacaggaatgaacaaacccaaactgtgaagactagctcttcgatgcctagacatcaatgaatatccacaattatcaagaacatctaggaaaacaggacctcaccaaacagactaatcctggagcaataaagatacgtgaccttttagatgggaaattcaaaatagcggtcttgagaaagctcaatttaattcaagataaaagagataaaaaattcagaattatatcagagaaacttaacaaagagactaaaatgatgaacaagcagaaattctgaagctcgaaaattcaacaagctgaaaatgcatcagtctcaacagcagaagaataaattagtgagcttgaagacaggtttatgaaaatacagtcagaagagaaaaaataataaaacaataatgaagtatgcctacaaaatctggaaaatagcccccaaaagtcataatctaagagttactggccttaaagagggcttacagaaagagattgaggtagaaagtgttttcaaagaaataatagcagagtacttttcaaactgagagaaagatatgaatatacaggtacaagaaggtcaaagaacaccaaatagattcaacccaaataagattaccttaaggcatataataattaaagtctcaaaagtaaaggacaaagaaaggatcctaaaagcggcaaaagaaaagaagtaacttcatatgaaggagttatactacatctggcagcaaacttcagcagaaacgctacaggccagaagagagtaggatgacaaactttagcagaaaccctggcaggccagaagagagtagaatagtattaggttggtgcacaagtaaccacggtttttgtaattacttttaatggcaaaaaccacgttaacttttgcaccaatctaatacatccaccgaaattatccttgaaacagggagacatgaagactctcctagactaataaaagctgagggatttcatcaacaccagactcatctttcagaaaatgctaaagggaagttcttcaatctgaaagaaaaggacattaacaagcaacaagaaatcatctgaaggtataaaactcactggtgaaagtaagtgcacagataaatacagaatactctaaccgctcatatctttagcaggaagattaaaagacaaacctatattgttagaagagttctaaactctaccttatctagagaaccttcttcttttagaaaatcaagcaaaacaactaagccaagacatgttaagaaaagtttgaaaagaaagctgtaaggaaatacaaggggagggattgttagatatgagttctaaatttcttttcaaagaattagtgtgtcagtatgttcaattctttgccttctagttttaaacttaacttcctcgtaaagcaacctttttcgattacctactccaccctgactcattctgatcatctgctccacccaacattccaatcacctgctccaccctaactcattccaattacctgctacctgctctgccctgactcccgccaaagcattcaccctgtcattctctttaaattagccaattggaattagtttagcccgtgcggtctaaccccagccaataggggaacgacagagcagcaggggccacatacgtcagggattagaaccccttcccatcccttgtccaaatgtgcgctcaccattgttccatctgtaagggtgcacccttctatatagaagtagcttgccttgctgaatattaaaaagaaaattttgtattcgagtgctatttcttttgcagcatcgaaactttctatataacactatcaaaaaaaaactactccaaaacttaaaatataaaaatatatagagacaaaaagtcaaaaagtgaagggatggagtagaagtgtacaggtttttagttttttctgtgcgtgtattttttcttttctttgcaatcagagttgtcatcagttgcaaataattggctataaattgttatttgctaacctcatagtaaccacaaaacaaaaacctctaataggtgcacaaaaaaataaaaagcaagaaattaaaacatactaccaaaaaataattatcacaaaggaaaacaaggaaaaaaatgggggaaaagccctagaaaataaccagaacaacaataaaaaggcagtagtaagtccttacctatcaataataatactgaatgtgaatggactaaattcttcactataaaaacatagactaacaacaaaaagacggaaaaagatactgcaccaaacagaaacccaaaaagagcccaagtagctttgtatctatttttagataaaatagatttcaacataaaaactatgaagaaagaaaaaaaggttatcatataatacaaaaggttttaattcagcaagaggacataaaaattataaatacatatctatccaacacagaagcatctagatatatagagtcaagtgtattagagttaaggagacagaacccaatacagtaatgacttgggacttcaacagcccactttcaccattggacagatcatctagacagaaagaaacaatgaatttaatctgcactatagattaaatggacctaatagacatttacagaagctgtcatccaacagccgcagaatacattcttctccttagcacatggaacatttctcaaggatggatcctaaattctccaatcaaaagacacagaagagctgaagggctaaacaaaacaaggccctactacctgctacatataagaaacccacttcatttataaaaacatagatagaccaaaagatggaaagagacattgcatgcaaacagaaatccaaaaagagcaccatcatgttaggccgcaaaacaagtctgataaaaagtatattttctaaccacaatggaataaaagtagaaataaataacaagtggaactttggaaactatacaaacatataagaattaaacaatacgtgcctgaacaaccaatgaagtaattaaggaaattaaaaaatgtcttgaaacaaatgaaaatggaaacacaacctactaaaacttatgagatacagttaaagctaacactaaagggaatgtttatagcaataaatgtgcaaatcaaaaagtagaaaaccaagaaataaacaacctagtaatgcatcttaaagaactagaaaagcaagagcatgccaagccccaaattaagaagagaaataataaagaaaacaagaaaataaataataaaaaacagaaataaaattgagacaaaaaaatagaaaagatcaatgaaatgaaaagggttgtttggaaagacagacaaaatcaatgaacctttacccagactaagaaaagaaaaaaaagaagatccaaataaaatcagagacaaaaaaggagacattacaattgatatcacaaaaattcaaaggatcattggagaccatttgaacaactgcatgccaataaattgtaaaacctagaagaaacgaataaattcctaggcacatacagcctaagaagaatgaaacattaagaaaaccaaaatcgaaatagacccataataagtttcaagatagaaacaataataaaaagtcccccatcacagaaaaggccaggacttcatggcttcactgagttctaccaaacatttaaagaagaactaacatcaatcctactcaaatcattctccaaaatcaaggaggatctccaaattcattttatgaggccagatttattctttttttttttttttttttttttgagacagagtctcactctgttgcccaggtgatctgcaacctccacctactgggttcaagcgattctcctgcctcagcctccagattagctgggattacaggcataagccaccatgcccagctaatttttgtattttttgtagagatggggtttcaccatgtcggccaggctggtctcaaactcctggcttcaagagatctgcctgcctcagcctcccaaagttctgggattactggcgtgagctaccatgcctggccccagatttattctgataccaaaaccagacaacgatacaacaacaacaaaaaagaaactacaggccagtatctctgatgaaaatagatataaaaatcttcaacaaaacacagcaaaccaaattcaacagcacattaaaaagatcatcataatcaagtgggattcatcccagggatgtaaggatggttcaacatatgtaaatcaatcagtgtgatacatggtatcaacagaatgaaggacacaaagtgtattgtcatttcaatagatgccaaaaaaatcttttttgataaaattcaatatcccttcataaaaactctcagcaaactggggacagaaggatcatccctcaacatgataaagccatacacaacaaacccacagttagtatcagactgaatgggggaaaaactgaaagcctttattctaggatctagaagaaggatgggcactttcaccactattactcaagttagtaacagaagtcctagccagagtaaacagacaagagaatgaaataaagggcatttaaattggaaaggagtaagtaaaattatcattgtttgcagctcatgtgatcttatactaacctaaagactccaacaaacgactattagaactaataaattcagtaacattgcagaatacaaaatcaacacacaaaaatccatagaatttctctatgccaacagtgacaacctatctgaaaaagaaatcaagaaggtgatcccatttacaatagctacaaataatattaaatatctagaaataaacttaaccaactacaatgcaaactatcaaacattgatgaaattaattgaagaggacacaaacaaatgaaaagacatcccatgctcatgggttgaaaaaaattgtattgttaaaatgacaatacttcccacagcaatctacagattcaaagccatccctatcaagagcaatgacattcttcacagaaatagaaaaaaaaaatcctaaaattgtatggaagcacaaaagaccccaaatagccaaaacaatcctgaccaaaaagaacagagctggtaactggtagacttaccacactaccaaacctcaaaatatactacaacgctatagtaaccaaaatagcacgatagtggcataaaaacagacatgtagaacaacagaacagagagtccagaaattaatctgtgtatttaaagccaattagttttttactaaggtgccaaaaacactcattgggaaaggacagtctcttcaataaatggtgttgggaaaactggatgcccacattcagaacaacaaaagtagaccccaactcttgccatatacaaaaatcaaagaaaaatgcattaaagacttacatctatgaaactaatcaaggaaaccattaggcaaaaactccaggacattggtctaggcaaagacttcttaaataagacctcaaaaacacaagcaactaaagcaagaaaataaaataaaataacaacaaatgagatctctccaagccaaaaagcttctgcacagcaatgaaaacaataaaatgaagatataacatgtagaatgggagaaaatatttcaaactaatatctgacaaaggattaataaccagaatatataagaatctcaaacgactcaataggaaaaaaaaatctgattttaaaatgggcaaaagatctgaggagacatttctcaaaaagacatacaaatggcaaacaggcatatgaaaaaaatgttccacattattaataatcagagaaatacaaatcaaaactataatgaggtatcaactcactccagttaaaatggcttttatcgaaaaggcagtcaatatcagatgctggtgagaatgtggagaaaggggaacccttgtacactgttggtggaaatgtaaactggcacagtcacaacagagaacagtatggagcttcctaaaaacacaacaaatagaactataatccagcaatcccactactgtgtatatacccaagagaaaggaaatcagtatataaaaggtatctgtactcccatgttaactgcagcactatacacaatagccaggatatggaatcaacctaactgtcaatcaatggatggataaagaaatgtggtacatatacacaatggaatgttattcagccataaaaaaaaaatgaaatcctgtcattttcaacaatatggatgtgactgacattataagggaaataagccaggcatagaaagacaagtatcacatgttctcacccatatgtggaagcttcaaaaaaattgaagtcatagagatagtgagtaaaaagatgttagcagaggctgggaagggtagtgttgagaggagaatcaagaggagatggttaatgggtagaaaaatatagttagatagaaggaataaaatatagtgttcagtagcacaatatagtaattacagctaacaataatttagtgtatgttttagaacaattaaatgagtggaaatgaaatgtccctaacacaaagaaatgacaaatacttgaggtaatggatatcccaattacctgatttgatcattacacattgtatgcttatatcaaatatcacatactccccattttatgtatccatagtaattaaaaattaaaatttttaaatatatgagttaagttaaaaaaattttggctcaaagcataaatatattaaaatcaaatctcagaagtaaaaaagaaagacaattagggttttatttatggtagtggcagacaggaccaacctttctgctgacgccaacaaaaaaactaaataatgaatgaaataaagtaatgtgaaattacttaccaaattccatgtgaaggtaaaccagaaacaaaccatacaccaagtaacttttgttctgaggacattttcctgtctagaagaaaaggctgagaaaaaaggctgagctaatggaagatgtgccggtctatggtaaaaaaatcaaagcacaaggccaggtgtggtggctcatgcctgtaatcctatcctttgacaggccaaggcaggaggatagcttgagcccaggaattcaggatgattgtgtgcaatacagcgagacctcatttaaaataaaaataaacacaaaaaatcaaaatcaaaaataaaaataaaagcacattgcctaacaaagctggggactcagataaactacccaatttatgttcagagtttaaggacaacatcattaggataagaggaaattgaaggaaaatagaattcatgatcttaaagtcttccttaatgtcatgtgtataacagaaggaatcccaactcttgaacatgaatagtgacttgggactgaaagcactcctagagacctttcctagaaaaatgtaccttcttaaaaaagatactattattctaggactcatatattcctataattttttaaatacaactggtactcaaggcacacaagaaaaaaatatcataagctagcagacacagacttagaaaatttagaaactggaattatcttcaacaaacaacaaatgaactatgaatatagtcggcccttcatagccacagattcactcaaccaaggattaaaaatacatgtatatttttaaaaacacgactataaaaaataatagaaatttttaaaaagccatgacagtataacaatatttacatagcatctacattgtattaggtaccataagcaatctagagattatttaaaatacgtgggaggatgtgtgtaggccgtatgcaaacatgatggcatgttatataaggaatttgagctgcctgtggattgtggtatctgcacggggttctgaaaccaatttccagcagatactaaggagcaactatactaggccaataaaagcaagattgtaattttcagcaggtaaccagaaacagtaagaatatcaccaatatctttaaaaagatactgatgcattgatctaataatctcgatgaatacagggcaagataaagaatgccacacgatgattgaacatttcctctacccccacaaccacacttgactaggagaaaaaaaaaaaagaagaaaagaattccacacaaaaagattagagtgaaacagcagaaaaattacaaccaaaaaaagaaacaaacaaaaaaaaattctaaaagagagatttccttcaaagcagcatgaattattaggttggtacaaaattaattgtggtttttgcattgttggaatttgccatttgatattggaatttttttttttttttttttttttttgagatggagtctctctctgttgcccaggctgggctgcagtggcgcgatctcggctcactgcaagctctgcctccagggttcacaccattctcctgcctcagccttctgagtagctgggactacaggcacccgccaccacgcctggctaattttttgtatttttagtagagacagggtctcaccatgttagccaggatggtatcgatctcctgacctcgtgatccgcccacctcagcctcccaaagtgctgggattacaggtgtgagccaccacacccggcctggaatacattcttaaataaatgtggttatgttatatgtcattttaatgggcatttcttgctttttttttttggctaatgacttattacttgctgtttatatttattttggactatggaaatgatgctagacaaaaagcaaagttgagtgattttcttatttaagttcaaagtgggtcgtaaaacagcagagacaacttgcaatatcaacaatgcatttggcccaggaactgctaatgaacgtacagtgcagtggtggttcaagaagttttgcaaaagataccagagccttgaggatgaggagtgtagtggcaggccactggaagttgacaacaaccaattgagagcaatcattgaagcagattgatcctcttacaattacatgagaagttgctgaagaactcaacgtaagaactcaacgtcaaccattccacagttgttcagtatttgaagcaaattgaaaaggtgaaaaagctcgataagtgggtgcctcaccagctgagcaaaaatttaaaaaaacaccgttttgaagtgttgtcttctcttattctccacaacaacgaaccatttctcaatcggactgtgaggtgcaacaaaaactagattttatatgacaagcaatgaccagctcagtggctggaccgcgaagaagctccaaagcacttcccaaagccaaacttgcaccaaaaaaggccatggtaactgtttgctggtctgctgccggtctgatccactacagctttctgaatcctggagaaaccattacatctgagaagtatgctcagcaaatcaatgagatgcacttaaaactgtgatgcctgcagccagcatgggtcaacagaaagggcccaattctccacagtaacacccaaccgcacactgcacaaccaacacttcaaaagttgaacgaactgggctacaaagttttgcctcatctgccatattcacctgacctctcaactgactaccactccttcaagcatctctacaacttttttcagggaaaatgcttccacaaccagcaggatgcaggaaaaagctttccaagagtttgtggaatcctgaagcatggatttttacattacaggaaaaaacaaacttatttcttgtcggcaaaaatgtgttgattgtaatgacctattttaattaataaagatatgttagagcctcgttataatgatttaaaattcgctgtcccaaaccacaatttcttttgtaccaacctaatgcattgacagctgatttctcaaaatcaataatgaaaaccaaaaacagtgaaatgttatcttcaaggtacaagtaaaacaaccacaaatctgtaatatcccccaaaacattcttcaagattgaaggcaaaacaaaaaattaagacaaagcaaaaaaattaagagaactgaccatcagaatgtctgcattatgaaacttctactgagtgtgctaaagtaaaagttaaaagattccaaaagaaaagtcagagacgcaggaagaaattaagacatggtaaacacataggaacatctagctcaaagtactgtccagcagcaatacagtaaaagtgacataagtaatttaaaattttctattgttcacactaaaagaaaacaaggtgaaatcaattataatttcaacatgtaatcataatgaaaagctgaggtattttacattgttttcatactgtctttgaaatatggtgtttatacaacattacaatgcagatgctaaattaaaactgccatataaaatacttgatctatatttttatataatttgcagctaatgccgggtgcagtggctcacgtctgtgatcccatcactttggaagcccaaggtgggtggatcacttgaggtcaggagtttgagaccagcctagccaaaatggtgaaactttgcctctactagaaataaaaacattagccaggtgtggtggcacatgcttgtaatcccagctactagggaggctgaggcaggagaatcacttgaacttgggaggcggaggttgcagtgagccaagatcatgccactggactccagcctgggcaacagagcgagactccatctccaggggggaaaaaatctccaaaaattaaaaaataataatttaataatttgcggttaagaaaggtttatgtatccgagttgttccaaacatacaggttttacagtaactgaatcaagtgtcagtttttaaacttaattgaacactaaataaaactaaaaattcagttcctcagtcatactagccacatttcaagtgctcaaaagccacacgcagctagtagctactgcaatgaatagcacaagcatagaacttgttatctggagtttaaactacgtatacaattcaaagaacaatgacagcctataagacctacatgaagataaaagttgccatcccagaagagagtaatgctccaagcacagagaagatattggccatactgctagaaatccctgagtaaaacagacaacccaattaaaacaaaaaacaaacaaacaaaaaaacctcccaaaaagatttaaaaagacaatgcacaaaagatttaagaattaaaaagacaattctagaaagaggaaattcaaatagccggtaagtttttgaaaaagtgctcaaactctttagtgtcctgggcagaataaattaaaacaacaataagataaagccacattcatcaagttgggaaaaaggaaaaataactcttggtgagacagtaaaagtaaagggatctaccatatactgctgtcggggtatacattggtgtatctactttggaaaaggcataactagtgaagttgaagataaacatacgtactctacaaaaacccatggtaatgtacattaagaatacatgtacaagaacattcataatagcattgttcataactactaaaaacggaacacaatccaaatgtttattaatattagactaaactgtggctcatttccattaagactttttatactatacttattatactatagattactacaatccaatataagaactagagctaaatgtactaatagagttatatcccagctgcatgagagaaaaagatacataatgatatgtaatatataatccacttacatacaattaagaaacaggcaaaacgaacctaaattgcttaggaatgctgacataggtggttaagaaatactaagaaagaaagcagtaaatgattgccataaaaatcagtatagtgttaaccactgaaaagaattgaggaaagggatgatcaggaatagaatggagaggggagcttctcaggtgccacagacgttctagttcttgactgtggcagcgcttacatagagttcacactttatagtttttcattatactatgtatcgatgtttgtatgcttaaatactaaatgtatggaaaaagacacaaaatatttaaaattgtagctaaggcacattaactgccttgctggtatttttttttttcattacaaagtggcagacaattggttacactataaagacagacaattggttacactacaaagaaaattttaaagcacaggagtctagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgggcgcggtggctcacgcctgtaatcccagcactttgggaggccgaggcgggaggatcatttgaggtcaagagatcgagaccagcctgaccaacatggtgaaaccccgtccctactgaaaacacaaaaaaattagccaggcgtggtggcacatgcctgtagtttcagctactcgggagggtgaggcaggagaactgcttgaacccaggagacagaggttgcagtgagccgagatcgcgccactgcactcgtctgggagacagagcgagactccgtctcaaaacaaaaaacaaacaaaaagaacccacccaacagaattaagtaccaacataataaatacgaagaattttagattcttggtttttaaaaaacatacaaagatgatattccttcaaaatatctttacaaaacatattgagactgtgatgctttatattgattgtatgaaaacaatgaaaaagaaccagcactgtttcactataaaagctttactaatgtaaatttataaatcctttcttaaatattttgagttaattctaattttatgatagaaattcattattttcagcaaaaacagctggcatttgggaaaccaaaggctcaaaaactaagaatagtaaccaaagaaacttgacaaaacagtccttttaaaactctcatctacactataaggggaaactttgatcacgtcccttctccttcatcaatcgtagaactcaacattaaggactacacaatcccacatccctctccgagaaaaagcaaaggctttgtgttgtagcaacaacgcaagacatggagggaagctccactcaagacttccctgcctgctccttccccaaagccactccagaataccagggagggttgagaggtaaggcatgaagggcgcaatatccaatatgagcaacgcgtgtgatgcatctggtcaaaatgcatacagaggacttgtctctgtccctagatagaagtcctccgtcctgcagtcatgagggtcaattgctgaggcttcacagttcccttctctcttacactcggaccgtcacgctcctcacctactaccccgatgcagaggtagactcaggatccctgcacttgtcaaggattcctcggcaagctcacggggcgggagtggccacaagacggagctcgcctggtcctggccttcccggcctatacaagcctgcccccttcccaattcccaatctccacagccttccatcctcccactttcgattcaccttgcgccaccgacgcccctggccttcgtttgcagcaagtttacccccaccattacctctcgcataaaagcctgcatttaccaggtcaaagaggggaaccaacgcctgcaggaatcgcttcaccgaatcgcctggccgcgtcctctgctagacttcacctgccgctgcggaccgtacacaaccactcccggcatgc

SEQ ID NO: 2658 - DNA, 90365 bp, Homo sapiens
  source 1..90365: mol_type = genomic DNA
actttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatgatttgcatatgcagtttttctttagctatgtttttttttttttttatactttaagttttagggtacatgtgcacattgtgcaggttagttacataggtatacatgtgccatgctggtgcgctgcacccactaactcgtcatctagcattaggtatatctcctaatgctatccctcccccatccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtgtttccagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggataaaatactggcaaaacgaatccagcagcacatcaaaaagcttatccaccatgatcaagtgggcttcatccctgggatgcaaggctggttcaatatacgcaaatcaatgaatgtaatccagcatataaacagagccaaagacaaaaaacacatgattatctcaatagatgcagaaaaagcctttgacaaaattcaacaacccttcatgctaaaaactctcaataaattagggattgatggggtgtatttcaaaataataagagctatctatgacaaacccacagccaatatcatactgaatgggcaaaaactggaagcattccctttgaaaactggcacaagacagggatgccctctctcaccactcgtattcaacatagtgttggaagttctggccagggcaattaggcaggagaaggaaataaagggtattcaattaggaaaagaggaagtcaaattgtccgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagctactgctcaaggaaataaaagaggatacaaacaaatggaagaacattccatgctcttgggtaggaagaatcaatattgtgaaaatggccatactgcccaaggtaatttacagattcaatgccatccccatcaagctaccaatgactttcttcacagaattggaaaaaactacttaagttcatatggaaccaaaaaagagcccacatcgccaaggcaatcctaagctatgtgttcttaaagaggggagtggtagctttgtaacttacagtgaggcttacaccttgacaactgcaagaatgaggatagtggtgagtgaagggagatttgttaattatggcatttccctctattatcgtctaaacagattatattcccactaaagtatgtgtgttggtcctgccagtattagaaaccagaggcttgttggcattgtgtcacacagtacacaccaatggattctcagattttctagggtaaaggtgaaggatggggcagcacttaggttatggtggtttgaaagaaactgaattgctttctaaaccagatgaggatcagagtgcgaaccatggtgaaatatgcatggaaactacagaaagactgaagtgtttcttacggtgttttctgcaaaacgtgattcattaggacattaacaggtattacgttttcaacatatacagcattatgatacagtaagtttggaccaaacaggtattcattccccagagcctttcacatgcacgagaatcagtcattttaacaagaattccgtttctgctgggccacttggatcccttggattcagatgtaaaaacacactgaaatattcctcctttcacctgcttttcagtttgaggtaatcagattgaaaagcaggagttcatgcattttttggttctatttttcctcctctagtaaatgaagaaaataagctatatgtataagtttacattattcttgaaccgctttttaaactagggtttttcatatttgtttttattgatgacaattaaagcaatttaagagacgaagttagctcaaaactcttgcgaatagattttagcatttttgtatgagggaatatggaaaggccaacaagcagcactgttcctccccacaaaaatgccttgggaatataataggcgtacacttcatttgtgtaacttttcctaatgtatttttttttaatttgctttataacggtttcatgtttacctcaattggtacttagtcttaaaatctttctttatacttggttattgatggatcttctgcagctcttatgtagccaatgagacagatgagggctgtcagcttttaagtgacatcttaagctaataagaaattggaatcctcaagtcatttcatgaggctgttaccctttaagacaaataatactttcctcaaatagttcagaaaatttttaaaaggatcacttagagcataagtgtaaaattcttgcttctagtatataatagtgatgttaccatgtcaagtattttggtgaaatatcccctaaaaatgtgtagactacggcacagattgagtatgcaagccttagcttgaatgagactgctgagaagtaaatgacagggatctgaatacttagcaggcttaactttttgcagggaaggaaaggctatgtatgcaaaagaataggttgtaactactgaagagctactttatgctcagaaaccttttattccactttgtatccaagatttcattaaaacattgttccttagagcatactttaaaaactatttggtaaggaatccactgttgaacttcaggtcttaatagcactggctttggtgctaaactgagttgaattccaagcctgttggccattcccagcattgccactgctgtgttagttttctcatctgtaaataactgcctacatctcacagggcctctaatagttaaatagattgtaagctgcacaagcatagggacagtctgtcttttgtaaacctcccatgcacacaataggaaatcaaatattcttgaacaaatgaagtcactaagtgctcattaaatttcattttaaatatatgcctctgttaattcatggatcttggaacttacttaaaagacaatgctttgacggacatttccacattcctcatagggatttactttttaatacaaacaggttcagttaacattgccatacacatctcattacttttgggagtgcttttccagaaatctctggtagtcacgtcacttcatgatggggctacgttctgagaaatgtgtctttgggtgatttcatcactgtatgaacatcacagagtatacttacacagaccctgatgatatgtatatagcctgttacacacttaggctatacagatagcctagcctattactcttcagctatagcactgtacagaatgttactgtaatcatactgtaggcaactgtaacacaatggtaaaacatttgtatatttagacatagaaaaggtacagtaaaaatatggtataatcttatgagaccaccctttatacaatgtcattgaccaaaatgttacgtggtgccatgactatacttgttaagaaggaaaattccagtccttttgacctatggtaggctcaacaatctgtaattttagaaaatcctacaagggattctgatgtggatggtatgagtaccacattttgagatgtctagaagaaaaatcttcaaactccttggcctttttcttccatggaaccatcttctgactaagctggttagtcttctgaactagaaaacctgggtctgggatagaatccaaaatttgcatgtggacagaaaaaaacactgcagcaaacctgctgtaccaaaggttacttattatacttcagtgcttaccattgttttttttactcctttggtttaaggtttgtaaagacatctagctgttaggttgaagtgagctcttcaaatagaccattatatatataagtgttaaaaaagcacatggtctagtccctaaaacagtcatattttattcttctgaacagctacttacaaagtaatctcaatcagtgaaattataaatcatgtaactgttcatgattaaaaggcaagacacagccaagacagtagatgggcaagtctcacataaatacaagaatgtttatagaatgtttagcatatcatgttaatggacaatagttttccgttctctacagaagtatgaatgaaatgccaaagttgaagtcactggttatattcataaccagcttagtgaggatgttgcccactgcctcacatctgtaggacagttgggatatttctgcagagcattcataatttgagtattatccaaaagcagtttcatcagctggtactctctctgtgaatttcctgaagttctttccatgggctttattaattctaattgctgcaagtgttcaaaagcctgaaagatgaaagaaatagtttaggttgaataggagaggagagtgacaactctcctgttctctcccagagaacagttagcattttggtcagctgcagaacagagtactgggaagcaaaatgtaacaacaatcaataggattaaaaaaactctcacaaccccatgaaaactcatattatcaggtaaaacagtgtcagtgcacacttacttgtccatatattgttgaatgtaaacacggcaaactttaattcaatatatacaatatggttttcttcctagcctcattctctatcatagctcctcctagtactttaataaatagtttccagttctctgtaaaaacctaagaatcagataagactttctgatcaattccctaggctactcagatttgcatttatattttgtctgtctctatttttgctttgctatgtaaaaaggtaacacagctgtaacagagggaggcagaaaaagacccttgagtcaactagacatattcagctgatcctgtaagtaaaggattcagcaggctagtatggacatggaggagaagggacaggctcctgtttcctctaagaagtctgactgagactgtcacaaccttcttccatcttccccatcttaatagggctctttcttgtctacttcctcttatccttaatattcacctattatatcttttctaaccttgagtgttgtgttaggtacgttattaggttatgaaaaaaaaaaccattaaatcatgatatactaaccattaaataatgatacactgaaatagattcctgaggattctattatattcttacaactcactgtaaaaaacatcactggaacatattctctatgtatcacataaattcttctgatagagaaacagctcagataccttcatatctgaacatgagaaaatactggaggctgcaggtgttaagagctgaatagaactgtgcagatttaaaacatttctaaatagcaaaatacttcataattgaaaattcagaaatgagcagctacaaattattgagaatttaaatgcaggctgggcgcagtggctcacgcctgtaatcccagcactttgggaggccgaggtgggcggatcatgaggtcaggagtttgagaccagcctgaccaacatggtgaaacactgtctctactaagaatacaaaaattagatgggcatagtggtgcacgcctgtaatcccagctattcaggaggctgaggcaggagaatcgcttaacttgggaggcagaggttgcagtgagccaagattgcgcccgccactgtactccagcgtaggcgacaggagactccatctcaaaaaaaaaaaaaaaaaaaaaatttaaatacttgggtaacctttccattttcacagctctcacaaaataagactattaggggaaaaaaaccctccagtattgtaaaatacttttcctgtttctttgaagaaatggcaatgctctgtactcatttttgttgctacaagaaatgaaattctggttactagggcctataagggatgccaatggacttggggaatccactgttttaaaagtttctttccttaaaatcttcaagagctgcactgtccacgctaggctactgagcacttcaatgtgtgactcaatttttttttaaacttaaaaatggatatttagttctattagaaaattctgagcatgtttagaacaatttcaaaatgtaaatttactttctcagctatacattttatggaatctaaacagcaagaatttccagtaaacatttaggccattgagatgtgcttaaatataatgtacaccaaatgttaaagacttaattcaaaagaatgtaaaataccttactgttcttctataatgattatagaatgacacatttttgatatgttgcattaaatatataattaaaattaaacctttttatttttcttacaggtactagaaaatttaaaactacattacatggctcacattatctttgtagtggacaatggtaatctacatgaagtcctgaagttgtaaaactcatgactcagcccccaaataacactttctctgtatgccctcacaggccaataagattttgtcttttaagtttcttaatggctctaattttcattgttttctccttttactgctgagattataaaagccaatccttgggttggaaagggaaaggttatatcacacactatactgaatagttgttttcgggatgcaagtgctctgaagagacagcagagggcagtatacctccacaaactaaaacaaccggtcacttcctcagatttttccaaaatatttcatttttagataattttcttgttttgaaaaaaatctctataatacttaatgtttaaaaatgaaagtgcaattttaatacataatcaaattggatgtaaaaaatatacttgtctgtagaaaaatgacagcaaactaaatcttaccttcatgacaacaggtttttcaaaattataaacggaatgtgctttcctttgaacaaacttctgaaactctgagtagaaagcaatgacaacattataccttcaaataagcagtggggaagagtcagaaaaaagctacttaagtctcatctcaccattatagaccatttgaaaattaaatggctcttcctcatagatgtcatttaaatgtttcattgctattataagacagatttccaagactgatagacctacagtaaaagggaaaaaaaactatcagtttaatgacatataagactgaaataactgttctccaaagaatacaatatagtgaaagatctatggttctgaggggtgaagaaggtcaagattcttctagatttcaatgtgtttcaattatctatataaatttaagttacttaacctccctgagcttagtttttttcctatctgcaaaataaggatatttttaaacttttagaaatgtcacaaagattggcgaaatattatcaggcactcaccatatggcccacagtaaacaaaataaacttcaattgttatgtgactttaaatcacacagggcctttgcgtaggatttatctagagacttcctaaactcctggaaattatatccaaatctgtgtattccttttttccccggagaggaaaaggttcattacatttggaaaaggaaataacaaacccaaaatgactgaaacccagagaatgctcttcagtagttcttgatacaatgataacatcagcaacacagtcttacctggatttccaatgtggcaaaagaggcagagcgtcaaatttttttttcactttaaatgggagtgatagtacctttaaaaggactaagttaaaggctatatggatacgaaagtattttataaagcattatgcccacgttaattgtaattttaaaaacattccattatctaaattcaaagttttaaaaaccacaatttaaaaaataaggctgggttctcaccatgtacaatatttgctttcgagtccatgctacacagttggcttgcttccattagatctacggcagtcataaatgggtgcgatgctgttactcgatttaaagcaagcatctagggaaagacagatcagaaaaacaattacgtatttacatgggcattttggagatactgtgcaaaacttctgaatttgtatagttaattcttaagggagagtaaatattaatgcttaggaaggtattctcaaattcagttgtattaaaatacagtatttcaatttgtgtgtcacataactgcagatgtaaagcataaaaaaagttcctgctgctctctctaacccatcccagttgcataacttgtttacttactgcttggaagaacaatgtttaaagaggagtaggtcaaggagaagaaactgaaaataattaagaatacttactaataaaagccccaaacacaagcccaaaaggcagatctacgccttacttgttaactttttcaccacccaatcatccagccaggttagtattaatttagacagaagttagctgttttatgttcaattgtacaaaaaagaaaagaaaatagcacatttatactcaggaataactctccttgaaagcacagtctccttctcttgtgctgcttctctgttcaaaaatgaacagaggtcctggaccagagttgctactcaagtatttgaagatttccttccttccttctttatttgtatttttcatgaaagttaaatttggtcatttagggttacaagatttagcagataaaaatgcatgacctctggttaaatttcaatttcaaataaacaataaatagtttcttagtagtatgtgccatgcaatatttgggatataattatccaagaaactctccttcaccttaacaagggcgcaactgattagctgggcagagagtttggcaatccttgtccttcattctcctactggttgggacctagattgccagtgctccctccctttctctctcctttcctttttcctttagttattaattttttaatttttattttttaacttcatttttccataagttattgtggtatgggtggtatttggttacatgagtaagttctttagtggtgatttgtgagactttggtgaatgcatcacttgagcagtatacactgcatcatatttgtagtcttttatccctcgccccactggaaaacaatgtggagattccttaaagaactaaaagtagaactaccatttgatacagccatcccactacagggcatctacccagaggaaaagaagttattatttgaaaaagaaagaagtcattatttgaaaaagatgcttgcatgtgcatgtttatagcagcaaaactcacaattgcaaaatcgtagaaccaacccaaatgcccatcaatcaacgagtggataaagaaactgtggtatatatatactatggatatggataaagaaactgtggtatatatatactatggatatatggatatatatatatatgtggtatatatatactatggatactacacagtcataaaaaggaatgaactaacagcatttgcagtgacctggatgagactggagactattattctaagtgaagtaactcaggaatggaaaaccaaacatcgtatgttctcactgatatgatatgtgggagctaagctatgaggacacaaaggcataaattttttttaacatatacaaaggcaacagagaataataaatatctatgactactttacctgcttaagaaatatgattttagagttgaagcccatctcctccggattggactctactcttccccacataaaacaaccaagtatgtctatactattaggttggtgcaaaagtaattgccattttgggcactgaaagtaatggtaacttttgcaccaacctaatacttctactacatatacatgtattatacaacagagtaattttcaacttttatataaatatattgtatcttcacaactctcttcactgtgaggttttacccatgttgaggcagtatcaattctggtttattcattttttcattatatttctttgtatatatccacgattattcatttcctaatttcctattgacagacatctttcatttctttttttttcccaattataaacaagactgcaataaacaaccttggacatgtcttcctgtgcattaggtaactagactttctctaattagtatgtttctctagttacctaatttgctaaataaattgctctccaaagcacttacacatatttacattggcagcagcaataaatattaatagtcacagtcatgataccatcaagcataatctttaacacccactagattggcaagaaaaaaaaagtttaattgtagtatttctctggttactggagaggctgaaaatctgtaatctataatgagcttccacagtaagacaatgacaacaaataatgggatgagctaagaatatgagtaagcagccctcaaagtagaatcccatatgacaaaaaacaagccattatttaattcattaccatgaattaaaaatgtaatagaaaaatggcagaacaatggccgttaatattgacaatactgaggcagagatattttcccagatggagatgtgtgtgtatatatatatacatacacacatacacacacacacccctcctctaaaaattactagtccccaaattccttcatgatatgctgaaaatggcagtatgcttttgacaatagaagaaaagtaaatagggataaaaagacttaaattcctcagcagaagcagcaatgaggaaagaaaacttgtatataaacatgggtgaaccatacagccaagtaggacacaaacttgaagccagagagctttggattaagtcctggctttgttatctactagtagtgtgaccttcggcaagttacttagctttaaggagcctcaatttctttaggggtaagaataaaaaataagattattccaatggccagacataatataggtactactagcatcaacagtacttggctcatatgccagtccataaatggtagctactgtcattattattctattattattaaaaatgacctttctatgaaaccaaaactatcttgtctttcaaaggtatttgccataattttctagaaatattagactaaaaccaaatactcttagtgaagaaagttaattttcagaacaattaagtacttcttgtttgatattggtattatgtaagcttaagatataattacttggcaaaacatcataaccaggtaggatttattccaggtatataaggctggttcaacactcaaaaaataacataatcaaatatatcaacaggttaaagagaaacatggtcatgcgaaacgatcgagaataagcatttgacaaaatccaacacccatttataagaaactctcagcaagttacaaacagatgaggattacctcaacctgataatgaacatgtataaaaaacctacagctaacattatacttaatggtaaaagtttgaatcctttcttcctaagactgggaacaagaaaggatgtccactctcactgctctaattcaacataacactggaaattctagccattgcaaaaaagcaagaaaagaaataaaaggcatacagattggaaagaaaaaaaaaaccgtcactatttgtgaaaaatgtaatggtctacatcaaaagtcccaaggaatctattaaaaaacctcttagaataagtgagttcagcatagactataagtcaatcacatttctatatattaatgtgtatatatataatcaatcacatattctatatgtaatgaatatgtgggaaatgtaatgaatatgtgggaaaccaaaatttcaaaacccatttacaattgttctaacaaattaaatattggtatacacattaaataagtacatcatctgtgtagtaagagctataaaatgctgatgaaagtaatcaaacaagaaatcaaataaaaggagatatgaaccctattcagagattggaacactcgatgtagtgttccaatgcatgtcgattctcccaaaatttacctacaggtttaatcaattcccataaaaacttaattatctaatgaaagatagaaaatgataaaagtaggctgggcacagtggttgatgcttgtaatgtcagcacttagggaggcagaggtgggaggatggcttaaggccaggagttcgcaaccagtctgagcaacaaagtgagaccccgtcactattaaaaacaaaaacaaagcaacaagcaataaaacaaaactaatacaaaccaatagcatgtgtaatgaccgcaggtttttgctgatattgaaatgcttctgtagtacttcttgcacacttctatcttctgagagatactaaaaggaaaaaaaaaaaaaaagccaaaattgaggaaagatgtagtttaaaacctaaatataatcctgtgccttactggttggtgtaccttagtaactctatctaatattaattcattattaaatagatgttggtcttatttgtagaacactaaaaccaaaataaagtttccagtctactgattttcttatcctgttctttacgttaattcaataaacacaatgataaaacaatcctggctaaccccaaattcgtacttgaataagggaaactactacacagtcatactagtgaaatgaacaaaatgcagcacaaaaacagaagtgcatgagttactgtacctagggatacaaggtaaagtattacaaagaatgcttaaactggatgagacaagagatttaaaaaagaaggaagaacattccagttacagggaacagcatgagtagcaggaaaattatcacattggcagaaaatgagtagtcacgtactggagtttcaattactggcaaagtgaatgtacaaaaagaaaaggcagaaaaacctaactggaggtagctgtccagacaagaggtaaagtgggtcggaattatctgagtgttatgaagaaaaaagaattaagacgtttataggagtacatctggtagagaattaactggtagcagaagagaaggaagggtttgaaaggtagaagataaaaatcaaacatgatctatgggaaacaaaatggcctgtgaaaagtgaaatgtggtcaaaaaatgaatcttggattattaatatttaagtagtaggtgggaaaagagaaaaactaagaaattaagaaagataccaaagactggaagagaatctaagacagagtagagatctagaaaacaagggaacaaagttttaagagagaagtgaggttcaacaatataaactactttgtaaaaagatatatttgagaagaggctaatggctttagaaattcaaagatcaccacagccctttgagaaagtaccatctaaagaggcaagtgactgcagtaattagggttgaatggaaggtgaggaacactggcattgaagaaaagattagatgaaaaaagagtaaattcagaagtagcagagccaagaaaggcctggaaaagattgtcataatttttcaaaaatcatctgcatggaataaggattcttttaaaaaaaaaaaaaagcccagaaaactaagcatttctgtattttctagagctgtaattatatgtctttactttgtccactctaagaagaccagattcagaagtaagttctagtctactggaataaaattttatactctcaggaaatatattatcttaattatagttcccactcccttgctattgtttctagtcttctctttgtattttaaaggacttctggttactatatctttttctatcacaaacacggtagaatatccttggaagtacacagggtgaacataaaaaaaacaaagtaataccttttggaaattaaaaaaaaatttgtttagcttttccagttttaaaattgcaatatggaagatatgtggctaaatatcacaggcaaactatagtcttggtttctgtaatctgtaagttgtaaaagttgatgtggtaaaatcggagcacttaggaaaactaaagaaaatcacctgggacaaaattgaagaaattttctctgcaagaatcaattatttttaaaacctgcatttgcctctctttgacatgatgcttcaaaggttaatcttctatactccaccttcctactttatctctttattttttagtggtttgactccaattccccctctttctaaaagctatcgccttcttgcttctataattacttattctgctttttaaaatgcctaccttatctacatgagccatttaaacaaaaaaaattgtctaacctcgttcattatatttttaattccatcttgattcaaacactatactctatttgaggataaggctattatcaacaaccacataagctacagtactttgggagatttcatttgaggagaataaggtatgattcttttaaatgttcttttcaaaggatccctcttatactgccatgctaagatagagtctactttgcttatttgactcatttgaagtagggctaaaacaaaccttcaaattaggcaggatatcaaggttcaatcttatcctgaagatatttcttggatgagattccatgtgtgacctgttatctgtatcactgctattggcttaatcctgccattcaaaatagcttcctggataatcggcactaagagaaagaatagctcccttaatgcagctaccaccctactccacaaggcagggactctgaccatggtgctgacagatttttcaagtgaagctcattttattcacataccaaagacaggcacaagatgatcaggataggggaagaaaatattagaactcagagacacaaacaccagtgatgctggttctacttaatgaaactgactattaagactatcaaaatgatgacaagacagtgctcacatgcaggggatttaaggtctgcaacaaaagtccagaaagtagattagttatgctactaacacatggttatcattttctaagtcacgcagttatacttcttcaccagtaactcccagcatcctctttatttatagactcaatttgagatgctcagaatgcaacacagttgggaaggaaagtggatgaaaaatggcacagtgcaacctagaccatgtagttaccttaagaagattaagtgtgagcaggtatggaaaaaaaaaagcccatggaaagtacagacatttaaatactatgaaagactacatttgaatctctaaaacagccagaaaaacatactggtggaataagacaatcagttcaggagttgtagaagatgaaagtctgtgaggcactgaaaagtagatctaaaagctgaagatccagaggtctggttcacaccagaccccagtaaaaggggacaatgtgggagtaccaactacaaagaaggtgctcctatagatggaatcctataattagaaatagtatcaaagacacttggtcaggtaattgaaatacccgagtctcaggaaagattgagtggaagggaggatccatacctaattatatcaaggcataatatctgaattttaaagataatgtcagctatttttacatacaattatgtatagttgtattaagaaaaagaacagggaattattaatcataacaatgggaaaaaagtaatataaaaatatgtaggctttgagtcctttatgtaaaaacaacatatttagcatgtatataaactctgcaatgttgtagaccaagtaattattccatagtagaagaaaggagaattgatatagtcttaagggaaacttccactgtttatcatgtattcttttgcactaattacattttgttcaataaacttttatgatattttaaaaaaatgaaatgtgtcaaaatactgcttacatgagcagactatattttataatcaaacaataatcatttaaagaacaaactaaatgcaaaacgcttccaatttagtattagtatttaaaaattcacggtaaaaatacaatctaccactattgctttaaaataaaatgatcctttttatagagtcagtgaatatagactgtgtaattctattcaaagatctaattatccttaccggtattttaacattataaatcagtttttcccaattccttcagagccagggactctatattattttccactctcacgaggccaatattttttgagattctagcataagggacttattcattaatgatgtttttcaattatattattaaatacacacacatatgcatacttcctcctttctctttgccaactgaaactttttgacagcgtaagattaaaatgctagtgtgttgagaatattttaagcacaggtaaatttatagtctcaaaggtgtggcaaatctttaaaacaacatatgaacctgcctttgtatctaagactctcaagtctccagggactgtgagatgtgatcacctattagataatataactggaggtgccacagtctgtactgcctcttaaggcccaacaaaataaaagctgaagttgctaatgaaaactggaagaaaaaaaatatccacacataataggtatgagtcattaacatttatttatcattatttactatttattattattgctaaatatgtaaaatatataaaataaaattatctaaaatataaaccacatacagataaaactaaagcctcattaaagtttacttcaaactaataacataaatcctaaagcttaactgtgatgttcttttgagatagaatttaggagaaatgacatttcaactgtctaagaagaaaatttttaaaaagtatataatttgtattactgcagcattatccttcagcaatattagaaactttgtgttaatttactaatttctaaaatttgtgttttaattgctttaaatcatatagcaaggaacatttagctttattgccttttaagatacctgaacattttcattccacttctcagcaaaaaccttgtctggaaactctgcaggtagagataactgttctttaaatattttaacatactgtggaaaaccaaatgaattcattaagtgtatctgccggtgagaaaatcttgacttcactcttttttctaagagttccaaaatatccttaaaaacaaacagaaatctctataaggaagatgaatgtttttaaaaaaacaaaaacactgtaccaatgttagaggtataagtaaactatcacctataattagtaatgtttagtctacaatacataattaaacatttaaaacattttatgcaaactaaataatccacctccaggcatttgctggcttggtgatgtcatgcctttttcccaccatgttactctcagctaatctgtaacattccaagacccaacatgactgtttaaaaaaactgacaatattgaatagctatatgtcacaataacaccaagagtgtcaataaggaattctgtacattctatgaagaactgagattaaaaaattaatagcatgataggcagcaggaaccaactttaggagaggaaagtggcagaaatgcaacatggcattcgtaagttatcttccggcttttttttttttatagtaatgcttttagactctatttgtatttgtgctatttttccttaaaaagaaatcaggaatcaaatttactgtcaaagaacactaaaaaccaaaggataactaatatgtactgcttgtaaggacatacgaagtgttcttaaatgaagaaaatacttccacaaaactgataggcattcaaactatccaagacatcaaaagcacaataggtaagctgtcttcctaagtcacatatattgcaggaactgtcattcctaaatctctttttaataatgaacttgagcaatttttcaaaatatattatagtacacagcatattatatataatatatataatttatattatatatgtatatatacatctatatatatacagtatagtataatatatatttattacttaagttacactccaaggtatacaaccaagacaaatgaaaccagataaccacaaaaaaagtgtatgtgaatgtttgcagcagtattatttttaatagcttaagaaatataaacaacccaaatgtccatcaactgatgaatggataaacaaagtgtggtatatctacacaacagaatattatttggtaataaaaaggaataaagggctgatatatgctgtaacacagatcaactctgaaaacatgttaaagaagccagtcacacaaaactatacgttgtatgattcaaaaattactaaacagtcagaaagtggattagcagattagtggttgcatagggctggggagggaacaggggatttggggtgatcactaaaaggtacgtggctcttaaactgtggtgataaatgcacaactctatgaataaacaaaaaccctgttaattgtataatttaaatgagtgagttgtatggtataaattacatctcaataaagctgttttaaaaacagtgacatgatatttgatgactttaaggaattacagctaatataacaattatattagggaaatatatttttaaagagctcttatctcctaaaaatacattctaaaatacttactgataaaatgatataatacctagtttttgcctcaaaataatacaggaatgaaaggagatgttgaggataaataaaattagtctgtagtaattgaatcttggcaatgagtggagaagggaattcagggctcattatttattctttcctatgtatattgttgaaatgttataaagatttttaaaaggggagtagtttaagcccagaaatatacatctccacatctagccagatgactctcataatacctacgtgaagaaatcatgatatagaggaaagaattcaagtgatcaaaatgggatcatggttagtttgggaaggtggacaggaaagactaatagcctgaggtaggaggtgggagggtgaataaaaaattttgaatgtttttatgaggtcaaagaaaagtatagtgccagcatgagaactaaaagacaagaaaggttatattcagagattcagatattgtacatttattttctattaagaaagagttctaggtcacccatataggtagacagtggaagtaataatctatacaagcaacaattcagaccctaaatttgggaatgaaaagagatggaagtaaatactgtctttgtagtaggcagtaatgacagaagttggcaatgtgggcatacaggaactagtaaaaacaaaacaaaaccaaaaaacaaaaatggaattactcccaatggggaagaagatgcttgctggcaaagtcactactccctctatacttttgttctctccctataaacgtggatacacagataaaattatacttgaggccaggcgcagtggctcacgcctgtaatcccagcactttgggaggccaaggggggtagatcacgaggtcaggagttcgagagcagcctgggcaacatggtgaaaccccatctctactaaacatacaaaaattagccaggcatggcggtgtgtggctgtaatcccagctactcgggaggctaaggcaggagaattgcttgaaccccgaaggtggaggttgcagtgagccgagattatgccattgtactccagcctgggcgacagagcaagactccatctcaaaaaaaaaaaaaaagaaaaagaaaaaaaattacacttgaaagaactacacagttggagaattatatatatacaataaaaaagaacatctgataacactgctaagaagttactggcattttatttggtccgttattgggtcaacaacactcaccacagccacttccacccaaaggaagatttttttttttttggcaagaaggaggatgcttctttgatccttgtcatcgcctgctgcttttggcaaggaggaataaagatatgtggagcaccagccagtgatgtatgagggatgtttatactaaagccatgtatcataagctctagagcacaggaaaggaggggcaaatgacagtcactctatagagaaacagcactggaaggaggactgttgaaatatgaattagaaaaaagtttcacttttctgaaaaagaaaaagggttgtaggaaaggagatgtgaacatgtaaatgtgcctgacacatctgccgagaatggagggggaagaggattgcaagaaagctatggaggcatggcagtcatagcatgagaaaagagacaactttgctatggtttggatatggtttgtccccaccaaatctcatgttgaaatttaattgccagtgcaacagtgggaagtcactggagtggaccctcataaatagatttaatgccttcttactggagtgagttcttgttctcatggggatagattagttcttgagacagtgagttgttataaattgaggttccaactcctatctggttcgtttttgcacatttcggttccccatttgaccttccaccatgtcatgcagcatgaaaacccttgcaacaaagccagtgccatgcgcttgaatttttcagcctgcagaactgtgagataaataaacttcttttctttaaaaattaccaagtctcaggtattatgttatagcaacacaaaatgggccaaggcactcttcaataccagttttatctgaattcagtaagttaatactacatgcgtgtaagaaggtaaacacaaaaaggcctgtactgctgtccaaaggtacacatggttcaatatgtacagagccttcacaaggcaaagtgatagtgatattgagactatagttaaaatcattctaaaatatcccatggaatgaagaagccactatctactgtcagtgcttggtagaatcttttccatttctggagatgtgtactttgaaagttggaatagtattacttagagttgatttcaagccttttcaaaatatggaaaaaaatcttaaaataaaaactattaccaagttttctcaaatattggtgagatttaaccgcctcattacttgataatgtagaaattatatttattagcataatctgatttcatacttttttcttcagtaatttcactgggaggagggaggtattcattaatgggctaaggtaactactaaactgttttcctcaatttgagttgaaagcaggataaatacaccaggcactgctgaaacaaaatttttaaaatgacctaaataagtgaaaaaaactagcagtgtcagcaattaagcttgaattttaaaatattataatcaatttttttaatgaacagaaagacttaccaatctacatgtaagaccaataactgctattggggtctgtgcagactgagaaatgtcaaaaagattatagagaagtgtttggtttttatgatgagcaaaaagatcaaattcatctaatatgaagatcactgggcaactgctagttcggtcacctaagataaaataagagcattacattaataagaaattatatccacctttcctaaatttccaaaccatttactatatttcagtttttaaaactcaattctgtaaacattctgatagcctactttgggtaggggatttactgatgcatatacgttcattcaacagaaaaaaattattcaaaggacaaacacagccccgactgctctcaagaagttcagtctaggctgggcgtggtggctcatgcctgtaatcccagcactttgggaggctgaggtgggtggatcacctgaggtcgggagttcgagaccagcctgacaaacatggagaaatcccatctctactaaaaatacaaaattagtcaggtgtggtggcgcatgcctgtaatcccagctactcgggaggctgaggcaggagaattgcttgaacccaggaggcagaggttgtggtgagccaagatcgtgccactgcactccagcctgggcaacgagagtgaaactccatctcaaaaaaaaaaagttcagtctaggccgggcatggtgactcacgcttgtaatcccagcactttgggaggccgaggtaggtggatcacctaaggtcaggggtttgagaccagcctggccaacatggtaaaaccccatctctgctattaaaaaaaaaaaaaaaaattagctacttgggaggctgaggcaggagaatctcttgaactgcggaggcagaggttgcagtgagctgagatcacaccattgtattctagcctgggcaacaagagtgaaactccatctccaaaaaataaaaagtgcagtctagttcctagactctagtagagtttgttgttgaaaaatgtcaaaaatcatttaaatgactaaagactattatttttataattacgtaaatataattcttatttaatgattataaaattgacagagttttctatacctacacagaaccaaaacactttaagattaaaatataaggggagtcactaattaatgaacaaaactaatgctttaaaagagagttgtttatttagtagaaatacaaggtacatttcttgtagaaatactttttataaacaaacttgtagattataaagttcaactaaagccacttaaactcccttgaagcacaacttttagcatttcaactacaatgcttttcatggggaaagttccacatcaccctctggttacatttttctcacttcaataatggaaacaactttagtaaaagaatcccttttaccttaggcttaacgcctttatatttgtgttaaaaagtgaaacaaatatctgataaaagaaagacttatttcaacaaataacaaatacagtagcctaaatgacttaatactggtacaaaaccaaagggattactcaaaagtctagaaagagacttatgtactaatatagaattttagtatttgataaaatattgcattatacatcagtggggaaaattagtctattcaaagtcagatccctactttacaggtaaaatcagaataaattccaaacaaattataaattacaaatatatatatatattaaataaaaagatggatcaatgaatgtttttataatctgaaggagagaaaaaactttctagataaacttaactatgtggaaaacataaaactttagatcagcagaaaagtccaaaccaaacttaagggaagagaaaaataaaacacaaaaattccgataaataagcataacataaacattaccacaataggtcaaagacccaacaggaaatacagtcgtgtgtcccttaatgacagagatacgttctgagaaatgtattgttaggtgactgcatcgttgtacaagcatcctaacagtgtacttacccaagcctagatggtatagcctactagacacctaggctatatggcatagcctattgctcctaggctatgaacctatgagcatgtgatagtgtagacaactgtaacacaatgcgaagtatttgtgtatctaaacatatctaaacacaggaaaggtacagtaaaaatatggttttataatctaataggaccactgtcacatatgtggtctatcattgaattaaaggttgttatgtggcacatgactgtacataaaccaggaaatttcaaaggtcaataaaaatatgaaatgacaagcatcaccactatcagaattatgcaaattaagtaaccagaattatgcaaattaaagaacaaaattattcaaattaaactaagagctgaaagtttttctattatatgggcaaacataaaaataataattgtttttgaggttgtgaagaaaaaggtattatcaaatatttttacaaattaaacctttagggtagtttttaaatgttaaagatggtgccttttaacccagaattctacccacagaaatttatcccaggaaatatctggatgatcatcaaagtatctcttcttaattataaaaaattagaaacaaaagcccataattggtgattaataaatagcaccttataaaacaagaaccataaaaatgatgatgcagatcaaaatcttattacaaaataggtaaaataattttattgttgtaaaaaatcacatttatctctatcaataatatactgatataaagatcagtatatcattgaataaagataagaaaccaaatgctaattgagataatcactgttatagtggtgggaatacagtgaacattgtattctttttaatgtttctgtattttatgagagcttttttttttggcaaaagcttgtattacctttataatcagggaaaaaataaagttaaaacagatcttctgaaacggctgaatatgttaatatttacctttttttaaagcttccagaagaaatgaaaggttttcagcaaagcttccctgaacaacaaaatgagataaaatgattaaaagtttagtgaaataaagaacaaaagatggctgtctgattctcaaattttatataaacactgtatatcttctagttattagagtcattgcccagactctgctgagtgtctctatacttcctatctaaaacttaaatacttaagcaaagatggcacatcactgaaaatggcaattacaatgtcatctttgaaattttatattttagaacttgaggataaaacggtcaaagaagaaaaagaaaagtaagaaattttatattttccggaaaaaatctgaaagaatgttaaatttatttgaaggtagttttgtagaattgccatattctaaatatagtttgagacctagaaatggattctactttgtgtcttcaaacacaatggggtcttgcaagtctctaatttgtactggtaaagaaataaccatgaatttaaatgagaaacaaaaagaaaaggcttttttgaaacattagatactataacagtgtttgtctattcaagagtatactgaagaatttatgtatatcatatcatgtttggctatgtttacttggaatatagccaaaacatttttggatactattaaatattcttgatgaaacttagtgtagtagatgcattatccaggtgctccagattgtgggtagaagccccattaaaatatttgtttcattaaaattattaacttttacttcattcagagttcataactaaaagaaacagccaactttaaatttgaggagatataaaggagaaaagaaacacacttattcactctccagttgagagatctaacataaaaatagcataaaggttttaaaactttcacatattgtgatgttgttatgctatttccaaggcaggcagaccaagaggtgttatccataatttaccgtaatataacaaatcctcaaagagacaatctgttgggaaatcagtggtcagttactcaaaggtagcttgtctttcaggctttttgcttaaaagattattacatctgatactaagtatatgcttctataaatacgtatttgtgcatgtataatatacatatatatgtctgtttatatcaaaccagaaaagctgtgggttgaattaagtgacttaggttcttataatgtccaggctctgccattttatgaccttcggcaacctaattatgctctctgagcagaagccaaatttatataatgaaggaattaaactattaatttctatagcagtatttctctattcaagagtacattgaagaatttatgtatatcgtatcatgtttggctatgcttactcggaacacagccaaaacatttttgggtacaacttaaactaataatctctatatatgataataatagcgaagattagaacagaatgataaaaaattgtcatttttattatttcacataaaaccaatatgaatatgtaacatttaaaaatgtcagaaacacctacccagatcaactgggaaccaaaagccaaactgagcatacttaacaagaactgtctttggctcagtataggccactagcttcaacatcacattctaaacaggaggtagaatattagatttatagatggggcattttgaaactgcacttcaaagacctacagactttggaagggacaaatttactcaaccttttagattagattaacattttatattaatatttttatagattaatatattatattaataatttagattataatctataattacatataataaactataattatatataatctattagataattatatagatataacctattatagaattacatagattatataattatataattatataattaataattttatagagtatataattatataattaataattttatagattgattattaaagaaagaaactcataaatgctaggagtcttacacaactatggcggtgtcattgcagcacaaagcacacagttcagaaattagagcgatgccaccgcatggtcaccagtaaccagaaaatgaagttggaatgtgtataatccactccaactgcataagcagtatgaggctaggtaatttcatcatgaaaattcaggtaggtgcaaaattaaattatcatgttttccttaggccctatatattaggtgaaaggtaaaagtttaatacaagtttcaaaacatttcaagtcagtttcttttactgatgttgttcactgccctgagactataagatgatatgataatgaagtatgaataaatttctgaaaacagaataactgacatttgtacagcacattaccatccagcaaattattttttaagttaaatgatgtgtaatgttttctttcttcttcaaaataatcctgtgaagtatggataataaaataacgcccaattaacatgtaaagaatctgaattcagagatacttgttagctcaggattatcaggcagtcaaagggttgtaaggcatgactgaaacccacctattgcagcctcaaatttagcacattttctactatacacaggctactcaagtctcaaaaaagtagaaataggctgctggagcatggtatttttaaaaatgtgttaatctatctccagagatacagaatcaaagtattcaccttacagaaaatgaaataaactcagaatatctacataaacttgggtttcttagctattttacagctactataacctactatggaaaaatccaagtattgtagacttaatgactaaatgtatcctatacattacacatttttatgaaagaatctcatatatttcaattaagaatttctgaacctctccctacccttccagaaatataaaaatatacatggtataaagacattaccttaaaagtctatttaataaaataactgaaatgatacttacaaaaactttatctccaactacattttccagatttaactgccttgtgatttcctttagggcgattttgtcattgatctgcagcagtcctaaaataaagtccatttaaaagtatttaattaaaattaaacatgtatttgatacagcaggttgttttccagttaagtaaatcttcccagtcaaagcctgtgagttcatatcactttcttcttaaaacttagcaataaagacattcggtagaatcaaaaaacaatcctccttgggattagaatgattaaaaaaaaaaaaaccaaaaaacccacaaaaaccagagtccttctgcgactccttcattattattattttaatttctaaaaatactgcatatggtgtgctaagtaaaacatggatctagttttcaaaatctaactattaaaatggatttgaaatatacaagtcatataaaaaccccacaaagtttacataatctccaatggcaaaataatggcatacttaccatttaagtgaacttgtaatacattttcactcacttcttctatttccatgagttctttcaaagcatgatttattaactaaatatgaaaagtttatgaaataataataggtaaaagataaaaataagtccatattcgtttttaaactacaagcagtaagaacagaatataaataaattgacctctttaacaagtaagttttcaaattctttacagataaaaggtttaactagaacatctcatatctgactctttttaagaaacaagagccaggactgatacaatattctctcaatcacctacccgaacttttaatacaaatttagaaacaaccaagttttaaaataaatatttctctacatgtcacattaaacatgtgacatggcccttataaacttcatgtctcagttagtacattacacatctctctgacaattactctactaaatatcattgtaatcagttaaaagcccattgaattaaaggtttctatgaagcatacttttttaaataacattgtattgctcttgtactgtgatatcatacatatctcttcatattaccaatgcattcttttttttaaagaatttgaaaatgaatgtaattaagaaaagccaaaaacctatttaaagagtaaagatggactgttccttccaatattaaaatataggtactatcataaataagtgaactgggaaaagcagttgtatacacaaaatattaatagagatggcatcaaaacttaggacaaaaagtattactcaacgaaggcactgggacaactggtaaactattttccaaaacaaaatactgtttgtatttgcaatatgctacttatttgtcattgcaacaccttatctaaaaagaaaaaagcaaatatgatcctcattttaaattacatatgtttcataacaagacaacaaaaataaaaaaaatttcctgttatacctgcatggtttttaaagcatagggaattccaggtcctctgaaaaggagacaatctcaagatatcacctgtcatactaccagtaatagcccaactgagaagtgacatttaatgagaagtgacatttaatgagaagtaacattaaaggactgcatagaggtacttcttcacctctggatcaggtcagacactataataagagtacatccctagatgatacagagttggtctctcaaaacagtgctttcagcaaaaattttttattttttattttttttgcaatccatggtattttctttcttccatctcttgatattttgcttaatatattttttcctaggttatgattttgttttaattcatacaatgttttatgttttgatgaattattcaaaaccatttcaaatcctttgctaaaaggaatggggattttaataataccttccattttatatatgcataaggagagttgtaacagatttatagctttctttccactcaacttactttaaacaccaacttatgctttgcttggatcagcccactaatattttatgggttgtgtgtatggtctgaaatgataaatatattagcaagtgagtcttcaaataatgttagttctaatctgggtattgctaaaatttattgtttatgcaatcaaccatttaagttagcttttttcttgaatatgttatcatttcaaatatttaaactacattatacactaaaaatatttagttggttattaatatcacactgaccaacataaccaaatttggtcatctcctttccacattctttgtgcctaaaatttaattttacaaacatactaagataattttcttagacctcccaacatccagtaatttttatgctcaccaacttatactattcccaaatattataataaacacaggtttcaccaatatgcaactaggagaaatatcctatttaaccatctagcaaatttgtctacagtaaattgcatgtgtaagagcattttctaagggtcggtacagtgggtcacacctgtaatctgagtgctttgagaggcagaggcaggaggactgcctgagcccaggaggttgaggctttagtgagctatgattgagccgctgggcgccagcatgggtgacagagagcctgtctcttaaaacaaaaaaaggtattttctaggggtcaatctgtcacttgaagccatatcaattttttttttaaataaaatgcttgtaatattataagccacactattgcctttttcaattaactatagagttagcatttttgtatttcagacagtttggccaagtatagtgttttaaatatactataatcttagggttaggattaggggttaaaacaaacaaacataagactacagtcttatgttttaaaatttgaatttatataattatactaatgaggctaggcacagtggctcatgcctgtaatcccagcactttggaaggccaaggtgggtggatcacttgagcacagcagttccagacaaacctggtaaacatggtgaaaccccatctctactaaacataaaaaacttagctgggtgtggtggcacatgcctgtcccagctactcgggaggcaaatgtgggaggattgcttgagcccgcgaggcagaggttgcagtgagtctagatcgtgccactgcactccagcctgggcaacagagtgagactctgtcaaagaaaaaaaaaaaaagaaaagaaaaagaaaaaaattatactatcgagagttattgtctaaaaataaattatatctgacaatttattcaatctatattttctctcaggatactcccacacatacaacaaattacaaaagtagcacaagtcaaacaatgctcatctcttcaacctgccagcatcagagtacatcaggaatatatgaaactatatcaaaatggaatgccatgcaagggactcttccagattccactatagtgaaaataaatgactgcaaggcaccacaatagggctctggtttaaaaagcaaaaagtagataaactgtcagtgtggccaagaataactgatccattttattaactgataaatactatgatttaatgcttttgcctttaaatttcagtacattgattaaacctataggggtttatgaaaaggtgctataacgtggaagggaacaacaagcagattaaaaagattaagttcagatttaaaatattaagcaagatggctgattagagactcctggtgctcgtactcccaacaagaaaggaccacagcaatgaatgaacagctaagatttgactggcgtgttgaagggagagtactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggaaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttccagtactaggggtccatcttcattccaccaagcccacataggtggctgaacacacaactctagctgcacagagactgagcctataattggttatgactctggtcctacacagcaaggaaaccaaccccttgctgccacacttccagccagagaaccaatctggcagtcccacccagggcaaactctcacttgaggtgaccaaaccagggtggggctctctcccaagaaggagaggcccccgagcatccaagcagctgatacaccccttgcactggcagagcggctatgcacccacactcagaacctgagaaacagccccacaataccgtgcacccctccctcccgcagacatacccctagcttgcccagtggtcctgtgcccacaatcagagcctgaaaaatagcccagaaggttacccctggcaggcatgcccccagcccagccgagcagccatgagccatgacctgtacctgagaaacagccctatgggccacccatggtgaatacacctcccacagggtggccaagcatccctgtgaacacatactaggcctgagaagtagcccttcaggccattcttgagcctgccaagcagtcttgtgctcacctcccaaacctgacaaacagcacagcctccctataactccatcagacatgccccaggaccagccaagcaatcatgtgcccacgtcgctaacctgagaagtacacttgccaactgcccctaacagacacattaccctagctggctgagcagcattacaccttaggcctacaaatcagccctgagggttgcctctggcagacactcttttgggccagtcgagcaaccctgctcctacttcccaggtctacaaaatggtccagtgggccatctgctgcagaaaagttcccaggccagccaagcagcagtgtcacaggcctgagaaacagcctcacaggacgcctctagtgggcatgcccataagccagctgaatagccttgtgcctgcatcctaaacctgagaaacaatcctgtggaacccctcagcagatacggccctaagccagtcgaggaactgtatccctacacctctgttgggatcaagcagccttgcacctggatcccaggcatctcctgggcctgagaaacaaaccagtgagttgttcctggcaaacattcaccaagactggctaagcaaccacatgactatgctcctggccacattaatagccccatctgccagtgtgtcagatcccaaggtgattgacccaccatatgcatgcatatgcccccaaactgagaaccagcccagcaaacccaccccttgcaaagctgtacaactgccaccacaaacaactctcagcctaggccactgagacacttgtaaatgacactagtgtggattacagctgaaaaaactacacaaagaccacactactgtatccaactagaaccaaggccaatgaaccacatcaaactgacacctcgagacacattgacacaaatcagtacttccttacgagatcaattctgtaagattggaaaagacaattttacttttctacctgaggcgtatcaatcaacatagggacacattaaacataaaaaagcaagaaaacatgacacttccaaaggaaaacaataattcctctagtaacagacaagaatcataaagaaatacagaaaatgccagaagaatttaaaataataatcttgacaacactcagtgaaattcaaaagaatacagatagaaaattgaacaaaatcagaaaaacaacttgtgattcgaataagaaattaacagagataccataaaaaaacaaacagaaatcctacagctgaagaagttaatgaatgaaatagaaaatacaactgagaccttcaataacagactacatcaagcataagcatttcttaaattgaagacaaattgtttgaaataacacaggcagacaagaaaaaaaatagaatgaagaaagtctacaggatttataagacttcaataagtgaacaaatatttgtattattgtactttcaggaggagaaaagaaggaaaaggtgagaaaaacatatttaataaaaccatagttgaaaacttcccagttcttgagagaggaatggacatccaaaggaagctcaaaactccaaacagactcaacacaaacagaaggtcttctctgaggcatattatagtcaaattgttaaaagtcacagacaaataattaaagcagcaaaagtaaagtgtcaagtcactataagggaatccctattatactaacagtagatttcttcttctttatagcagatttcttttttttaattaaaaattttaaactatcatttttttaaatgatattttaaaacatctttcatccttcttgtttacattttagctgattgtcagaatatacaacagcagatttcttaagagaaacctgacaggacagaggggaatgggatgatacaatcaaagctcagaatgaaagaactgtcagctaagaatataatacccagcagcttcagaaataaaggagaaataaaatctttcacagacaagcaaaaactaaagcaatccgtcatcactagaccagacctataagaaatgttcaagggagtctaacatccacaaatgcaaagatgatgaccaccatcatgaaaacagggaaaactataaaactcactggtactgcggatacataaaggagaaagagaaaggatcaagccttatcactacagagaggcacccaactggaaaaataaatgagaggaagtaagaaacaaaggatatatgaaacaaccagaaaacaatcactaaaatgacagggtaagtcctcacttatcaataataatcttgaatataaaccaattaagtttcccatttaaaaaatacagaacagataaaaaaaaaaactcaattatatgctgctacaagaaactcacctcacctgtatagacacacagacttaaaggtatgaaaaagatatcctatgaaaatggaaaataaaagtgataagaaagttgtaaaaacaaagaacattatataataataaaaggatcaattcaacaacagaatataacagttgtacatataaatgtacccaacactgaaacactcagatgtataaagcaagtattattagatctaaagagagataaattgcaataaaataataggaacttcaacaccctattctcagcattggacagataatttagacagaaaatcaacaaagagacattgaatttgaacttcaccatagaccaaatggacctaaaatacatctatagaacatttcacccaacaactgcagaatgtacattcttctcatcagcacacagaagattctccaagactgacctcatgttaggacacaacagaagtcttaaaacatttttttaaaaaaagcaaaatcctatcaagtatctgatctggccacaatggaataaaactagatatcgataataaaaacaactggctaggtgtggtagctcacacctgtaaccccaacactttgagacgccaaggtgggaggatcccttgagcccaggagtttgagaccagcctgggcaaaatagggagacctggtctatattttttttaaaaagtaataataatgacaggaacattaaaaactatacaaaaatatggaaattagacaacatgcccatgaacaatgggcaaaagaaattaagaatattacagattcctagaaacaaaagaaaatagaaacacaacttactaaaacttaaggaacacacagcaaaagcagaattaagaggcaagtttatatcaatatatgcctacatcaaaaaactagaaaaatttcaaataaagaatctaacaatgcaatccaaaaaattagaaaaattttaaattaaaaaatctaacaatgtattccaaagagctagaaaagaacaaaccaaaccccaaattagtcaaaggaaataaatatcagagaaggaataaacaaaattgagactaaaacaatactacaaaaaatcactgaaacaaaagttgcttagctagactaagaaagaccaaaataaataaatgagaaaagaaaaaggagacatcaaactgaatatcacagaaataaaaaggatcattagggactactatgaagaactatacatcaataaattacaaaacctaaaggaaatggttaagttcctggacacatacaacctttcaatattgaagcaagaagacacagaaaacctggagagaccaataacaaataatgaggtagaatcaggaataaaaagtcttccaacaaaggaaaatccagtactggatggctttgctgctgaattctactaaacccttaaggaattaatgccaattcttctaaaactattccaaaaaattcaagcagagaaaattcttcctaattcgttctatgaggccagcataaccctgacatcaaaactagacaaggacaaaacagcaacaaaaactacaggtcaacatctctgatgaatatagatgcaaaagtcttcaataaagtattagtaagctgaatgcaaaaagatcattcaccatgatcaagtgggatttatcccagggatgcaaggatggtttaatatacgcaaatcaataaacatcatacaccacatcaatagaatggaggccagaaactatatcatctcaatggatgcagaaaaaaacacgtgataaaattcaacatcccttcatgatagaaactgtcaaaaaggtatagaaaaaaaacaccacaacacagtaaaggccatatatgacaaacccaaaaccaacatcacaccaaatggggaaaaactaaaagtttctcctgtaagaactggaacaatacaaggatgttcactctccccattcttattcaatatagtactagatgttcaagccaaagcaatgggaaaggaagaagtcaattcattcctttttgcagatgacataatcttatatatagaaaaacctagagactctaccaaaaaactcttagaatttcagtaaagttgaaggctacaaaatcaatatacaataaccagtactgtttgtatatactaacaacaaactacccgaaaaaaaaaaatcaagaaggcaatcccatttataagagctaccaaaaaaacgtaattactgaggaataaattcaattaaggaggtgaaaggtacagttttgtacaaggaaaactacaaagcactgaagaaagaaattgaggaggatacacacaaatgaaaagacacccatactcacatgatagaaagaatgaatattgttaaaattactatattaccagaagcaatctacagtttcaatgatattcctatcataacactaatgatattcttcacagagatagaaaaaaaatcctaaaattcatatgaaacaacaaaagatgccaaatcgctaaagcaatcttgagcacaaggaataaggctggagtcaacatactgccttacttcaaatatactacaaagctgtagtaaccaaaacagcatggtactggcataaaaacagacatgtagaccaatagaacagaatagagaacccagaaattaatctgcttatcaacagccaactgatttttacaaaggccaagaacactcactcatcagggaaagggcaatttcttcaataaatggtgctgagaaaactggatatgcagaagaattaaactagattcccatctctcatcctgtacaaaaatcatttcataatagatcaaagacctcaatgttaagacctgaaactataaaactactagaagaaaacataggggtaatacttcaggacactagtctaggaaaatatcttatgaataaaaactgcaaatcacagacaacataaaaaaatagacaaatctgctaacatcaaactcaaaagcttctgcatagcaagggaaacaatcaacagcatgaaaagacaatctacagaataaatgaaaatatctgcaaagtattcatctcatagggattcatatccagattacacaaggaactccagtatctcaaaagcaaaaaaccaatttgcttaaaaaacaggcaaattatctgaacagacatttctgaaaggacatacatatagccaacgaatacatgaagaaatgcttaacatcatcaatcatcagggaaatgcaaatagaaaccacagtgaggtatcatctcactccagttaggatgtctattttcagaaaaacaaaaaataataaatgctggtgaagatgcaaaaaaaaggaacttttatacaccattggtgggaatgtaaactagccaatattgaaaacagtacaaaggttccccaaaaaccactacaaatagaactaccatatggtccagcaatcacactactgagaatttatataaaggaacggaaatcattacatcagagagacatctgcagcccgtatttattgttgtactattcacaatagccatgatatggatcaacctagttgtccaacaacagatgaatggataaagaatatgtgtatatacacacaatggaatactgttcagccattaaaaaaagaaatgaaattctgtcattcacagcaacatagatggaactggaagaagttatattaaatgaaataagccaggaaaagaaagttaaacaccatgcgttttcactcatctatggaagccaagaaaagtaggtcttacagaagtcaaaagtagaagagaggatagggtaggaagggtaggaggaaaggagggatagtgagagattcaataatgaacacaaaattacagcaagataggaggagtaagtaacagtgttgtactatcatttttctgtaactataggatgactataattaacaataatattttccaatagctagaagaaggatactggatgttccccacataaataaatgataaatgtttgagatgattgatatgctaattattctgatttgatcactatacactatatgcatcaaaacatcactatatatcccatgaaagtgtataattattatgagtcaatttaaaaataaagtataaaaaggttaattactacctaaaatgactattttatgaaataaatgttttgagctatttaagccagacttagacaagaagaaaagattcttagaaaactgaaatgcaatatcagattagaagaagcaaatgacagcactggcagtaaagaaaatcacattggccatatgacagaatgctgagagagggggaaaaaacatgaaaaagatggtagacatggaaaaatgaaaacaaagatttaagaactgaatattctaatattggatattcattttttctaatcataagaaaaaatgaaagaatattcaaaaataaaagaatattattctttagtgaacaataccctctaaatttatactaaatcagtatgcagagtattagtgaattttatgattaactgttagacatagtctatgaataactaatgcaataaaagaagaaaaggaatagaagtatggagatagggaaggaataattaaaactgtctttgttgacagataacataactgtctaagtaaaaaaatctcaaagaactgacaaaaaaactaatggaattgagaagcaattatagcaaggttgcagaatacaagcaaatatagaaaagccaagtgtttagctatctactagcaatgaagacttagaaaaggaaataaaaaacacagtactattcgcactagaaccaaaaaaatgaaaaattaggtataaatctaacgaaacatgtgtaagatctttattaagaaaactacaaaaactgacaaaagtcttaaataaatagatactccaagaacgggaagactaaatatagttaagatgtccattcttcctattgtgatgtataaatttaactcaaaatctagcaattcacaaagattcccagaattttctggatatgtacaaagtgattctaaagttaatatgaaaaggcaaagtatgcagacagccaacacaatactgcagaagaacgaggtcagaagactgacagtacttaccttaaagactcactaaaaatctacagtaatcaaaacaatgtgatattggcaaaagacagacaaagcaagggaatagaaagagaacctaaaaacagaaccacataaacatagtcaactgatctttgacaaagaagcaaaggcaattcaatggataaaagatagtctttctccaattgggcattcatttgcaaaaaaaaaaaagaaaaaaaaacgaatctaaacacagaccttacatctttcacaaaaattaactcaaaatgaatcacagacctatatataaaatgcaaaactataaagcttgtagaagatacataggaaaaaatctacatgactttcggtttggtgatgaagcttcagatacaataccaaaatcataatacatgatagaaaaaactgacaaattagattattaagatcaaagacttcagttgggcacagtggctcatgtctgtaatcccagcactttggaaagctaaggcaggattgcttgagctcagggttcaggaccagcctgggaaacatggggagacctcgtctctacacaaaattaaaaaaaaaaaattagccaggtgtgatggtgcatgcttgcagtcccatgtactcaggaggctgaggtgggaggactgcttgagcacaagaggccaaggctacagtgagctgtgatcatgccactgcactccggcctgggtgaaagagcaagaccctattcttgtaagtaagtaagtaaaataaataaataaaaactactctaccaaagatacagttaatagtatgaaaagacatagcaacatcccatctcaaaaataaataaataaataaatgaaatcttctgctctgccaaagacaatgttattattaatagtatgaaaagaataatattcttttaatattatgaaataatattaatagtatgaaaagaaaagccacagactgtaagaaaatacttgcaaaacaaaactgaaaatcagaaatataaaggactcctaaaacctatcaataagaaaacaaataacccaaattaaaaatgggcataagacacctcaccaaacatatatagatgaaaaagaagtgtatgaaaagatgctcaacagcatatgtcattagagaattacaagtacaaacaatgagacaccaatatatacctattagaatggttaaaataaaaagtttcttaaatttaaaaatttaaaaatttgaaatttaaaaacatttcacatagccctcttgtgaaaactacccaaaataacagtgaattcaaatgcaaagaaaaaccataataaaaaactcaagaatgaagaaatagtgattatagaagctgagtatgaggactaaaacaaattaaacatagatttgaaactaaaaaattactgcaaatatgattatatataaatgtgacaatttgtgaaatattgaaagaaattacctagatctaaattctcaatttatattaaacaatacttcagatgtgataacagtaaaatcctaacgtactcatcttaataatgtaatttcaatatacattgcttaaatgttaaaaaaaattttgcttctcatccatttttttaaagtacattggtcaaaaattgaaatttattgtatataatacatgagaacagattttacacagactacttagcattgaaattaattgctttcaaaagttaacacccataatttgtctcctatattgcataaaggatatcaaagaaaagagtaaagggaaataagtaagaatatctttttgaggtaactaagcaaatatgataaagagcaaaaggagacaagaatgatataagatgtgagcatgcactgaaaaactgtgtaagttagggttaaacaaatagtaatgatgtaggaaaaataaaaagaatgcatgatatgatagttccctaacctataacaaagggaaaaaccctaccgtgcagtgttgatgtaaagaataaatgagagaacacaataaaaagacacatagtacatgctcaatacatgctattttctttttccactggaaatctctacttctttaaggacaaaagaccatgttggaacaaacatcaattgacaatttttcactaggaggacaaataagggggaaaaaggtctgctacactcaaatataccaccctaagtttataaagttttacatgtcttctgtgattaaaaaagaaaaaaacaaaaaagtaaaacattacaaaataatgaaaagtattttcagtattacataaaataagatttatatatgaatttatttattcttatataaaataagaatcatcacatgccaacaaacaccagaaatcaacagcttttaccatagtttttcctgatcctcggggtccgataataaggacagagttactctctccatggagagcagttcttttcagcagctcacttaagtgtctaaaatgatataaataggacaaaattttaaaaatgaagctggaatactttgttatgttgtagtttttaaaaggcatatttgaatatgcacagaaatttcctctcttctctccctctgggtacttggcctagcttctgaatggtcctaaatagaaaaatacaaaagaaatagtagggcagtattgattctctgaaatcttcaggtgaaaacgtagtcagattggaatatattgatttatacgatagtaggggacaagggacaatagtggcaactctcgggacccttggattcaaatctcttttcctactaatactctggacttttactccatagctggctgctgggtattaagggcaagatggctagaattctctccacagtatcagataacagaaacaaaacaaaattgaaagttaaagtgctattgcattatggaaatatttgtatctgctcctgcttcatgctatgtggtgtttctattcacaaagcaaaattttttatttctataaaagtgtttgttagctttatttaatatcaaatttgtacaataatttttgcaaaacctggaaggcatctgtaagtaggtccataacagtcaagaggacagctagacttacttgtattgtacttgcactccaaataggttactatgtggactctgacgacaaaatctttcacgtaaaattctttgtacctgatgaaaataaagtgaataaatataaataaaaatattacacatgatataaaaaataaataagaaagcacatttacaatagtcagaattaggtattaatgaatcaattcaaccctccctaaattcttatcctctagagttctggcaccattttcatatgttaaaaaattaatggatttcttacctatctcaagtcccataggaagaatgagaatttagttgtgaaggtttcaacaagagggagaatcactgactttagctatattagcaacttaagggccattgtaatgcatgtgaacgagttaagaaaagaattcttgtaagcagctatattttgaggtcatcttagaactaaggccttagacttagtcatgaaaaattatgtcagataatctaccatactctttaaaaagatggaccattaaagtcgttccttttttggatctgcagctaatacagaggtctttcaaggacaacaacctgagggtgctatctcagatttggccccatgaactggaataaaaaggctccaagaatatttgcttctcctagactgacagcatggaactaatccttcatgtaccaaagaagtaaatctgagttcttgttccatgtacagaggcaaagcaaagaaaatgattcattagggacaaaacaatacatacttgttcattatcgaggaagttaaagagtaaggacattggctccagaagagtctattatatgaattttaaaaggttaagtctgttctaaattttaatttctgtatctataaaatagggacaataacatcttatggcaggcctgtttgaaagattaaaaaagggggctggccgctgtggctcacgtctgtaatcccaacactttgggaggtcgagatgggcagatcgcttgaggttaggagttcaagaccagcctggccaacatggttgaaatcccttctctaataaaaattcaaaaattagccagacgtggtggtggatgcctgtaataccagctacttgggaggctgaggcaggagaattgcttgaacccaggaggcagaggttgcagtgagccaagactgcaccactgcactccagctggggcaacagagcaagacttggtctcaaaaaaaaaaaaaggtttaaaaaaggcaattatttgtaacacaaataggctttgtacaggtaatagctaatatctgtaaaaatacataaaagaacatatatatgcctcaactaatcataatgtgtattcctctacctagatgagatcaaaagaaaaaactcaatcttttccttaaaaaaaaaaaaaaaaaaacccagaaaacctcattaaaatatcttagaggcagtaacggggtataaaatataagctagataaagctacagtgactagtcagaaggttcacaaatctcaaagtgatctggcatagaagttaaataggtatacacatgtattgatattaagtcagctgtacatggaggattcgtgcactttacatacaaaggtatgtaaagcatatttcagttaaaaatttttttagaaagagagttaaactacttccttcaaaaagaaagccaagtcgtataaaagaataccagtaacacttaatttttatttaaaaactacatggagttcaggtcaagctagataaatacaaatgccagggtagaaataccatgctcatttccctactaatctataagcttcttaaggaagagacatacagatagatgctcagcacttggaatacaatatacacttcttataacattcattataaaaacactcaacagatgaggaaacgtaacggaacttcctcaacttaataaagggcatctacaaaaaaatcctacagttaacatcatatataacagtgacagactgaatgctgctgtttctctaagatgaaaacatagacaagaatgtccattcttcccaatcctattcaacattttaaagaaagttcaagccagggcaattaggcaagaaaagggaaaaaaaaaaaaaggcatctagattggaaagaaaaaagtaaaagctagaattctgactacccagacttaataaggataaaattaaattacagtataaaacactaatattaaaaaaaatatatgaactgacaaaaagggcagagaacaatcataacaacaaaatctgttggtccacatttaattttgacagagtttggaaaattttgcttccagatgattgttcttacgaccttgtgctggcatctcgttaaggtctcgtactgatatctccctaaggttagaaagagtgattcttcctaaatgctaaagggaaaattcaggttaagaagataactatttctctgaacagctttacagggtaaaatatcttgagattaatgaaaatacatactaacctgtgaaaggcactctgtgtgaattaagctgttactctttgatttacgactgctcatttcaacaaattcaaatcctttaaaaaaattggcataaatattataaacgtagtgacttaaagagattacttaagaatttactgttctagaattaaaataaatacaagtttttaaaagtaaaaaatgctcaaaccctaagaccttcaaaatcttcgatggcttcattttgtctaagtacaggctgattcaacactctcataccacactttaggcacactttgttttactgtgctttgcagatggtgcattttttttttaaagtaaactgaaggtttgtagcaactctgtgtccaacaagtcgataggcaccatttttcaaacaccatgtccccattttgtgtctgtcagcattttttagcaataaggtattttcaaattaaggtatgtacattttttagacatgctactactgcacacttagtagactagtatactgtaaatataaattttatatgcactgagaaaagttttgggtgattcactttattgtgatatttgcttcactgcaatggtctggaactgaacctacaatacctccaggcctgtatgtggttcttacagctactcctccctttcgattaaatcttctattcaccttccctttcttcctttttctttttttaacttacatgcttcctttatgattctcccacccatccatcccacaggatcatcccttatagaaaaccttccctttcttgctccactcaccaacaatacacaaataatcattacagactaggttaaatgcctcttccttaaacactcataagtgcctgtattttgctttattattgaattattttaaacaaaattgtctgtttaattgctactgtttccaaattgagattttttatattctaagcattgtagcataatgcccaaaacaaagttggcaatgaataactggaatgaaaaaaaaattaatgaaaaaattatattttttgtaaaattctcctcaagtgtaccatactcatagacaaatgactaaaagacctttgactaaaagacctaattttcttagcactgatttcctataggaataaattttaacagatagacagtaacagcttaagcagtgtttaggtatcaggaattgttacaaatgctttgcatttatcaactcatttaatcctcaaaactatcatgtggaataactactattataatcctcttttaaggttagaagacacagataggctaggtatgttgaccaaaatcaaacagtatataaatggaagagccaggatttggatccaaccaagttaaccacttttttaaaaaagtgtattctggtctcatctaatctccagaaggaacacagctttgctaacaccctgaatttagctcagtgaaagacattttggaacttttttactgccagaactcataaaactcaaaaaaagctgacttatcatcaaatcaccaatgattaacattataataatgcgagaatgacagcagcaagatgaaataggaggcccttcagcttgtgtccccaaatagcaacaataatttcacagccacccacggacaaaatggtctttgtgttagcgttgagattcaggcaggcgtctgtgaaaccccagtggggcccaagacctggaaaagtcaattggagggcagatcttcattcacgtgacagattccccaactgtggtccaggcttcagacttggaaagggccctgtcctcccgataggaccttgttaccaggggctgtagcaggatatgaaccctatctggtcccttggcggactggactttttctaggacctcggtctgtacagtggatgaagatatgcagagaaaagacctgttaccaggtgtgtggatggtttggctttctctgggaacctgggagggctcctactggatcactgagtagattccttaacaggcagtactgccctagtccacagctgagtggggctggaactaagctacagggttgcttcagggcctacagtcaagacttaggtcttcaggcctaaggtgtcacaaacctgcatgtctcccttcaggtccttaagttagcgggcctgctgtattgagaggggctggagccacttttcaggggtgtttcagggactgatgagggacctaggtcaggtggcctgtttgcagggctatggacagccccatctccctccaggatgctgggtaggcagaactgctctctgaccacagctgagaggggcttatgccaagattcagggttgtttcaggacctgctgtgggactgaaatctgcctgcctgtcctgaggacacagaaggatgtatctcctgactacaggaggatttctgtgcaggatttctgtaagactgtggctgagtggagctgaatccccgattcagagctttttcagcatatgctatgggacagagattggcaagtctgtactgatggcacagacaggtgagtctcctagcagttccttgtgcaggcagggttgctctcaggctgcaaccaacagtggcaggagctgagcttcagggctgtttcagtatttaatgcaggaccaagttcagaaagcttgacccagggattcagacagttttgtcttcttgtgggtccttgaactgatctcagaccatagccaagttaaagtgtcttatcagggtccgcagttgggactgaggacagtggacttattttctgaggtaccagtgtgcatgaattttcccaggcctcttggtgaacagtttcggtagcaggccaatatccttgatgaatataggtgcaaaaatcctcaacaaatactggcaaatctaattcaacagtacattagatcaattaccatgatcaagtgggatttatctttggaatgcaaagacggttcaacatatgtaaatctataaatgtgatataatgcattaacagaatgaaggacaaaaatcacatgactgactcaacagatacagaaaaagcttctaacagaattcaatattccttcaggtttaaaaactgtcaatatattaggtataaaaggaatatacttcaacacaataaaggccatatataacaaactcacagctaacatcacaccccaaaggtaaaaagttggaagctttccctctaagatcaagaacatgacaagaatgcccactttggccatttatattcaatatagtactgcaagtcctagccagaggaattaggtaagaaaaaataaataaaaggcatccaaatcaaaaaagagaaagttaaatggtctgtttgcagataacataattttatatagagaaaatccttaagactctaccaaaaaactgttagtactaatacatacagtaaagtggcaggatacaaaatcaacataaaaaaatcaataagatttctccacactaataactatttgataaaattaaaaaccagtcctaattacaatagcatcaaaaacaaattagaaagaaatgtaacaaaagaggtgaaaggtctgtcactgaaaactatacaatattgatgaaagaaagtgaagacacaaataaatggaaatatactccatgttcatggactgaaagaatcaatgttattaaaatgtccctactactggaagtgaaggttcaaagtaatccatatcaaaattctaatgacatttttcatagaaatagaaaaaaatcctaaaattcatatggacccacagagacatttaatagctaagacaatcatgagctaaagaacaatgctggaggtatcagactacctgatttcaatacctagtgcaaaactaagataattcaaaacaacatggttctggcataaaaacaaacatacagaccccagaatacagagtcgagaaataaatccatacttttacagttgacttatgttcaacaaaagtgccaagaacacacaacggagtaaggacagtctcttcaagaaatggtgttaggaaaactggatatccacaggcagaagaatgaaattgaacccttattgcacaccatatacaaagatcaactaaaaatggattaaagacaaacataagacctgaaacataggggaagaaaacacagggggaaagctttttgacactggactcggcaaagatttttttgggatatgactccaaaagcagaagcaagaataatgaaaacagacataaaactaaaaagcttcaatcaacagagtgaagagacaaccttcagaataagtgaaactatttgcaaatcttacatctgctaacaggttaaaatccaaaatatgtagtcgctcctcatcagcagattcaaccaacttaagagagagaaaatttagaggggaaaaaaaatgcaacaataaaaattaatataaattttaaaaacaatacattataatagctatttacaaagcacttacattgtattagaaattataagtaatctagtgatgatttaaagaatatgggatatgtgtaggttatacgctaataccatgccaatttatagaaaggacttgagcatctacagattttggtatctcaggggagtcctggaaccagtttcccgtggatacagagggatgactgtataaggaactaaaaaaaacaaaaacaaaaacaacaacaaaaaaaacttaatagcaaggaaacaacccaatttaaaaaatggtcaaaaagatttctcacaggacataaaaatgtcaaataggtatttgagaaaattctcagtgttactaattgtcagggattttcagggaagtacaaacaaaaccacaatgagataacatttcacacctgctaggaaggctattgtcaaaaaaaggcaaaagatgatgagtgttgttgaggattatgaagaaaggaaactcttgtacactgttggtaaaaatgtaaattagtataatcattatggaaaacagtatggaggttcttgaaaaaattagaagtcaaattacatgaccggtaatcccactcctgaatatccatcaatatatacaaaggaaatgaaatcaatatgtcaaagatatatcctcactcccatatacactccagcattattcacagccaaaatacggaatcaacctaagtgtccatcaatggatgaaaagataaagaagatgtggtatatatacacaatagaacactaactcagccttaaacaaaaaagaaatcctgtcatttgcagcaacatagatgcatttgggagatattctgttagctgaaataagccaggcacagaaagacaaacaccacataatctaatttatacagtagtctctccttatccatgggagatgaattccaaggcgcccctcgcatgtctgaaatcatggatagtacccaactctctctatatactatgttcttttaatctgataacctagatggctactgagtgattatgggacacatgcaatacacagcatggatacgctggacgaagaaattatgtatgtcccaggcaagacagagcaggacactgcaagatttcatcacattactcagagtggcatgcaatttaaaactcatgaattatttatttctggagttttccatttaatattttggaacttcagctgaccaaaagtaactgaaacaatggaaagtgaaactgaggataagggagggactacaataggtggaacctctaacaggggaactcatagaatgaaagcagattttaaattttcttactacaaaaaaatggtatgtgaggtaacagatatattaataggcttaattttgtcattccacaatgtatacctatattaaaacattatgctgtataccataaatggataagatttttattcatcaattagaaaaaaaacatataaaatatacatcaaaaagcaagtaagtgcagagccaggatttgaatgatttgaacccaaataagttgtactcttatgaaattgttacgtatttagcaaacttttttgaaaaaagaagtacaaacacatttcaataacctgaaggaagatcagccaatatattttacattcacatttattaatttcatatagtgacaattagaaagcaaaccatggtaatgctgttttcttctctagaaatgttaacaggtccttagctgagccaggccttgacagacagacagcaagcaaatctgtgtcctccttaatgtgtaagccaggtagctaaggcctcagccaccaaaagtcctctggctccaggcttcctaattgaaaattaaataacagagtactcaattattgtcttgacccttaagcatcttctttcttagaagaaaagtggtcttctcagctgtcttaggataccttctagcagtcttttatatctaaagttttatcttattctattttttatttttcctaatcagtgttatgagagggaaaaacctttttagctaataaaatatcctcaactctggtttatgatgctcttgactatcagccaaaatctaaaatcacaaagaactatgtaataattgtctcctagattataagactaattaaaatgtaaaaaggagaaagggcttttgcagtatgttttattttgtagaactacattagctatcttacagtattgttagaattaaaagatattttttacccacttcatgaattaagaaagaattactcaaaaaagctaaataaatgtccacagttccaaggcaggtatctaatctgcccctttgcatcatatataaatcaggtaagctattaagataattcattttttcttcatgtggggccagcattcataaaagaaacaacaaacatgccactatggtatctaccttataacctacataaattttgactgtaaataaagttttagtccaaaggttattttgacatcttcccccttcatgtaatggtcaaatatctactatataataaagaatatttcaaagacaattctaatagtacagatgagacaagcttcagactgggagaaaatacctgcaaaccacatatctgacaaaagatctgtatctaaagaaccctcaacactcaataataaaaaaggaatcccattagaaaataggcaaaatacataagtagacatttcaccaaagatatgcaggtggcaaataagcatatgcaaagatgtttaatatcattatccgctaggaaaatgcaaagtaaaaccatagtaagataccaccacacactgattaaggcagctaaaataacacaaagatggtgaggatgtaaagaaaatgaatctttcatttaaccactggtgggaatgtataatggcatggctactctgaaaagtttcttgacagcagtttcttagaaaactacaaatactcttaccaagccacatagcaattgcactcttgggtacttacctgacagaaaaacttatgttcacacaaaaacctgtaacacgtatgttcatgataaatttattcgtaatagtcaaaacactggaaccgattcactcaatgagccaatggggttaatgaattagttccactgatgctttgtcactgaagtcaggaagtacccagacagtaagggactgccttttgaagttcttctgatattggacaatgcccctggctacccagaatcccatgagttcaacaccgaaggcttttgtccaagtggtccactggtccccaaacacaaactctctaattcagcctgtagatcagggggtcatagggacctttaaggttcattacacacagaactctatggaaacgaatgtcaacactatggaaaaacctccacagacagaacatgatgaaagtctgggaggattatcccattgaagatgccctgttgtcatagaaaaagccatgaaagccaacaagactgaaacaaatttctgctgaagaaatctatgtccagatgttgtgcatgacttcacaggatttactacaaagccaatcaagaaaatcatgaaagagattgtagacacggcaaaaagggtggggagtgatgtgtttcaacatatgggtcttagagaaattcaagagctaacagataccacaccagaggaattaacagaagacaaggtggagatagatgcttctgaaccactgccagacagtgagaaagatgcagaacagtgccagaaaacaaactgacattagacaatctggcagaacggttctgaatatacaagactactcttgacttcttttacgacatggacccttctatgatacaggtactggaatcaaagcaaatggttgaggaagggttgatactgtatagaaacattttaaaagaaattagaaaccaaaagagatagacagaaattacctgtttagttacacccagtgtgcctaacctgtcttgtctccccttctacctcctccacctcttctacccctaggcaacaagatcaacccctcctcttcctcctcagcctactcaacaggaagacaagtaggatgcagacctttacaatgagccacttcaacttaatgaatagtaaatatattttctatatatagtagatatattttctaaatatcttttctttaccttactttattataataatacaatatataatacatacataaaatatatattaattgactatgttaccagcaaggcttccagtcaagtaggctattaacagttaagtttttggggaggcaaaagttatatgcagattttcaactgcttttggtagggagggggtgtttcgacccctaacccttacattgttcaagagtcaactgcgtatggaggaaattctcattactgcagttccagagcactactatacatcagagagctactgaccattttaaatttacttctgtattgacaaaggacaaaaattataggaattgtaaaaatgtgtcatctaaagctgtctgctctctaaattgcctatgtgcatttccccatgacagtaagtcccctacaatctatacctttacaaaggaagggatgaattctgaaatatattcactgaccactacttactgtatctgtatttgaaattttatagttacatgctaactaaagcaggatgactaaataatctcaagactcaatcacatgtatattcatactcccatttttcaactgaggtggcttatttattgtaattctccattcctatgctttccaagggttgcttgttgataaattctaaaaattatgaagtacatcctttactgctcttgaggtttcatgagtacttataactcttctttctcatgatgccttcctcagatccaaaccctcactcagagcctctttgtctaccacactgattctgcataatgtattttagactaactctgtttggccaacaataatgataactattcagtaaactctctgttttttttgtttttttgtttttttgagacagagtctcgctctgttgcccaggctggagtgcagtggcgctatctcggctcactgcaagctccacctcccgggttcacaccattctcctccctcagcctcctgagtagctgggactacaggcgcctgccaccatgcccggctaattttttgtatttttagtagagacggggtttcaccatgttagccaggatagtctcgatttcctgacctcgtgatccgcctgcctcggcctcccaaggtgctgggattacaggcgtgagccaccgtgcccagccttagtaaactctcttaacatctaaagacagaattagaaaatagctgacactaacaacttattcctacatatagctcaatagccattcagatgtcaaatgttttcctaccttagaaatagaacataaaagccctccatttagtttgcacaactaacttaagctcctcatcttaggttagttctaatcactgttttttagactaacataatcctaaactttgtgggagaagcaacctggatgaactcctggtgacagtccttcatgtcaaatttgaagtttggtcaatttaccaaatacctctctgcttgctgactagcaatggtatacaatgacctgcccaagatgacatagcttacttaacagcagcagtagctgttaggtctattgactcccaatcagaggttggttagtctcaactggcatgaaaaaaaaccctgcaaacatcagaaagttcatcaaaatcatcactgggcttttctttaggagacaaaacatagcagaggaatacattctgaaagaacacggttattataacagatgttcaataccaacaattcacttctctttgaatgtctatgtgtacaatttgtatttttttctgtacacatctttatttttaagatcataaactttcttcccatcgctaaaaaggaatacatgtttcgtacagaaactctggaattttaattaggaattgtgcagataaaatggtaaaaaatggaatcagagaatctttctcctctaataaaacaaaacaaaaaactgttaaacagaaatactttagcagtaactaaacaaagagacaagttaataataaacaagcctagaaaattctacaggagttctccatagttcctaactttaacctcactcttaaaagctatacttgcatcaataaaatctcctaaactctcatcaatgtatcaaatatgaaaagaagaaaactgataaaaactgtaattcaattattaaatttcaagcctaaaaaaaagaattcactgggactcagcctgaaaaacacctacaagggagaaaaaaatgctaaaatatggtgtcataatatctacaaagttctgagagagagaccaagactcatacctagcaaagatgtcactcacatataaaggtaacaggtatagccttatcaaataagaatgaacttatttagtacacagagccaataaagccttgtgtggagtgtgtgtgttgcaggaggatatggggaactcaatgacaaaatccagccaactaaagcataattaaaaacacaattttatacagacacacacacacatacacacacacacacacacacacactagtgacctttgaatccactaaaataaaaaactaaaaccaaaaaaaggtaaataattatagtagcaggtggaaacataagtcgttacacagtgaaaataatcattcaacaaaaaaatgaaaaaaaagtggcatgaatgcatacggttgctaatttcattcttcagagtagaaagaaaatgtctaaacttaaaacatgaagtgtaaaaaaggaacttaaaactattttttttttagacccagggtctcactgtattgcacaagctggatttgaattcctgggctcaagagatccttccgtctcagcctcctaagtagctgggtcaacaccttgagcagcttgaaactttttttaacctaagattgagatctttaaaaaaaaaaaaatctcttgggtttaataaatatctaaagtccagcaattcctataatttttattaggttaaaaatgtggcctgcctacacacacacatactttttcaaccaaaatgggctctatttcataatatttgtcatttaaaagaacaagaactttccatatatagatatatatatgtgtgtgtgtgtgtgtatatatatacacacacacacacacacacaaaaagtaacatattttaaattattttttctacagctaccataaggtaaaaaacaaaaataagaattagtggatcaaattgtttaagaaaaagaaccatgtacctcagctggataatcaaaagtactctagtattatgagcatcttactagtaattacgacgccaggagctgtaacactgtgtacccaaaaaaaagcatttaaggagaaaacaggtgtgaacatgtccgatttatttagtttcaaagttgtccaagcacaggtcaaagaggtaacaacaaacaatttttcctatctttcatataaatggtcagtaaggtggctggtgcaaaataaccctctggaataagaaagtattgtaggctgggcacagtggctcccacctgtaatcccagcactttgggaggccgaggcgggcagatcatgaggtgaggagatcgagaccatcctggctaacatgatgaaaccccatctctactaaaaatacaaaaaattagccaggtgtggtggccggcgcctatagtcccagctacttgggaggcttaggcaggagaatggtgtgaacccgggaggcggagcttgcagtgagccaagatagagccactgcactccagcctgggcaacagagcgagactctgtctcaaaaaaaaaaaaaaaagaaagtattgtaatatgtttacctataaatatctatccaaaaaataagagctaaattaaacttaactaatatttaatatatacattgacaaattttacttggtctctgtatcagcaggtcaagtcatgttactcaacccagacgccctaaggaaagggaagagttcaagatcaataacaagaaggggttccgagtggcaccatcacatattcatttactgtcagctcattaatacacaatgtaggtatatgaatccagtttggagacattactgaatccagctgacttactgaatttttttttttttttgagacagaatctcgctctgtcgccctggtgggagtgcaaggttgcaatcttggctcactgcaacctccgcctcctgggttcaagctattctcctgcctcaggagataggagctgggattacaggcatgtgccaccatgcctggctaatttttgcatttttagtagagatgggggtttcaccatgttggccaggctggtctcgaactcctgacctcaagtgatccacccaccttggcctcagttgggattacaggcctgaatcaccacgcccagcctcacttgctgaatttaaagatgttattatttttaaaatgtaagtgaaataatctcagctgttccaactgcagctttttcctggaatgaaaaatggctgcctgtcaacagcatgctgcttagtaaataaaaaacaaaaagcaaaaaaaaaaaaaagatttacttcatctggaattttaaaataaaagtaggaaagaaactgctttttagaagaaatttgtgttatagggcattttgaaaatgtttccaacactgattttatagccaaaaattaggtgttacctataaaaattctcatatctatacacttaaaacatttataaacataactttttattctattcacaaatatttctgtaaataatgtaagttttatatgtgttgacctaaaaggaaagaagttgaggcaaaattaataacatacatagagagttcatttgagccaagcttgagggttgcaaccaaggagcataaattcaagttgccctgaatatgctcattagcagcagtaacaagtagatttttaaagagaaaaagaaaaataaaaaggcacgctctgagttgttcaccaagaatctacattaaaataacaaactatccattggctacagagtggcagggggtagggagttggggtggagtatgggggcataactgaagtcccatactactcacatctctctgggcctgcatacctcagagctcagactgttctgagcattttttgttttctcatacccatttgttaaaaatataaaaacataccacttttcggctgggcgcagtggctcacacctgttataccagcactttgggagactgaggtgggcagatcacttgaggtcaggagtttgagacgagcctggccaacatggtgaaactccatctctactaaaaatacaaaaattagccaggtgtggtggcacgtgcctgtaatcccagctactcaggagacttgaggcaggagaactgcttgaacccaggaggcggaggttgcagtgagccaagatcgccaacactgcactcccaccagggcaatagggcgagactcatctcaaaaacaacaacaataggaacaacaacaacaagaaacaaaaaccatgcaccactttccaagaacactaatttatatcaagtttttcttagtttggaataagaactaacacatcaagagaagatgaaattggctaacaactcctacaaaaaccttggtaaaattagtggatgagactagaaaatataattcaaaaatacacaaatgatcatgtattattttctctaatacccttactttgaggcaaaaccttacagctccagcagatgggggcattactttgtgaaaagaactcttagtaaattaaaaagatgtttaatactgctttctttccagatggtggcagaagaaaacaccgaaaacaataccactaccccactccctttattagaaaaaagttaaaatacaaattctattactgtttacctaggacctaacttcacacggctgacatttctcaaagataggtaagtatggacaaaatttcagaactttgcctctcttcagttcgataaaatgttcttgatttgctagctaaacagtcaaataacgtaaaatgaaaggtattttaggagaaatttgaaggtggtttccatgttttgttactgtcctttgagatgaaactgaggcaagaaaaatacatttaagctgtttttcagtccatcagaattagttttcattcttttttctcccccagttggattgtttgtacagaggtaaagattaaaatagagttaaaagaatggttgagtgtggggagaaataagggccaatactgatatatattccaagttagaaaataagtaaactctgttagttcttcctaaagagatcagctcaaaaatgctatctatatcaagttggggcacagcctctggtgagatgtttccttgagttctccagagctgaagaataattccacacaaatcaacttttggaccacaggtgaataaaccatggtaattactgacagttttgtaaaatctttttttcctcctcatttgttgccagtgaatattaaaaggacacaatttacttaaggacacattcagattaaatgattccaaggtttgataacctttagttaagtaatatgatgccatgatattttctcattgatattaaaatgaagaaaaatattttataatgtcttggtacttaaactgattaaataattgaaaaggcttgcaattctccagaaaagccatgttctctctaacctctgaatttcagtaatcttcactagtacatggcagtatgtctggaatcatatatacacagacacacacaaccacacatacatatatatacacacatatgaatataaacgtatatacatatatatcttttttttttttttttgagctggactttcactctgtcgcctggctggagtgcagtggcaccatctcagctcactgcaacctccacctccagggttcaagcgattctcctgcctcagcctcctgagtagctgggattacaggcatgcgccaccacgctcggctaatttttgtatttttagtagagatggggtttcaccatattggccaggctggtctcgaactcctgacctggtgatccgcccacctcagcctcccaaagtgctgctgggattacaggcgtgagccactgcaccccatacatatatatcttttaataagtgtacttactttataaagtacctattagagccttgatattcatgaataagccaataaagttgttttcaagaacatgggaggtaaatagttatgaaataaacaacccccagaaggataatcagagagttaatactatgatatgttcagtaaagaaagacatttagaaattactacagttggccgggcatggtggctcacacctgtaatcccagcactttgggaggctgaggcgggtggatcacctgagttcaggagtttgagaccagactagacaacatggtgaaaccccgtctctactaaaaatacaaaattagccaggtgtcgtggtgcgtacctgtaatcccagatactcgggaagctgagacaggagaatcgcttgaaccggggaggcggaggctgcagtaagcggagattgcaccactgcactccaaccagggcaagacagagcaagactccgtctcacaaaatgaaaaaaagacattactacagttgttttgattattaaccatggaatacaccttgtaaatgatacaaagtatcaattctgcagtagtgttgatgaatgaataaaaaagaaatactagttggaggacttctttaaagtatacgtcttaaaatgcatttacttctgaattatataggctaacaaaagaactaacacaaatttgcaacgtatttagaaatcctttagaagctttggaaatgcattatatgatcttactggcactgacataactacatcttaaatattatagtgatcaacagtagtctatgttctctgagcacatggaagtaggctaccttcaggatttaagcttgtgaatccaagctaatgtgtttaattggatggataaatagtataagggcgacagacacttgaatcaacgaaaacttttttttgtttttggtttaagagatggggcttccctctgtcaactagggcagtggcacgataatagctcactgaagtcatgaactcctggcctcaagcaatcctcctgactcagcctcctaaatagctgggattacaagtgtgaggtactgcccctgacaaaaatatcatttttgtgaaggatggttgcattatatgggacacaagatttaagactagggcactaaaattggtgggtgagaaggcacatgtagacaaattttccttgaaaagccccaaactacacataaattacagaactgtactttcttgcaatatcaattacttcagggtatatgttcatttgagaagaataatgaatagaatactgtccactattcaaataaatttttcctttgccacgtttacagacttgagtttacttaaatgtaagtatgatactgctagggctaaggaaatgatactccaaaataaagtcctccaaagcagctctctctgaccatctcctaacttcctgtctctggcctctcattctcctgaggctagccactgaaactaccatccctcgtccccaaggtagtccacagaaaccagaactccctttccccaaagccagccacagaacctaaatatattactctaatgttccctgccctcatctttctgtgtaaaaactaactataaagacatatctgacctattctgtttgattgtaggtcataggatccccattccagaaagggtgctgttccatacccggaaggaaagaatgctgcacagagaggccaagaagaatctatacagacaggcaggccttgctgggtttccccactcagtatatggctgtccagactttgctgaacctaagcataccaatgggcagttttctcctatatctttaggtctttattctgaaggctcccatgtcacgtaacaccaagatcaaataaaatcatatgccctttctcctattaatctgccttttttcagctgattttcaaagaaccttcagaggctgaaagggaagttttttcttggcccctacaatatgctacaactccagtaagttaattagtaaatattaaactatttttggaaggaaaaaaaactgaaaataacattgctttagagataaattatttaagaattgctagaaattaccctagaaattatcctagaaaaatcttaaaattttccctaaaaacttttaggaataatacattgtttctaatgagacccttcagcttatgcaaaaagcacaggagactaaattctagagtcaacgaaacgatattctccaattctgttttgctaatgaatatgttgtccatccccccatcagcatgcttaggtaatcttgcaaggataaatggaaatgtcagttgacatttacaatgaaataggatttttagacagttgtgctttttgggtgggaaaaggagagctaaaaattagggggttgggggcttaaaaaagacagcattatatggcttagaactttggtaccctaccttcatccttttctgcaatcccttttactccccaaagttaaaaggctatcaatgggacaataattgatgatcaactatgaagaaataggctcaaatacactgttttattatatttttatcattctttatataccttttctcatcattctttgtcccaatagtatgctatgattatgcacgtagaaaatcccaaaataacaacaaaatcactggaactaataaactactgtagaaaggttgcaggatacaaggttaatatacaaattgtcaacttccttcctatgtatcagtaatgaacaactgaaattagaaattaaaataataccatatacattagcaacaacaacaaaaaacattcaccaaaaatgtagatataaatctaacaaaatatgtacaagatctctatgaggatcactataaaactctgattcaagaaatcaaagaaagtctaaataaatgagatcattcaagagtagaaaaaaattcgtattgttaaatgtcagttcttccaaccttgatctataaattcaatgcaatcccaatcaaaattctggatagttattttgtggatatgacaaactgattttaaagtatacacagaaagacccaggagaaccaacacgataccgaaggagaacaaagttggaggacaaaacctacccaacttcaagacattataaaactatactaatcaatacagtgtgataatggtgaaagaacagacaaatcaagggaacaaaacagagcccagaaataggcccacataaacatagtcagctggtcttttacgaataagcaaaggcaattcaatggagaaaagaacaatctttgcaacaaatggtaatggaaaaactagacatacacatgccaaaacatgaattgacacagaccttacaagtttcacacacaaaaaatctaaaaatggatcacagacctaaatataaaatgcaaaactataaaactccaaaaatggccgagcacagtggctcacgcctctaatcccagcactctgggacaccaaggcaggtggatcacctgaggtcaggagttcgaaaccagcccgaccaacatggtgaaaccctgtctctactaaaaatacaaaaattagctgggcattgtggcaggctcctgtaatcccagctacttggtgacaggtgaagccagctggacttcctgggtcgagtggggacttggacaacttttctgtctagctagaggactgtaaatgcaccaatcagcactcaataaaaaaacgcaccactcagcgctctgtggattaaaggattgtaaatgcaccaatcagcactctataaaaacgcaccaatcagcgctctgtgtctaaaggactgtaaatgcaccaatcagcactctgtaaaaatgcaccactcagcattctgtgtctagctaaaggattgtaaatgcaccaatcagcactctataaaaacgcaccaatcagcactctgtgtctaaagtattgtaaatgcaccaatcagcactctggtctagctaaaggattgtaaatgcaccaatcagcactgtgtaaaaacgcaccactcagcgctctgtaaaatggaccaatcagcaggatgtgtgtggggccaaataagggaataaaagttggcatggaccaatcagcaggatgtgcgtggggccaaataagggaataaaagctggccacccgagtcagcagtggcaacctgctggggtccccttccacgctgtggaagctttgttctttcgctcttcacaatagatcttgctgctgctcactctttgggtccgcactgcctttatgagctgtaacactcaccaggagggtctgcggcttcattcctcaagtgagcaagacacaaacccactgggaggaacaaacaactccagacgcgccacctttaagagctgtaacactcactgcgaaggtccgctgcttcactcccgaagttagcgagaccacgaacccaatggaaggaagaaactccggacacatctgaacatctgaacaaacaaactccagacacaccatctttaagagctttaacattcactgcgagggtctgcggcttcattcttgaagtcagcgagacgaagaacccaatggaaggaataaattccagacacatcgggaagctgaagcaggagaatcgcttgaacccaggaggcagaggttgcagtgagccgagatcacgccattgcactccagcctgggcgacagagcaagactccatctcaaaaaaaaaaaaaacaaaaaacaggccaggtgcggtggcttacgcctgtaatcccagtgctttgggaggcagaggctggtggaccatgaggtcaagagatccgagaccatcctggccaatgtggtgaaaccccgtctctactaaaaattcaaaaattagctgggcatggtggtgtgtgcctgtagttccagctacttgggaggctgaggcaggagaaccacttgaacccgggaggtggaagttgtagtgagccaagattgtgccactgcactcaagcctggtgacagagtgagactccatctcaaaaaacaaacaaacaaacaaacaaaattccaaaaatgtaacacaaaagaaaatctaggtgaccttggttatggccatgtgtttttagatacaacaccgaaagtacaatccatgaaagaaaataaaaaattgatttagacttcattaaaattaaaaacttctgctctaccaaatggcactactaagaaaattaaaacacaaaatacacatggggataaaatatgtgaaaaacacttattttgttacacaaaatatacaaagaactcaacaaggaaataacccagtttaaaattggcatccaaataaacatctcaccaaataagatacagaggtggcaaataagcatatgaaaagatgctcaacatcatatgtcaatagggaattacataatcaaacaatgagataccattgcacacctattacaatggctaaatccaaaacaatgacaataccaaatactagtgagaaggtagagcaatgggaactctcattcatggctcatggaaaagcaaaatggcacagacactttggaaaacagtttggcagcttcttataaaactaaacatatttgttttacataatctagcaatcatgtaccctggttacacccaaatgagttgaagacaggtccacacaaagacctgtaccttcctgtttacagcagttttatttataattgccaaaacttggaagtaagcaagagtgtccttcaatatgtgaatggataaaccaactgtggtacatccatacaatggaatcttactcagcatgtaaaagaaataaagccatgaaaagacatgaaggaaacttagatgtatactgctaagtgaaagaagccaatctgaagagactacctactgtatgtttccaactatatgatattctggaataggcaaaactacagaaatagatgttttagtgatcttttcactaaaagatcagtggttgtcaagaaaagagaagtatggaacatgagatttttagggcaattaaattattctgaatgatactgtaataatggatcattatatatttatcaaaatccatagaatgtacaaaacaaagaatgaatttattcatatgtttgtcgtttttaaagaaataagacatttcaagaacatttatataccaaagtaagaaaattttttatatcttatctttctttgtcaacaccaatcatcacactattcaagagcataattcctaatggttgagaagagactcttgcaatataaagcaaacaaacatattgttattttgtaagtatttaatataatgaaaacatgttatctatgattatttcttctcaaagtacatgacaaagctctatgatctcatgctgccattaaatgtataaaaacatagcttaaaaagactaatattacacatattagcatcttggaattatttctgggtgcaaaggttataggtaattttcattttttaatcacttttatactgaatgtatattatgtttgtaactttaaaaattttcttgcacatttaaatcaaatcttgtactttacaatttgaatatataaatttctaagtgtaaattatgatgctaaaattctattttaacttttaaacatgttacaaacataaaatgtgttttaacataaaattttaaaaacatgatgctcaccagatattgcagcagtgttggtataacatgctggacataattaaaaaaacaccaaagtctaatggatattagctgaaacccagctttttagggaaaatagttttggtatttactcattataaagtaagttgactgagacataaacaaaccatacaagtggtcatattaagagtgcatttaagactgacatgtctgggttatctgtattagatatttttgtaaacaatacaaaaaagaaacaaaggagaaagtgaaaatgtgcaagtgaaaagccaacagatcagaacttaattcttgaaaaagtctgacctcactttggtcatgctataatttggatttggtttctttatcaccaccaaagctaatgtggaaatttgaaccccagcgtggcaatattgaaaggtgaggcctagagggaggtgtctgggttctacgggtagatgcctcataaatggctcagtgctattctggagttagtgtgttctggctctcatgagactggattagttctctggcgaatggcttagttccttcccacaagagtgggttgttataaggccactatgcactcctcagattttcctctctttgaatgtttctttttctcctttgaccttgtccaccgtgttgtgaagtatgaaagatcttgccagaagccaggtctatgctcttgaacttctcagtctgcagaactgtgagctataaaacctcatatctttataaattacccagtcttaggtattcttttatagcaatacaaaacagactaaggcaggtcaaaatttcacactattctcaattcccctattaatcaaaaaagtagtataggactaagaatttgttatgttttattggaggtgaggagagatatgggagaatataagataaaggttaaaaagagattaggaaaaggtagcaaccccaaagcatgtttaagatcagtgctttgagcaagatcaggaatgaaaagagagaataaaacagaaatgaaaggatgggaacagctgtcaattccaggtttcatctaccttttggtttataatcttcaactcatgtcttatttttctacttatgcatttagtaaaatatacaaagccatccagtctcgtcagctaatactctaaataatataaacatacaacaagttcactaaataactggtcttttaatttgggctagaattcaatgagaaaaccatttctaaaagacttgcagtgctaacatggctcaaattaaacagaagcctctaacccacttcatcagaggccatgaggcttattttctacacagggtaagacagaagaaatctaccctgaggacacaagacacagcagaaggtgagggtatcagacaaaaaggttttgagggggaggagaggattaagagagtgtttatatattgaacgttgaggccccctagctctcttctttcacatagttctcatactactggcaatcagacttataccctaaagcagggtttctcaggataacattttaaacttgattgttcttcgttgttggagctgtcctatgcactgtaggatgtaacaagacccccagattctatgcatcagttttcaggagcaacctatctgtggcaatcaaataagtctctagacactgctaaatttctcttagggggccaaattgtcccacttgagaatcactgacctaaaggcagaagcttggagaactcttcttattagactcttattaaccctagaaaaaaggtttccaaacttaaagataatgacaccaggggtttccacccacaaaatgcccagccatattcacagagctctaaaatagctttctaatgaatctaacataaatttgaacatgcaatcaatgattgctacatagctgaggaaagcctcgattaaaaagatgaaaacatattaacagaaagaataatttggaaaaagtagagaaagcaggaagcaataaatttcaaaaccaaacaataattttaattcataaaaagaaaacataacaggatataataagaaaattatacagagatcaaaaaaggccttggaaattaaaagtatgatagcagaaatcaaagtctcaaaagtttgaaaaaggtaaattttccagaaagtatgaagaaaaaaaaaacataaaaaatgacagaaaaaaaataggtccaggaggtagaatgtttaattagagttccagaaccaaaaacaaaggcaagaaaattaaagaaaaaacatgaggaattttcccagagttgatggacacaaattgtcagactgaaaggacccataaaatgcatggcaaaatgaaagactatagactcataataagtaacatggctgtgacatttcagaactctagatacaacaaagagaaacatttgataagtttcaaaatgagatcgtataatcttccacagaggagacaaaagtgatctgaagagtgatggaagtaagaagggcttctaattttacaacagatgctatgaattccttcaaagctcttaagaacaatttcacctttataatttgaaagccagctaaactaatagttggggtaaaataaagacacttatataaatataataccacagaacacttgcctttcagaaagctactagaaaatggaataaaccaagagaatacacaagccaaaggattacataggatataggaaacagaggaactagcataggatagagactgcaccagcagcaactatatcaagcaatgggctaaaactgcagcacataagaatgctctgggagaaatttcttgatgatggataaactgataaaaatacttgatacctctgaatatatggaaaggctgttttgacaaccagcagatagtttgggtctaaatgactaataaatatttagaactatacaaatgctcaatggtcgtatatgaaaaattaaactatcaatgggaagatggggggaatggatgggatgtttgtggaaaaaggctaaatctacatcacctatagtaagtcaagagataatgcctaaaactgaaaaaacaggaggtagcaatataaaatgttatttagagatacagaagtatataccaaaagaataagccaaaaaaagttttagaagtatttccctctatttggggaaaactggggtagtgacagctaccttgtccaacatcacagccttcctgggattaagcaaataaggcgataaaggcccaatcatttcgttgcaccatggtatcaatctgaaggaaaatattctggagaacctaacctgtgacaaagaagtaagaactgtttttaatcataagctatggagaagcagttaaaaacttaagcatgtgttcttttacctttgcaacagttaaaagaaaaagagaaagagaagaaacaggctgcttaaatatattttctaatttcattaacttggcttcttatactgcagagccgaatgttattttagaaatttaaagcccatcagactaacaacggatctctctgcaggagccctataagccagaagagagtaggggccaatagtcaacattcttaaagaaaagaattttcaacacagaatttcatatccagccaaactaagcttcataagtgaaggataaataaaatcctttatagacaagcaaatgctgacagattttgtcaccaccaggcctgccttacaagagctcctgaaggaagcactaaatatgtaaaggaaaaactggtaacagccactggaaaaacataccaaattgtaaagaccattgacactatgaagaaactacatcaactaacgggcaaaataaccagctagcatcataatgatagtaccaaattcacacataacaatattaaccttaaatgtaaatgggctaactggcccaattaaaagacacagactggcaaattggataaagagtcaagacccatcggtgtgctatattcaagagacccacctcacttgcaaagacacacaaaggttcaaaataaagggatggaggaatatttaccaagcaaatggaaagcaaaaaagagcaggggttgcaatcctagtctctgataaaacagactttaaaccaacaaagataaaaaaagacaaagaaggacattacataatgacaaagttatcaatgcaaaaagaagtgctaactatcctaaatatatatgcacccaataagggagcacccagattcataaagcaagttcttagagacctacaaagagacttagacccccccacaacaatagcagtgggagactttaacaccccactgtcaatattagacagatcaacaagacagaaaattaacaaggacactcaggacttgaactcagctatggaccaagtggacctaatagacatctacagaactctccaccccaaatcaacagaatatacattcttctcagcaccacatcgcacttattctaaaattgaccacataattggaagtaaaacactcctcaacaaaggcaaaagaatgaagtcataacaaacagtctcccagaccatagtgcaatcaaattagaactcaggattaagaaactcactcaaaactgcacaactatgtggaaactgaacaacctgctcctgaatgaatactgggtaaataacaaaattaaggcagaaataaatacattctttaaaaccaatgagaacaaagacacaatgtaccagaatctctgagacacagctaaagcagtgtgtagagggaaatttatagcactaaatgcccacagaagaaagcagaaaagatctaaaaccaacacccttacatcacaattaaaaaaactagagaagcaagagcaaacaaattcaaaagccagcagaagacaagaaataactaagaccagagcagaactgaaggagatagagacacaaaaaccccctcaaaaaaataaatgaatccaggagctgcttttttgaaaactttaacaaaataggtagaccgctagccagactaataaagaaaagagagaagaatcaaatagacacaataaaaaatgataaaggggatatcaccactgatcccacagaaatacaaactaccatcagagaatactataaacacttctacacaaataaactagaaaatctagaagaaatggatgaattcctggacacagacaccatcccaagactaaaccaggaagaagtcgaatccctaaatagaccaatagcaagttctgaaattgaggcagtaattaatagcctaccaaccaaaaaaaagcccaggaccagatggattcacagacaaattctaccagaggtacaaagcggagctggtaccattccttctgaaactattccaaataaaagaaaaagagggactcctctctaactcattttatgagtccagcatcatcctgataccaaaatctggcagagacacaacaaaaaaagaaaattccaggccaatatccctgatgaacatcaatgcaaaaatcctcaataaaatgctggcaaactgaatccagcagcacatcaaaaagtttatccaccatgatcaagttggcttcatccctgggatgcaaggctggttcaacatatgcaaatcaataaatgtaatccatcacataaacagaaccaatgagaaaaaccacgattatctcaatagatgtagaaaacgccttcgacaaaattcaacaccccttcatgctaaaaactctcaataaactaagaatcgatagaacgtatctcaaaataataagagctatttatgacaaacccacggccaatatcacactgaatgggcaaaaacaggaagcattccctttgaaaaccggcacaagaaaaggatgccctctctcaccactcctattcaacatagtattggaagttctggccagggcaatcaggcaagagaaagaaataaaaggtatttgaataggaagagaggaagtcaaattgtctgtttgcagatgacatgattgtatatttagaaaaccctgttgtctcagcccaaaatctccttgagctgataagcaatttcagcaaagtgtcaggatacaaaatcaatgtgcaaaaataacaagcattcctatataccaataatagacaaacagagagccaagtcatgagtgaactcccattcgcaattcctacaaagagaataaaatacataggaatacaacttataagggatgtgaaggaccgcttcaaggagaactacaaaccactgctcaaggaaataagagaggacacaaacaaatggaaaaacattccatgcgcatggataggaaggatcaatatcatgaaaatggccacaccgcccaaagtaatttatagattcaatgctaaacccatcaagctaccactgactttcttcacagaattagaaaaaaaactactttaaatttcatatggaaccaaaaaagagcccgcataagccaagacaatgctaagcaaagagaacaaagctggaggcatcacgctacctgacttcaaactatactataaggctacagtaaccaaagcagcatagtactggtaccaaaacagatatacagaccaatggaacagaacagagtcctcagaaataacaccatacatcaacaacaaccatctgatctttgaaaaacctgatgacaacaagcaattgggaaaggattccctccctatttaataaatggtgttgggaaaactggctagccatatggagaaaactgaaactggcccccccttccttacaccttatacaaaaatggattaaagactaaaacataagacctaaaaccataaaaactctataagaaaacctaggcaatatcattcaggacataggcatgggcaaaaatttcatgactaaaacaccaaaagcaatggcaacaaaaggatacgaacagacacttctcaagagaagacatttatgtggccaacaaacatgtgaaaaaaagcttatcattactggtcatgacagaaaaggaaatcaaaaccacaatgagataccatctcatgccagctggaatggtgatcattaaaaagtcaggaaacaacagatactggagaggatgtggaaaaacaggaacgcttttacactgttggtgggaacataaattagttaaaccattgtggaagacaatgtggcgattcctcaaggatctagaaccagaaataccatttgacccagcaatcccattactgggtatatacccaaaggattataaatcattctactataaagacacatgcatacgtatgtttattgcagcactgttcacaatagcaaagacttggaaccaatccaaatgtccttcaatgatagaccagataaagaaaatgtggcacatatacgccatggaatactatgaagccataaaaaaggatgagttcatgtcctttgcagggacacggatgaagctggaaaccattattctcagcaaactaatacaggaacagaaaaccaaacaacgcatgttcccataagtgggagctgaacaatgagaacacatggacacagggagggcaacatcacacactggggcctgctgggggatgggggggctaagggagggatagcattaggaaaaatacctaatgtagatgacaggttaatgacacgtgtatacctatgtaacaaacctacatgttctgcacatgtatcccagaacttaaattataataaaaaagaaaaatttaaaatagacattgtttttccttgcagaggaggcagaacaagattgctgaagagaatcccccaggaatcatcccgtagcaggaacaccaaactgaacaactatccatgcaaaaaaaaaaaaaaaaaaaaaaaacaaccttcataagaatcagctggcacagtggtacatgcccataatctcagcactttggaaggtcaaggcgagtggatcatttgatctcagttcaagaccagtctgggcaacctgatgaaaccctgtctttacaaaatatgaaaaaattagctgggcatggtggcatgtgcctgtagtgccagctactcgggaggctgaggtgggaggatcacttcagcccaggaggtcaattgaggctggaatgagttgagatcacgccatgcactccagcctgggtgacagagtgagaccctgcctcaaaacaaacaaataaacacactaacaaacaaacaaaaaatccaaaatcaggtgagtaatcacggcacctggttttaacataatatcaaggaaagaagcatcgaagagggtaggaaagacagtcttgcgctgactacaccaaccctcctccaaccccaggcagcacagcactgagatagaatctgtgtgcttgggagagagagcgaaagtaagtatgggactttgcgctggaactcagtgctgctctgtaacagcagaacacaacacagggcattctgctggtgcccacagaaggagcatttagcttagtcctgggccagagagaaatcctccccccaaggagagtaattggttttcatcacattctgactaaagtagtctagggcccggaataaattggagtgacaggccacaaggactgcatcctttggcaagccttggtactgcactggccttggaggtaatggacttaagataaaacccagtgcaataccacccgtggcagctaagggaatccctgaggcacccctccccaactacttcagcttggggtaaggaaaaggaagagtagacagaactttgttttgcaaccggagtattggttcagtcacagtaaaataaagcaaaagacagatttctgaagcttttgatagcaagcttttgctccgggatggcatttatagattgaccctaggcaggaagggaatggctgccatgatgggatggactcagtcttggcagaattcaccacctgctaactaaagtggcctttggccttgaataaccagtggcagtcacgcaggactggccgtggaccttgggtgagccccaatactgtgctggtctgcaatgcttcagaggcaactcagcatagttccaactgtggtggctacaggaatgcctgtatcaccccccaccaacactgggcaggccagtacagagaaagactcctgattgaaggaaagggaaggtagagagcaagagactctgcctggtaacccagggaattctcccaattatcttcccaagtccatcaggactgtgtatgtaggagtctgcaagactcacagcgttcctgtgctttggatgctccttaatgccaaaatggctgcagtgactacaggcttaggtcacaacactcaatctgctttgatttcctggaaagccccctggagagtgacaggaatgaacaaacccaaactgtgaagactagctcttcgatgcctagacatcaatgaatatccacaattatcaagaacatctaggaaaacaggacctcaccaaacagactaatcctggagcaataaagatacgtgaccttttagatgggaaattcaaaatagcggtcttgagaaagctcaatttaattcaagataaaagagataaaaaattcagaattatatcagagaaacttaacaaagagactaaaatgatgaacaagcagaaattctgaagctcgaaaattcaacaagctgaaaatgcatcagtctcaacagcagaagaataaattagtgagcttgaagacaggtttatgaaaatacagtcagaagagaaaaaataataaaacaataatgaagtatgcctacaaaatctggaaaatagcccccaaaagtcataatctaagagttactggccttaaagagggcttacagaaagagattgaggtagaaagtgttttcaaagaaataatagcagagtacttttcaaactgagagaaagatatgaatatacaggtacaagaaggtcaaagaacaccaaatagattcaacccaaataagattaccttaaggcatataataattaaagtctcaaaagtaaaggacaaagaaaggatcctaaaagcggcaaaagaaaagaagtaacttcatatgaaggagttatactacatctggcagcaaacttcagcagaaacgctacaggccagaagagagtaggatgacaaactttagcagaaaccctggcaggccagaagagagtagaatagtattaggttggtgcacaagtaaccacggtttttgtaattacttttaatggcaaaaaccacgttaacttttgcaccaatctaatacatccaccgaaattatccttgaaacagggagacatgaagactctcctagactaataaaagctgagggatttcatcaacaccagactcatctttcagaaaatgctaaagggaagttcttcaatctgaaagaaaaggacattaacaagcaacaagaaatcatctgaaggtataaaactcactggtgaaagtaagtgcacagataaatacagaatactctaaccgctcatatctttagcaggaagattaaaagacaaacctatattgttagaagagttctaaactctaccttatctagagaaccttcttcttttagaaaatcaagcaaaacaactaagccaagacatgttaagaaaagtttgaaaagaaagctgtaaggaaatacaaggggagggattgttagatatgagttctaaatttcttttcaaagaattagtgtgtcagtatgttcaattctttgccttctagttttaaacttaacttcctcgtaaagcaacctttttcgattacctactccaccctgactcattctgatcatctgctccacccaacattccaatcacctgctccaccctaactcattccaattacctgctacctgctctgccctgactcccgccaaagcattcaccctgtcattctctttaaattagccaattggaattagtttagcccgtgcggtctaaccccagccaataggggaacgacagagcagcaggggccacatacgtcagggattagaaccccttcccatcccttgtccaaatgtgcgctcaccattgttccatctgtaagggtgcacccttctatatagaagtagcttgccttgctgaatattaaaaagaaaattttgtattcgagtgctatttcttttgcagcatcgaaactttctatataacactatcaaaaaaaaactactccaaaacttaaaatataaaaatatatagagacaaaaagtcaaaaagtgaagggatggagtagaagtgtacaggtttttagttttttctgtgcgtgtattttttcttttctttgcaatcagagttgtcatcagttgcaaataattggctataaattgttatttgctaacctcatagtaaccacaaaacaaaaacctctaataggtgcacaaaaaaataaaaagcaagaaattaaaacatactaccaaaaaataattatcacaaaggaaaacaaggaaaaaaatgggggaaaagccctagaaaataaccagaacaacaataaaaaggcagtagtaagtccttacctatcaataataatactgaatgtgaatggactaaattcttcactataaaaacatagactaacaacaaaaagacggaaaaagatactgcaccaaacagaaacccaaaaagagcccaagtagctttgtatctatttttagataaaatagatttcaacataaaaactatgaagaaagaaaaaaaggttatcatataatacaaaaggttttaattcagcaagaggacataaaaattataaatacatatctatccaacacagaagcatctagatatatagagtcaagtgtattagagttaaggagacagaacccaatacagtaatgacttgggacttcaacagcccactttcaccattggacagatcatctagacagaaagaaacaatgaatttaatctgcactatagattaaatggacctaatagacatttacagaagctgtcatccaacagccgcagaatacattcttctccttagcacatggaacatttctcaaggatggatcctaaattctccaatcaaaagacacagaagagctgaagggctaaacaaaacaaggccctactacctgctacatataagaaacccacttcatttataaaaacatagatagaccaaaagatggaaagagacattgcatgcaaacagaaatccaaaaagagcaccatcatgttaggccgcaaaacaagtctgataaaaagtatattttctaaccacaatggaataaaagtagaaataaataacaagtggaactttggaaactatacaaacatataagaattaaacaatacgtgcctgaacaaccaatgaagtaattaaggaaattaaaaaatgtcttgaaacaaatgaaaatggaaacacaacctactaaaacttatgagatacagttaaagctaacactaaagggaatgtttatagcaataaatgtgcaaatcaaaaagtagaaaaccaagaaataaacaacctagtaatgcatcttaaagaactagaaaagcaagagcatgccaagccccaaattaagaagagaaataataaagaaaacaagaaaataaataataaaaaacagaaataaaattgagacaaaaaaatagaaaagatcaatgaaatgaaaagggttgtttggaaagacagacaaaatcaatgaacctttacccagactaagaaaagaaaaaaaagaagatccaaataaaatcagagacaaaaaaggagacattacaattgatatcacaaaaattcaaaggatcattggagaccatttgaacaactgcatgccaataaattgtaaaacctagaagaaacgaataaattcctaggcacatacagcctaagaagaatgaaacattaagaaaaccaaaatcgaaatagacccataataagtttcaagatagaaacaataataaaaagtcccccatcacagaaaaggccaggacttcatggcttcactgagttctaccaaacatttaaagaagaactaacatcaatcctactcaaatcattctccaaaatcaaggaggatctccaaattcattttatgaggccagatttattctttttttttttttttttttttttgagacagagtctcactctgttgcccaggtgatctgcaacctccacctactgggttcaagcgattctcctgcctcagcctccagattagctgggattacaggcataagccaccatgcccagctaatttttgtattttttgtagagatggggtttcaccatgtcggccaggctggtctcaaactcctggcttcaagagatctgcctgcctcagcctcccaaagttctgggattactggcgtgagctaccatgcctggccccagatttattctgataccaaaaccagacaacgatacaacaacaacaaaaaagaaactacaggccagtatctctgatgaaaatagatataaaaatcttcaacaaaacacagcaaaccaaattcaacagcacattaaaaagatcatcataatcaagtgggattcatcccagggatgtaaggatggttcaacatatgtaaatcaatcagtgtgatacatggtatcaacagaatgaaggacacaaagtgtattgtcatttcaatagatgccaaaaaaatcttttttgataaaattcaatatcccttcataaaaactctcagcaaactggggacagaaggatcatccctcaacatgataaagccatacacaacaaacccacagttagtatcagactgaatgggggaaaaactgaaagcctttattctaggatctagaagaaggatgggcactttcaccactattactcaagttagtaacagaagtcctagccagagtaaacagacaagagaatgaaataaagggcatttaaattggaaaggagtaagtaaaattatcattgtttgcagctcatgtgatcttatactaacctaaagactccaacaaacgactattagaactaataaattcagtaacattgcagaatacaaaatcaacacacaaaaatccatagaatttctctatgccaacagtgacaacctatctgaaaaagaaatcaagaaggtgatcccatttacaatagctacaaataatattaaatatctagaaataaacttaaccaactacaatgcaaactatcaaacattgatgaaattaattgaagaggacacaaacaaatgaaaagacatcccatgctcatgggttgaaaaaaattgtattgttaaaatgacaatacttcccacagcaatctacagattcaaagccatccctatcaagagcaatgacattcttcacagaaatagaaaaaaaaaatcctaaaattgtatggaagcacaaaagaccccaaatagccaaaacaatcctgaccaaaaagaacagagctggtaactggtagacttaccacactaccaaacctcaaaatatactacaacgctatagtaaccaaaatagcacgatagtggcataaaaacagacatgtagaacaacagaacagagagtccagaaattaatctgtgtatttaaagccaattagttttttactaaggtgccaaaaacactcattgggaaaggacagtctcttcaataaatggtgttgggaaaactggatgcccacattcagaacaacaaaagtagaccccaactcttgccatatacaaaaatcaaagaaaaatgcattaaagacttacatctatgaaactaatcaaggaaaccattaggcaaaaactccaggacattggtctaggcaaagacttcttaaataagacctcaaaaacacaagcaactaaagcaagaaaataaaataaaataacaacaaatgagatctctccaagccaaaaagcttctgcacagcaatgaaaacaataaaatgaagatataacatgtagaatgggagaaaatatttcaaactaatatctgacaaaggattaataaccagaatatataagaatctcaaacgactcaataggaaaaaaaaatctgattttaaaatgggcaaaagatctgaggagacatttctcaaaaagacatacaaatggcaaacaggcatatgaaaaaaatgttccacattattaataatcagagaaatacaaatcaaaactataatgaggtatcaactcactccagttaaaatggcttttatcgaaaaggcagtcaatatcagatgctggtgagaatgtggagaaaggggaacccttgtacactgttggtggaaatgtaaactggcacagtcacaacagagaacagtatggagcttcctaaaaacacaacaaatagaactataatccagcaatcccactactgtgtatatacccaagagaaaggaaatcagtatataaaaggtatctgtactcccatgttaactgcagcactatacacaatagccaggatatggaatcaacctaactgtcaatcaatggatggataaagaaatgtggtacatatacacaatggaatgttattcagccataaaaaaaaaatgaaatcctgtcattttcaacaatatggatgtgactgacattataagggaaataagccaggcatagaaagacaagtatcacatgttctcacccatatgtggaagcttcaaaaaaattgaagtcatagagatagtgagtaaaaagatgttagcagaggctgggaagggtagtgttgagaggagaatcaagaggagatggttaatgggtagaaaaatatagttagatagaaggaataaaatatagtgttcagtagcacaatatagtaattacagctaacaataatttagtgtatgttttagaacaattaaatgagtggaaatgaaatgtccctaacacaaagaaatgacaaatacttgaggtaatggatatcccaattacctgatttgatcattacacattgtatgcttatatcaaatatcacatactccccattttatgtatccatagtaattaaaaattaaaatttttaaatatatgagttaagttaaaaaaattttggctcaaagcataaatatattaaaatcaaatctcagaagtaaaaaagaaagacaattagggttttatttatggtagtggcagacaggaccaacctttctgctgacgccaacaaaaaaactaaataatgaatgaaataaagtaatgtgaaattacttaccaaattccatgtgaaggtaaaccagaaacaaaccatacaccaagtaacttttgttctgaggacattttcctgtctagaagaaaaggctgagaaaaaaggctgagctaatggaagatgtgccggtctatggtaaaaaaatcaaagcacaaggccaggtgtggtggctcatgcctgtaatcctatcctttgacaggccaaggcaggaggatagcttgagcccaggaattcaggatgattgtgtgcaatacagcgagacctcatttaaaataaaaataaacacaaaaaatcaaaatcaaaaataaaaataaaagcacattgcctaacaaagctggggactcagataaactacccaatttatgttcagagtttaaggacaacatcattaggataagaggaaattgaaggaaaatagaattcatgatcttaaagtcttccttaatgtcatgtgtataacagaaggaatcccaactcttgaacatgaatagtgacttgggactgaaagcactcctagagacctttcctagaaaaatgtaccttcttaaaaaagatactattattctaggactcatatattcctataattttttaaatacaactggtactcaaggcacacaagaaaaaaatatcataagctagcagacacagacttagaaaatttagaaactggaattatcttcaacaaacaacaaatgaactatgaatatagtcggcccttcatagccacagattcactcaaccaaggattaaaaatacatgtatatttttaaaaacacgactataaaaaataatagaaatttttaaaaagccatgacagtataacaatatttacatagcatctacattgtattaggtaccataagcaatctagagattatttaaaatacgtgggaggatgtgtgtaggccgtatgcaaacatgatggcatgttatataaggaatttgagctgcctgtggattgtggtatctgcacggggttctgaaaccaatttccagcagatactaaggagcaactatactaggccaataaaagcaagattgtaattttcagcaggtaaccagaaacagtaagaatatcaccaatatctttaaaaagatactgatgcattgatctaataatctcgatgaatacagggcaagataaagaatgccacacgatgattgaacatttcctctacccccacaaccacacttgactaggagaaaaaaaaaaaagaagaaaagaattccacacaaaaagattagagtgaaacagcagaaaaattacaaccaaaaaaagaaacaaacaaaaaaaaattctaaaagagagatttccttcaaagcagcatgaattattaggttggtacaaaattaattgtggtttttgcattgttggaatttgccatttgatattggaatttttttttttttttttttttttttgagatggagtctctctctgttgcccaggctgggctgcagtggcgcgatctcggctcactgcaagctctgcctccagggttcacaccattctcctgcctcagccttctgagtagctgggactacaggcacccgccaccacgcctggctaattttttgtatttttagtagagacagggtctcaccatgttagccaggatggtatcgatctcctgacctcgtgatccgcccacctcagcctcccaaagtgctgggattacaggtgtgagccaccacacccggcctggaatacattcttaaataaatgtggttatgttatatgtcattttaatgggcatttcttgctttttttttttggctaatgacttattacttgctgtttatatttattttggactatggaaatgatgctagacaaaaagcaaagttgagtgattttcttatttaagttcaaagtgggtcgtaaaacagcagagacaacttgcaatatcaacaatgcatttggcccaggaactgctaatgaacgtacagtgcagtggtggttcaagaagttttgcaaaagataccagagccttgaggatgaggagtgtagtggcaggccactggaagttgacaacaaccaattgagagcaatcattgaagcagattgatcctcttacaattacatgagaagttgctgaagaactcaacgtaagaactcaacgtcaaccattccacagttgttcagtatttgaagcaaattgaaaaggtgaaaaagctcgataagtgggtgcctcaccagctgagcaaaaatttaaaaaaacaccgttttgaagtgttgtcttctcttattctccacaacaacgaaccatttctcaatcggactgtgaggtgcaacaaaaactagattttatatgacaagcaatgaccagctcagtggctggaccgcgaagaagctccaaagcacttcccaaagccaaacttgcaccaaaaaaggccatggtaactgtttgctggtctgctgccggtctgatccactacagctttctgaatcctggagaaaccattacatctgagaagtatgctcagcaaatcaatgagatgcacttaaaactgtgatgcctgcagccagcatgggtcaacagaaagggcccaattctccacagtaacacccaaccgcacactgcacaaccaacacttcaaaagttgaacgaactgggctacaaagttttgcctcatctgccatattcacctgacctctcaactgactaccactccttcaagcatctctacaacttttttcagggaaaatgcttccacaaccagcaggatgcaggaaaaagctttccaagagtttgtggaatcctgaagcatggatttttacattacaggaaaaaacaaacttatttcttgtcggcaaaaatgtgttgattgtaatgacctattttaattaataaagatatgttagagcctcgttataatgatttaaaattcgctgtcccaaaccacaatttcttttgtaccaacctaatgcattgacagctgatttctcaaaatcaataatgaaaaccaaaaacagtgaaatgttatcttcaaggtacaagtaaaacaaccacaaatctgtaatatcccccaaaacattcttcaagattgaaggcaaaacaaaaaattaagacaaagcaaaaaaattaagagaactgaccatcagaatgtctgcattatgaaacttctactgagtgtgctaaagtaaaagttaaaagattccaaaagaaaagtcagagacgcaggaagaaattaagacatggtaaacacataggaacatctagctcaaagtactgtccagcagcaatacagtaaaagtgacataagtaatttaaaattttctattgttcacactaaaagaaaacaaggtgaaatcaattataatttcaacatgtaatcataatgaaaagctgaggtattttacattgttttcatactgtctttgaaatatggtgtttatacaacattacaatgcagatgctaaattaaaactgccatataaaatacttgatctatatttttatataatttgcagctaatgccgggtgcagtggctcacgtctgtgatcccatcactttggaagcccaaggtgggtggatcacttgaggtcaggagtttgagaccagcctagccaaaatggtgaaactttgcctctactagaaataaaaacattagccaggtgtggtggcacatgcttgtaatcccagctactagggaggctgaggcaggagaatcacttgaacttgggaggcggaggttgcagtgagccaagatcatgccactggactccagcctgggcaacagagcgagactccatctccaggggggaaaaaatctccaaaaattaaaaaataataatttaataatttgcggttaagaaaggtttatgtatccgagttgttccaaacatacaggttttacagtaactgaatcaagtgtcagtttttaaacttaattgaacactaaataaaactaaaaattcagttcctcagtcatactagccacatttcaagtgctcaaaagccacacgcagctagtagctactgcaatgaatagcacaagcatagaacttgttatctggagtttaaactacgtatacaattcaaagaacaatgacagcctataagacctacatgaagataaaagttgccatcccagaagagagtaatgctccaagcacagagaagatattggccatactgctagaaatccctgagtaaaacagacaacccaattaaaacaaaaaacaaacaaacaaaaaaacctcccaaaaagatttaaaaagacaatgcacaaaagatttaagaattaaaaagacaattctagaaagaggaaattcaaatagccggtaagtttttgaaaaagtgctcaaactctttagtgtcctgggcagaataaattaaaacaacaataagataaagccacattcatcaagttgggaaaaaggaaaaataactcttggtgagacagtaaaagtaaagggatctaccatatactgctgtcggggtatacattggtgtatctactttggaaaaggcataactagtgaagttgaagataaacatacgtactctacaaaaacccatggtaatgtacattaagaatacatgtacaagaacattcataatagcattgttcataactactaaaaacggaacacaatccaaatgtttattaatattagactaaactgtggctcatttccattaagactttttatactatacttattatactatagattactacaatccaatataagaactagagctaaatgtactaatagagttatatcccagctgcatgagagaaaaagatacataatgatatgtaatatataatccacttacatacaattaagaaacaggcaaaacgaacctaaattgcttaggaatgctgacataggtggttaagaaatactaagaaagaaagcagtaaatgattgccataaaaatcagtatagtgttaaccactgaaaagaattgaggaaagggatgatcaggaatagaatggagaggggagcttctcaggtgccacagacgttctagttcttgactgtggcagcgcttacatagagttcacactttatagtttttcattatactatgtatcgatgtttgtatgcttaaatactaaatgtatggaaaaagacacaaaatatttaaaattgtagctaaggcacattaactgccttgctggtatttttttttttcattacaaagtggcagacaattggttacactataaagacagacaattggttacactacaaagaaaattttaaagcacaggagtctagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgggcgcggtggctcacgcctgtaatcccagcactttgggaggccgaggcgggaggatcatttgaggtcaagagatcgagaccagcctgaccaacatggtgaaaccccgtccctactgaaaacacaaaaaaattagccaggcgtggtggcacatgcctgtagtttcagctactcgggagggtgaggcaggagaactgcttgaacccaggagacagaggttgcagtgagccgagatcgcgccactgcactcgtctgggagacagagcgagactccgtctcaaaacaaaaaacaaacaaaaagaacccacccaacagaattaagtaccaacataataaatacgaagaattttagattcttggtttttaaaaaacatacaaagatgatattccttcaaaatatctttacaaaacatattgagactgtgatgctttatattgattgtatgaaaacaatgaaaaagaaccagcactgtttcactataaaagctttactaatgtaaatttataaatcctttcttaaatattttgagttaattctaattttatgatagaaattcattattttcagcaaaaacagctggcatttgggaaaccaaaggctcaaaaactaagaatagtaaccaaagaaacttgacaaaacagtccttttaaaactctcatctacactataaggggaaactttgatcacgtcccttctccttcatcaatcgtagaactcaacattaaggactacacaatcccacatccctctccgagaaaaagcaaaggctttgtgttgtagcaacaacgcaagacatggagggaagctccactcaagacttccctgcctgctccttccccaaagccactccagaataccagggagggttgagaggtaaggcatgaagggcgcaatatccaatatgagcaacgcgtgtgatgcatctggtcaaaatgcatacagaggacttgtctctgtccctagatagaagtcctccgtcctgcagtcatgagggtcaattgctgaggcttcacagttcccttctctcttacactcggaccgtcacgctcctcacctactaccccgatgcagaggtagactcaggatccctgcacttgtcaaggattcctcggcaagctcacggggcgggagtggccacaagacggagctcgcctggtcctggccttcccggcctatacaagcctgcccccttcccaattcccaatctccacagccttccatcctcccactttcgattcaccttgcgccaccgacgcccctggccttcgtttgcagcaagtttacccccaccattacctctcgcataaaagcctgcatttaccaggtcaaagaggggaaccaacgcctgcaggaatcgcttcaccgaatcgcctggccgcgtcctctgctagacttcacctgccgctgcggaccgtacacaaccactcccggcatgccccgcgcacgcact

SEQ ID NO: 2659 - DNA, 90341 bp, Homo sapiens
  source 1..90341: mol_type = genomic DNA
actttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatgatttgcatatgcagtttttctttagctatgtttttttttttttttatactttaagttttagggtacatgtgcacattgtgcaggttagttacataggtatacatgtgccatgctggtgcgctgcacccactaactcgtcatctagcattaggtatatctcctaatgctatccctcccccatccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtgtttccagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggataaaatactggcaaaacgaatccagcagcacatcaaaaagcttatccaccatgatcaagtgggcttcatccctgggatgcaaggctggttcaatatacgcaaatcaatgaatgtaatccagcatataaacagagccaaagacaaaaaacacatgattatctcaatagatgcagaaaaagcctttgacaaaattcaacaacccttcatgctaaaaactctcaataaattagggattgatggggtgtatttcaaaataataagagctatctatgacaaacccacagccaatatcatactgaatgggcaaaaactggaagcattccctttgaaaactggcacaagacagggatgccctctctcaccactcgtattcaacatagtgttggaagttctggccagggcaattaggcaggagaaggaaataaagggtattcaattaggaaaagaggaagtcaaattgtccgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagctactgctcaaggaaataaaagaggatacaaacaaatggaagaacattccatgctcttgggtaggaagaatcaatattgtgaaaatggccatactgcccaaggtaatttacagattcaatgccatccccatcaagctaccaatgactttcttcacagaattggaaaaaactacttaagttcatatggaaccaaaaaagagcccacatcgccaaggcaatcctaagctatgtgttcttaaagaggggagtggtagctttgtaacttacagtgaggcttacaccttgacaactgcaagaatgaggatagtggtgagtgaagggagatttgttaattatggcatttccctctattatcgtctaaacagattatattcccactaaagtatgtgtgttggtcctgccagtattagaaaccagaggcttgttggcattgtgtcacacagtacacaccaatggattctcagattttctagggtaaaggtgaaggatggggcagcacttaggttatggtggtttgaaagaaactgaattgctttctaaaccagatgaggatcagagtgcgaaccatggtgaaatatgcatggaaactacagaaagactgaagtgtttcttacggtgttttctgcaaaacgtgattcattaggacattaacaggtattacgttttcaacatatacagcattatgatacagtaagtttggaccaaacaggtattcattccccagagcctttcacatgcacgagaatcagtcattttaacaagaattccgtttctgctgggccacttggatcccttggattcagatgtaaaaacacactgaaatattcctcctttcacctgcttttcagtttgaggtaatcagattgaaaagcaggagttcatgcattttttggttctatttttcctcctctagtaaatgaagaaaataagctatatgtataagtttacattattcttgaaccgctttttaaactagggtttttcatatttgtttttattgatgacaattaaagcaatttaagagacgaagttagctcaaaactcttgcgaatagattttagcatttttgtatgagggaatatggaaaggccaacaagcagcactgttcctccccacaaaaatgccttgggaatataataggcgtacacttcatttgtgtaacttttcctaatgtatttttttttaatttgctttataacggtttcatgtttacctcaattggtacttagtcttaaaatctttctttatacttggttattgatggatcttctgcagctcttatgtagccaatgagacagatgagggctgtcagcttttaagtgacatcttaagctaataagaaattggaatcctcaagtcatttcatgaggctgttaccctttaagacaaataatactttcctcaaatagttcagaaaatttttaaaaggatcacttagagcataagtgtaaaattcttgcttctagtatataatagtgatgttaccatgtcaagtattttggtgaaatatcccctaaaaatgtgtagactacggcacagattgagtatgcaagccttagcttgaatgagactgctgagaagtaaatgacagggatctgaatacttagcaggcttaactttttgcagggaaggaaaggctatgtatgcaaaagaataggttgtaactactgaagagctactttatgctcagaaaccttttattccactttgtatccaagatttcattaaaacattgttccttagagcatactttaaaaactatttggtaaggaatccactgttgaacttcaggtcttaatagcactggctttggtgctaaactgagttgaattccaagcctgttggccattcccagcattgccactgctgtgttagttttctcatctgtaaataactgcctacatctcacagggcctctaatagttaaatagattgtaagctgcacaagcatagggacagtctgtcttttgtaaacctcccatgcacacaataggaaatcaaatattcttgaacaaatgaagtcactaagtgctcattaaatttcattttaaatatatgcctctgttaattcatggatcttggaacttacttaaaagacaatgctttgacggacatttccacattcctcatagggatttactttttaatacaaacaggttcagttaacattgccatacacatctcattacttttgggagtgcttttccagaaatctctggtagtcacgtcacttcatgatggggctacgttctgagaaatgtgtctttgggtgatttcatcactgtatgaacatcacagagtatacttacacagaccctgatgatatgtatatagcctgttacacacttaggctatacagatagcctagcctattactcttcagctatagcactgtacagaatgttactgtaatcatactgtaggcaactgtaacacaatggtaaaacatttgtatatttagacatagaaaaggtacagtaaaaatatggtataatcttatgagaccaccctttatacaatgtcattgaccaaaatgttacgtggtgccatgactatacttgttaagaaggaaaattccagtccttttgacctatggtaggctcaacaatctgtaattttagaaaatcctacaagggattctgatgtggatggtatgagtaccacattttgagatgtctagaagaaaaatcttcaaactccttggcctttttcttccatggaaccatcttctgactaagctggttagtcttctgaactagaaaacctgggtctgggatagaatccaaaatttgcatgtggacagaaaaaaacactgcagcaaacctgctgtaccaaaggttacttattatacttcagtgcttaccattgttttttttactcctttggtttaaggtttgtaaagacatctagctgttaggttgaagtgagctcttcaaatagaccattatatatataagtgttaaaaaagcacatggtctagtccctaaaacagtcatattttattcttctgaacagctacttacaaagtaatctcaatcagtgaaattataaatcatgtaactgttcatgattaaaaggcaagacacagccaagacagtagatgggcaagtctcacataaatacaagaatgtttatagaatgtttagcatatcatgttaatggacaatagttttccgttctctacagaagtatgaatgaaatgccaaagttgaagtcactggttatattcataaccagcttagtgaggatgttgcccactgcctcacatctgtaggacagttgggatatttctgcagagcattcataatttgagtattatccaaaagcagtttcatcagctggtactctctctgtgaatttcctgaagttctttccatgggctttattaattctaattgctgcaagtgttcaaaagcctgaaagatgaaagaaatagtttaggttgaataggagaggagagtgacaactctcctgttctctcccagagaacagttagcattttggtcagctgcagaacagagtactgggaagcaaaatgtaacaacaatcaataggattaaaaaaactctcacaaccccatgaaaactcatattatcaggtaaaacagtgtcagtgcacacttacttgtccatatattgttgaatgtaaacacggcaaactttaattcaatatatacaatatggttttcttcctagcctcattctctatcatagctcctcctagtactttaataaatagtttccagttctctgtaaaaacctaagaatcagataagactttctgatcaattccctaggctactcagatttgcatttatattttgtctgtctctatttttgctttgctatgtaaaaaggtaacacagctgtaacagagggaggcagaaaaagacccttgagtcaactagacatattcagctgatcctgtaagtaaaggattcagcaggctagtatggacatggaggagaagggacaggctcctgtttcctctaagaagtctgactgagactgtcacaaccttcttccatcttccccatcttaatagggctctttcttgtctacttcctcttatccttaatattcacctattatatcttttctaaccttgagtgttgtgttaggtacgttattaggttatgaaaaaaaaaaccattaaatcatgatatactaaccattaaataatgatacactgaaatagattcctgaggattctattatattcttacaactcactgtaaaaaacatcactggaacatattctctatgtatcacataaattcttctgatagagaaacagctcagataccttcatatctgaacatgagaaaatactggaggctgcaggtgttaagagctgaatagaactgtgcagatttaaaacatttctaaatagcaaaatacttcataattgaaaattcagaaatgagcagctacaaattattgagaatttaaatgcaggctgggcgcagtggctcacgcctgtaatcccagcactttgggaggccgaggtgggcggatcatgaggtcaggagtttgagaccagcctgaccaacatggtgaaacactgtctctactaagaatacaaaaattagatgggcatagtggtgcacgcctgtaatcccagctattcaggaggctgaggcaggagaatcgcttaacttgggaggcagaggttgcagtgagccaagattgcgcccgccactgtactccagcgtaggcgacaggagactccatctcaaaaaaaaaaaaaaaaaaaaaatttaaatacttgggtaacctttccattttcacagctctcacaaaataagactattaggggaaaaaaaccctccagtattgtaaaatacttttcctgtttctttgaagaaatggcaatgctctgtactcatttttgttgctacaagaaatgaaattctggttactagggcctataagggatgccaatggacttggggaatccactgttttaaaagtttctttccttaaaatcttcaagagctgcactgtccacgctaggctactgagcacttcaatgtgtgactcaatttttttttaaacttaaaaatggatatttagttctattagaaaattctgagcatgtttagaacaatttcaaaatgtaaatttactttctcagctatacattttatggaatctaaacagcaagaatttccagtaaacatttaggccattgagatgtgcttaaatataatgtacaccaaatgttaaagacttaattcaaaagaatgtaaaataccttactgttcttctataatgattatagaatgacacatttttgatatgttgcattaaatatataattaaaattaaacctttttatttttcttacaggtactagaaaatttaaaactacattacatggctcacattatctttgtagtggacaatggtaatctacatgaagtcctgaagttgtaaaactcatgactcagcccccaaataacactttctctgtatgccctcacaggccaataagattttgtcttttaagtttcttaatggctctaattttcattgttttctccttttactgctgagattataaaagccaatccttgggttggaaagggaaaggttatatcacacactatactgaatagttgttttcgggatgcaagtgctctgaagagacagcagagggcagtatacctccacaaactaaaacaaccggtcacttcctcagatttttccaaaatatttcatttttagataattttcttgttttgaaaaaaatctctataatacttaatgtttaaaaatgaaagtgcaattttaatacataatcaaattggatgtaaaaaatatacttgtctgtagaaaaatgacagcaaactaaatcttaccttcatgacaacaggtttttcaaaattataaacggaatgtgctttcctttgaacaaacttctgaaactctgagtagaaagcaatgacaacattataccttcaaataagcagtggggaagagtcagaaaaaagctacttaagtctcatctcaccattatagaccatttgaaaattaaatggctcttcctcatagatgtcatttaaatgtttcattgctattataagacagatttccaagactgatagacctacagtaaaagggaaaaaaaactatcagtttaatgacatataagactgaaataactgttctccaaagaatacaatatagtgaaagatctatggttctgaggggtgaagaaggtcaagattcttctagatttcaatgtgtttcaattatctatataaatttaagttacttaacctccctgagcttagtttttttcctatctgcaaaataaggatatttttaaacttttagaaatgtcacaaagattggcgaaatattatcaggcactcaccatatggcccacagtaaacaaaataaacttcaattgttatgtgactttaaatcacacagggcctttgcgtaggatttatctagagacttcctaaactcctggaaattatatccaaatctgtgtattccttttttccccggagaggaaaaggttcattacatttggaaaaggaaataacaaacccaaaatgactgaaacccagagaatgctcttcagtagttcttgatacaatgataacatcagcaacacagtcttacctggatttccaatgtggcaaaagaggcagagcgtcaaatttttttttcactttaaatgggagtgatagtacctttaaaaggactaagttaaaggctatatggatacgaaagtattttataaagcattatgcccacgttaattgtaattttaaaaacattccattatctaaattcaaagttttaaaaaccacaatttaaaaaataaggctgggttctcaccatgtacaatatttgctttcgagtccatgctacacagttggcttgcttccattagatctacggcagtcataaatgggtgcgatgctgttactcgatttaaagcaagcatctagggaaagacagatcagaaaaacaattacgtatttacatgggcattttggagatactgtgcaaaacttctgaatttgtatagttaattcttaagggagagtaaatattaatgcttaggaaggtattctcaaattcagttgtattaaaatacagtatttcaatttgtgtgtcacataactgcagatgtaaagcataaaaaaagttcctgctgctctctctaacccatcccagttgcataacttgtttacttactgcttggaagaacaatgtttaaagaggagtaggtcaaggagaagaaactgaaaataattaagaatacttactaataaaagccccaaacacaagcccaaaaggcagatctacgccttacttgttaactttttcaccacccaatcatccagccaggttagtattaatttagacagaagttagctgttttatgttcaattgtacaaaaaagaaaagaaaatagcacatttatactcaggaataactctccttgaaagcacagtctccttctcttgtgctgcttctctgttcaaaaatgaacagaggtcctggaccagagttgctactcaagtatttgaagatttccttccttccttctttatttgtatttttcatgaaagttaaatttggtcatttagggttacaagatttagcagataaaaatgcatgacctctggttaaatttcaatttcaaataaacaataaatagtttcttagtagtatgtgccatgcaatatttgggatataattatccaagaaactctccttcaccttaacaagggcgcaactgattagctgggcagagagtttggcaatccttgtccttcattctcctactggttgggacctagattgccagtgctccctccctttctctctcctttcctttttcctttagttattaattttttaatttttattttttaacttcatttttccataagttattgtggtatgggtggtatttggttacatgagtaagttctttagtggtgatttgtgagactttggtgaatgcatcacttgagcagtatacactgcatcatatttgtagtcttttatccctcgccccactggaaaacaatgtggagattccttaaagaactaaaagtagaactaccatttgatacagccatcccactacagggcatctacccagaggaaaagaagttattatttgaaaaagaaagaagtcattatttgaaaaagatgcttgcatgtgcatgtttatagcagcaaaactcacaattgcaaaatcgtagaaccaacccaaatgcccatcaatcaacgagtggataaagaaactgtggtatatatatactatggatatggataaagaaactgtggtatatatatactatggatatatggatatatatatatatgtggtatatatatactatggatactacacagtcataaaaaggaatgaactaacagcatttgcagtgacctggatgagactggagactattattctaagtgaagtaactcaggaatggaaaaccaaacatcgtatgttctcactgatatgatatgtgggagctaagctatgaggacacaaaggcataaattttttttaacatatacaaaggcaacagagaataataaatatctatgactactttacctgcttaagaaatatgattttagagttgaagcccatctcctccggattggactctactcttccccacataaaacaaccaagtatgtctatactattaggttggtgcaaaagtaattgccattttgggcactgaaagtaatggtaacttttgcaccaacctaatacttctactacatatacatgtattatacaacagagtaattttcaacttttatataaatatattgtatcttcacaactctcttcactgtgaggttttacccatgttgaggcagtatcaattctggtttattcattttttcattatatttctttgtatatatccacgattattcatttcctaatttcctattgacagacatctttcatttctttttttttcccaattataaacaagactgcaataaacaaccttggacatgtcttcctgtgcattaggtaactagactttctctaattagtatgtttctctagttacctaatttgctaaataaattgctctccaaagcacttacacatatttacattggcagcagcaataaatattaatagtcacagtcatgataccatcaagcataatctttaacacccactagattggcaagaaaaaaaaagtttaattgtagtatttctctggttactggagaggctgaaaatctgtaatctataatgagcttccacagtaagacaatgacaacaaataatgggatgagctaagaatatgagtaagcagccctcaaagtagaatcccatatgacaaaaaacaagccattatttaattcattaccatgaattaaaaatgtaatagaaaaatggcagaacaatggccgttaatattgacaatactgaggcagagatattttcccagatggagatgtgtgtgtatatatatatacatacacacatacacacacacacccctcctctaaaaattactagtccccaaattccttcatgatatgctgaaaatggcagtatgcttttgacaatagaagaaaagtaaatagggataaaaagacttaaattcctcagcagaagcagcaatgaggaaagaaaacttgtatataaacatgggtgaaccatacagccaagtaggacacaaacttgaagccagagagctttggattaagtcctggctttgttatctactagtagtgtgaccttcggcaagttacttagctttaaggagcctcaatttctttaggggtaagaataaaaaataagattattccaatggccagacataatataggtactactagcatcaacagtacttggctcatatgccagtccataaatggtagctactgtcattattattctattattattaaaaatgacctttctatgaaaccaaaactatcttgtctttcaaaggtatttgccataattttctagaaatattagactaaaaccaaatactcttagtgaagaaagttaattttcagaacaattaagtacttcttgtttgatattggtattatgtaagcttaagatataattacttggcaaaacatcataaccaggtaggatttattccaggtatataaggctggttcaacactcaaaaaataacataatcaaatatatcaacaggttaaagagaaacatggtcatgcgaaacgatcgagaataagcatttgacaaaatccaacacccatttataagaaactctcagcaagttacaaacagatgaggattacctcaacctgataatgaacatgtataaaaaacctacagctaacattatacttaatggtaaaagtttgaatcctttcttcctaagactgggaacaagaaaggatgtccactctcactgctctaattcaacataacactggaaattctagccattgcaaaaaagcaagaaaagaaataaaaggcatacagattggaaagaaaaaaaaaaccgtcactatttgtgaaaaatgtaatggtctacatcaaaagtcccaaggaatctattaaaaaacctcttagaataagtgagttcagcatagactataagtcaatcacatttctatatattaatgtgtatatatataatcaatcacatattctatatgtaatgaatatgtgggaaatgtaatgaatatgtgggaaaccaaaatttcaaaacccatttacaattgttctaacaaattaaatattggtatacacattaaataagtacatcatctgtgtagtaagagctataaaatgctgatgaaagtaatcaaacaagaaatcaaataaaaggagatatgaaccctattcagagattggaacactcgatgtagtgttccaatgcatgtcgattctcccaaaatttacctacaggtttaatcaattcccataaaaacttaattatctaatgaaagatagaaaatgataaaagtaggctgggcacagtggttgatgcttgtaatgtcagcacttagggaggcagaggtgggaggatggcttaaggccaggagttcgcaaccagtctgagcaacaaagtgagaccccgtcactattaaaaacaaaaacaaagcaacaagcaataaaacaaaactaatacaaaccaatagcatgtgtaatgaccgcaggtttttgctgatattgaaatgcttctgtagtacttcttgcacacttctatcttctgagagatactaaaaggaaaaaaaaaaaaaaagccaaaattgaggaaagatgtagtttaaaacctaaatataatcctgtgccttactggttggtgtaccttagtaactctatctaatattaattcattattaaatagatgttggtcttatttgtagaacactaaaaccaaaataaagtttccagtctactgattttcttatcctgttctttacgttaattcaataaacacaatgataaaacaatcctggctaaccccaaattcgtacttgaataagggaaactactacacagtcatactagtgaaatgaacaaaatgcagcacaaaaacagaagtgcatgagttactgtacctagggatacaaggtaaagtattacaaagaatgcttaaactggatgagacaagagatttaaaaaagaaggaagaacattccagttacagggaacagcatgagtagcaggaaaattatcacattggcagaaaatgagtagtcacgtactggagtttcaattactggcaaagtgaatgtacaaaaagaaaaggcagaaaaacctaactggaggtagctgtccagacaagaggtaaagtgggtcggaattatctgagtgttatgaagaaaaaagaattaagacgtttataggagtacatctggtagagaattaactggtagcagaagagaaggaagggtttgaaaggtagaagataaaaatcaaacatgatctatgggaaacaaaatggcctgtgaaaagtgaaatgtggtcaaaaaatgaatcttggattattaatatttaagtagtaggtgggaaaagagaaaaactaagaaattaagaaagataccaaagactggaagagaatctaagacagagtagagatctagaaaacaagggaacaaagttttaagagagaagtgaggttcaacaatataaactactttgtaaaaagatatatttgagaagaggctaatggctttagaaattcaaagatcaccacagccctttgagaaagtaccatctaaagaggcaagtgactgcagtaattagggttgaatggaaggtgaggaacactggcattgaagaaaagattagatgaaaaaagagtaaattcagaagtagcagagccaagaaaggcctggaaaagattgtcataatttttcaaaaatcatctgcatggaataaggattcttttaaaaaaaaaaaaaagcccagaaaactaagcatttctgtattttctagagctgtaattatatgtctttactttgtccactctaagaagaccagattcagaagtaagttctagtctactggaataaaattttatactctcaggaaatatattatcttaattatagttcccactcccttgctattgtttctagtcttctctttgtattttaaaggacttctggttactatatctttttctatcacaaacacggtagaatatccttggaagtacacagggtgaacataaaaaaaacaaagtaataccttttggaaattaaaaaaaaatttgtttagcttttccagttttaaaattgcaatatggaagatatgtggctaaatatcacaggcaaactatagtcttggtttctgtaatctgtaagttgtaaaagttgatgtggtaaaatcggagcacttaggaaaactaaagaaaatcacctgggacaaaattgaagaaattttctctgcaagaatcaattatttttaaaacctgcatttgcctctctttgacatgatgcttcaaaggttaatcttctatactccaccttcctactttatctctttattttttagtggtttgactccaattccccctctttctaaaagctatcgccttcttgcttctataattacttattctgctttttaaaatgcctaccttatctacatgagccatttaaacaaaaaaaattgtctaacctcgttcattatatttttaattccatcttgattcaaacactatactctatttgaggataaggctattatcaacaaccacataagctacagtactttgggagatttcatttgaggagaataaggtatgattcttttaaatgttcttttcaaaggatccctcttatactgccatgctaagatagagtctactttgcttatttgactcatttgaagtagggctaaaacaaaccttcaaattaggcaggatatcaaggttcaatcttatcctgaagatatttcttggatgagattccatgtgtgacctgttatctgtatcactgctattggcttaatcctgccattcaaaatagcttcctggataatcggcactaagagaaagaatagctcccttaatgcagctaccaccctactccacaaggcagggactctgaccatggtgctgacagatttttcaagtgaagctcattttattcacataccaaagacaggcacaagatgatcaggataggggaagaaaatattagaactcagagacacaaacaccagtgatgctggttctacttaatgaaactgactattaagactatcaaaatgatgacaagacagtgctcacatgcaggggatttaaggtctgcaacaaaagtccagaaagtagattagttatgctactaacacatggttatcattttctaagtcacgcagttatacttcttcaccagtaactcccagcatcctctttatttatagactcaatttgagatgctcagaatgcaacacagttgggaaggaaagtggatgaaaaatggcacagtgcaacctagaccatgtagttaccttaagaagattaagtgtgagcaggtatggaaaaaaaaaagcccatggaaagtacagacatttaaatactatgaaagactacatttgaatctctaaaacagccagaaaaacatactggtggaataagacaatcagttcaggagttgtagaagatgaaagtctgtgaggcactgaaaagtagatctaaaagctgaagatccagaggtctggttcacaccagaccccagtaaaaggggacaatgtgggagtaccaactacaaagaaggtgctcctatagatggaatcctataattagaaatagtatcaaagacacttggtcaggtaattgaaatacccgagtctcaggaaagattgagtggaagggaggatccatacctaattatatcaaggcataatatctgaattttaaagataatgtcagctatttttacatacaattatgtatagttgtattaagaaaaagaacagggaattattaatcataacaatgggaaaaaagtaatataaaaatatgtaggctttgagtcctttatgtaaaaacaacatatttagcatgtatataaactctgcaatgttgtagaccaagtaattattccatagtagaagaaaggagaattgatatagtcttaagggaaacttccactgtttatcatgtattcttttgcactaattacattttgttcaataaacttttatgatattttaaaaaaatgaaatgtgtcaaaatactgcttacatgagcagactatattttataatcaaacaataatcatttaaagaacaaactaaatgcaaaacgcttccaatttagtattagtatttaaaaattcacggtaaaaatacaatctaccactattgctttaaaataaaatgatcctttttatagagtcagtgaatatagactgtgtaattctattcaaagatctaattatccttaccggtattttaacattataaatcagtttttcccaattccttcagagccagggactctatattattttccactctcacgaggccaatattttttgagattctagcataagggacttattcattaatgatgtttttcaattatattattaaatacacacacatatgcatacttcctcctttctctttgccaactgaaactttttgacagcgtaagattaaaatgctagtgtgttgagaatattttaagcacaggtaaatttatagtctcaaaggtgtggcaaatctttaaaacaacatatgaacctgcctttgtatctaagactctcaagtctccagggactgtgagatgtgatcacctattagataatataactggaggtgccacagtctgtactgcctcttaaggcccaacaaaataaaagctgaagttgctaatgaaaactggaagaaaaaaaatatccacacataataggtatgagtcattaacatttatttatcattatttactatttattattattgctaaatatgtaaaatatataaaataaaattatctaaaatataaaccacatacagataaaactaaagcctcattaaagtttacttcaaactaataacataaatcctaaagcttaactgtgatgttcttttgagatagaatttaggagaaatgacatttcaactgtctaagaagaaaatttttaaaaagtatataatttgtattactgcagcattatccttcagcaatattagaaactttgtgttaatttactaatttctaaaatttgtgttttaattgctttaaatcatatagcaaggaacatttagctttattgccttttaagatacctgaacattttcattccacttctcagcaaaaaccttgtctggaaactctgcaggtagagataactgttctttaaatattttaacatactgtggaaaaccaaatgaattcattaagtgtatctgccggtgagaaaatcttgacttcactcttttttctaagagttccaaaatatccttaaaaacaaacagaaatctctataaggaagatgaatgtttttaaaaaaacaaaaacactgtaccaatgttagaggtataagtaaactatcacctataattagtaatgtttagtctacaatacataattaaacatttaaaacattttatgcaaactaaataatccacctccaggcatttgctggcttggtgatgtcatgcctttttcccaccatgttactctcagctaatctgtaacattccaagacccaacatgactgtttaaaaaaactgacaatattgaatagctatatgtcacaataacaccaagagtgtcaataaggaattctgtacattctatgaagaactgagattaaaaaattaatagcatgataggcagcaggaaccaactttaggagaggaaagtggcagaaatgcaacatggcattcgtaagttatcttccggcttttttttttttatagtaatgcttttagactctatttgtatttgtgctatttttccttaaaaagaaatcaggaatcaaatttactgtcaaagaacactaaaaaccaaaggataactaatatgtactgcttgtaaggacatacgaagtgttcttaaatgaagaaaatacttccacaaaactgataggcattcaaactatccaagacatcaaaagcacaataggtaagctgtcttcctaagtcacatatattgcaggaactgtcattcctaaatctctttttaataatgaacttgagcaatttttcaaaatatattatagtacacagcatattatatataatatatataatttatattatatatgtatatatacatctatatatatacagtatagtataatatatatttattacttaagttacactccaaggtatacaaccaagacaaatgaaaccagataaccacaaaaaaagtgtatgtgaatgtttgcagcagtattatttttaatagcttaagaaatataaacaacccaaatgtccatcaactgatgaatggataaacaaagtgtggtatatctacacaacagaatattatttggtaataaaaaggaataaagggctgatatatgctgtaacacagatcaactctgaaaacatgttaaagaagccagtcacacaaaactatacgttgtatgattcaaaaattactaaacagtcagaaagtggattagcagattagtggttgcatagggctggggagggaacaggggatttggggtgatcactaaaaggtacgtggctcttaaactgtggtgataaatgcacaactctatgaataaacaaaaaccctgttaattgtataatttaaatgagtgagttgtatggtataaattacatctcaataaagctgttttaaaaacagtgacatgatatttgatgactttaaggaattacagctaatataacaattatattagggaaatatatttttaaagagctcttatctcctaaaaatacattctaaaatacttactgataaaatgatataatacctagtttttgcctcaaaataatacaggaatgaaaggagatgttgaggataaataaaattagtctgtagtaattgaatcttggcaatgagtggagaagggaattcagggctcattatttattctttcctatgtatattgttgaaatgttataaagatttttaaaaggggagtagtttaagcccagaaatatacatctccacatctagccagatgactctcataatacctacgtgaagaaatcatgatatagaggaaagaattcaagtgatcaaaatgggatcatggttagtttgggaaggtggacaggaaagactaatagcctgaggtaggaggtgggagggtgaataaaaaattttgaatgtttttatgaggtcaaagaaaagtatagtgccagcatgagaactaaaagacaagaaaggttatattcagagattcagatattgtacatttattttctattaagaaagagttctaggtcacccatataggtagacagtggaagtaataatctatacaagcaacaattcagaccctaaatttgggaatgaaaagagatggaagtaaatactgtctttgtagtaggcagtaatgacagaagttggcaatgtgggcatacaggaactagtaaaaacaaaacaaaaccaaaaaacaaaaatggaattactcccaatggggaagaagatgcttgctggcaaagtcactactccctctatacttttgttctctccctataaacgtggatacacagataaaattatacttgaggccaggcgcagtggctcacgcctgtaatcccagcactttgggaggccaaggggggtagatcacgaggtcaggagttcgagagcagcctgggcaacatggtgaaaccccatctctactaaacatacaaaaattagccaggcatggcggtgtgtggctgtaatcccagctactcgggaggctaaggcaggagaattgcttgaaccccgaaggtggaggttgcagtgagccgagattatgccattgtactccagcctgggcgacagagcaagactccatctcaaaaaaaaaaaaaaagaaaaagaaaaaaaattacacttgaaagaactacacagttggagaattatatatatacaataaaaaagaacatctgataacactgctaagaagttactggcattttatttggtccgttattgggtcaacaacactcaccacagccacttccacccaaaggaagatttttttttttttggcaagaaggaggatgcttctttgatccttgtcatcgcctgctgcttttggcaaggaggaataaagatatgtggagcaccagccagtgatgtatgagggatgtttatactaaagccatgtatcataagctctagagcacaggaaaggaggggcaaatgacagtcactctatagagaaacagcactggaaggaggactgttgaaatatgaattagaaaaaagtttcacttttctgaaaaagaaaaagggttgtaggaaaggagatgtgaacatgtaaatgtgcctgacacatctgccgagaatggagggggaagaggattgcaagaaagctatggaggcatggcagtcatagcatgagaaaagagacaactttgctatggtttggatatggtttgtccccaccaaatctcatgttgaaatttaattgccagtgcaacagtgggaagtcactggagtggaccctcataaatagatttaatgccttcttactggagtgagttcttgttctcatggggatagattagttcttgagacagtgagttgttataaattgaggttccaactcctatctggttcgtttttgcacatttcggttccccatttgaccttccaccatgtcatgcagcatgaaaacccttgcaacaaagccagtgccatgcgcttgaatttttcagcctgcagaactgtgagataaataaacttcttttctttaaaaattaccaagtctcaggtattatgttatagcaacacaaaatgggccaaggcactcttcaataccagttttatctgaattcagtaagttaatactacatgcgtgtaagaaggtaaacacaaaaaggcctgtactgctgtccaaaggtacacatggttcaatatgtacagagccttcacaaggcaaagtgatagtgatattgagactatagttaaaatcattctaaaatatcccatggaatgaagaagccactatctactgtcagtgcttggtagaatcttttccatttctggagatgtgtactttgaaagttggaatagtattacttagagttgatttcaagccttttcaaaatatggaaaaaaatcttaaaataaaaactattaccaagttttctcaaatattggtgagatttaaccgcctcattacttgataatgtagaaattatatttattagcataatctgatttcatacttttttcttcagtaatttcactgggaggagggaggtattcattaatgggctaaggtaactactaaactgttttcctcaatttgagttgaaagcaggataaatacaccaggcactgctgaaacaaaatttttaaaatgacctaaataagtgaaaaaaactagcagtgtcagcaattaagcttgaattttaaaatattataatcaatttttttaatgaacagaaagacttaccaatctacatgtaagaccaataactgctattggggtctgtgcagactgagaaatgtcaaaaagattatagagaagtgtttggtttttatgatgagcaaaaagatcaaattcatctaatatgaagatcactgggcaactgctagttcggtcacctaagataaaataagagcattacattaataagaaattatatccacctttcctaaatttccaaaccatttactatatttcagtttttaaaactcaattctgtaaacattctgatagcctactttgggtaggggatttactgatgcatatacgttcattcaacagaaaaaaattattcaaaggacaaacacagccccgactgctctcaagaagttcagtctaggctgggcgtggtggctcatgcctgtaatcccagcactttgggaggctgaggtgggtggatcacctgaggtcgggagttcgagaccagcctgacaaacatggagaaatcccatctctactaaaaatacaaaattagtcaggtgtggtggcgcatgcctgtaatcccagctactcgggaggctgaggcaggagaattgcttgaacccaggaggcagaggttgtggtgagccaagatcgtgccactgcactccagcctgggcaacgagagtgaaactccatctcaaaaaaaaaaagttcagtctaggccgggcatggtgactcacgcttgtaatcccagcactttgggaggccgaggtaggtggatcacctaaggtcaggggtttgagaccagcctggccaacatggtaaaaccccatctctgctattaaaaaaaaaaaaaaaaattagctacttgggaggctgaggcaggagaatctcttgaactgcggaggcagaggttgcagtgagctgagatcacaccattgtattctagcctgggcaacaagagtgaaactccatctccaaaaaataaaaagtgcagtctagttcctagactctagtagagtttgttgttgaaaaatgtcaaaaatcatttaaatgactaaagactattatttttataattacgtaaatataattcttatttaatgattataaaattgacagagttttctatacctacacagaaccaaaacactttaagattaaaatataaggggagtcactaattaatgaacaaaactaatgctttaaaagagagttgtttatttagtagaaatacaaggtacatttcttgtagaaatactttttataaacaaacttgtagattataaagttcaactaaagccacttaaactcccttgaagcacaacttttagcatttcaactacaatgcttttcatggggaaagttccacatcaccctctggttacatttttctcacttcaataatggaaacaactttagtaaaagaatcccttttaccttaggcttaacgcctttatatttgtgttaaaaagtgaaacaaatatctgataaaagaaagacttatttcaacaaataacaaatacagtagcctaaatgacttaatactggtacaaaaccaaagggattactcaaaagtctagaaagagacttatgtactaatatagaattttagtatttgataaaatattgcattatacatcagtggggaaaattagtctattcaaagtcagatccctactttacaggtaaaatcagaataaattccaaacaaattataaattacaaatatatatatatattaaataaaaagatggatcaatgaatgtttttataatctgaaggagagaaaaaactttctagataaacttaactatgtggaaaacataaaactttagatcagcagaaaagtccaaaccaaacttaagggaagagaaaaataaaacacaaaaattccgataaataagcataacataaacattaccacaataggtcaaagacccaacaggaaatacagtcgtgtgtcccttaatgacagagatacgttctgagaaatgtattgttaggtgactgcatcgttgtacaagcatcctaacagtgtacttacccaagcctagatggtatagcctactagacacctaggctatatggcatagcctattgctcctaggctatgaacctatgagcatgtgatagtgtagacaactgtaacacaatgcgaagtatttgtgtatctaaacatatctaaacacaggaaaggtacagtaaaaatatggttttataatctaataggaccactgtcacatatgtggtctatcattgaattaaaggttgttatgtggcacatgactgtacataaaccaggaaatttcaaaggtcaataaaaatatgaaatgacaagcatcaccactatcagaattatgcaaattaagtaaccagaattatgcaaattaaagaacaaaattattcaaattaaactaagagctgaaagtttttctattatatgggcaaacataaaaataataattgtttttgaggttgtgaagaaaaaggtattatcaaatatttttacaaattaaacctttagggtagtttttaaatgttaaagatggtgccttttaacccagaattctacccacagaaatttatcccaggaaatatctggatgatcatcaaagtatctcttcttaattataaaaaattagaaacaaaagcccataattggtgattaataaatagcaccttataaaacaagaaccataaaaatgatgatgcagatcaaaatcttattacaaaataggtaaaataattttattgttgtaaaaaatcacatttatctctatcaataatatactgatataaagatcagtatatcattgaataaagataagaaaccaaatgctaattgagataatcactgttatagtggtgggaatacagtgaacattgtattctttttaatgtttctgtattttatgagagcttttttttttggcaaaagcttgtattacctttataatcagggaaaaaataaagttaaaacagatcttctgaaacggctgaatatgttaatatttacctttttttaaagcttccagaagaaatgaaaggttttcagcaaagcttccctgaacaacaaaatgagataaaatgattaaaagtttagtgaaataaagaacaaaagatggctgtctgattctcaaattttatataaacactgtatatcttctagttattagagtcattgcccagactctgctgagtgtctctatacttcctatctaaaacttaaatacttaagcaaagatggcacatcactgaaaatggcaattacaatgtcatctttgaaattttatattttagaacttgaggataaaacggtcaaagaagaaaaagaaaagtaagaaattttatattttccggaaaaaatctgaaagaatgttaaatttatttgaaggtagttttgtagaattgccatattctaaatatagtttgagacctagaaatggattctactttgtgtcttcaaacacaatggggtcttgcaagtctctaatttgtactggtaaagaaataaccatgaatttaaatgagaaacaaaaagaaaaggcttttttgaaacattagatactataacagtgtttgtctattcaagagtatactgaagaatttatgtatatcatatcatgtttggctatgtttacttggaatatagccaaaacatttttggatactattaaatattcttgatgaaacttagtgtagtagatgcattatccaggtgctccagattgtgggtagaagccccattaaaatatttgtttcattaaaattattaacttttacttcattcagagttcataactaaaagaaacagccaactttaaatttgaggagatataaaggagaaaagaaacacacttattcactctccagttgagagatctaacataaaaatagcataaaggttttaaaactttcacatattgtgatgttgttatgctatttccaaggcaggcagaccaagaggtgttatccataatttaccgtaatataacaaatcctcaaagagacaatctgttgggaaatcagtggtcagttactcaaaggtagcttgtctttcaggctttttgcttaaaagattattacatctgatactaagtatatgcttctataaatacgtatttgtgcatgtataatatacatatatatgtctgtttatatcaaaccagaaaagctgtgggttgaattaagtgacttaggttcttataatgtccaggctctgccattttatgaccttcggcaacctaattatgctctctgagcagaagccaaatttatataatgaaggaattaaactattaatttctatagcagtatttctctattcaagagtacattgaagaatttatgtatatcgtatcatgtttggctatgcttactcggaacacagccaaaacatttttgggtacaacttaaactaataatctctatatatgataataatagcgaagattagaacagaatgataaaaaattgtcatttttattatttcacataaaaccaatatgaatatgtaacatttaaaaatgtcagaaacacctacccagatcaactgggaaccaaaagccaaactgagcatacttaacaagaactgtctttggctcagtataggccactagcttcaacatcacattctaaacaggaggtagaatattagatttatagatggggcattttgaaactgcacttcaaagacctacagactttggaagggacaaatttactcaaccttttagattagattaacattttatattaatatttttatagattaatatattatattaataatttagattataatctataattacatataataaactataattatatataatctattagataattatatagatataacctattatagaattacatagattatataattatataattatataattaataattttatagagtatataattatataattaataattttatagattgattattaaagaaagaaactcataaatgctaggagtcttacacaactatggcggtgtcattgcagcacaaagcacacagttcagaaattagagcgatgccaccgcatggtcaccagtaaccagaaaatgaagttggaatgtgtataatccactccaactgcataagcagtatgaggctaggtaatttcatcatgaaaattcaggtaggtgcaaaattaaattatcatgttttccttaggccctatatattaggtgaaaggtaaaagtttaatacaagtttcaaaacatttcaagtcagtttcttttactgatgttgttcactgccctgagactataagatgatatgataatgaagtatgaataaatttctgaaaacagaataactgacatttgtacagcacattaccatccagcaaattattttttaagttaaatgatgtgtaatgttttctttcttcttcaaaataatcctgtgaagtatggataataaaataacgcccaattaacatgtaaagaatctgaattcagagatacttgttagctcaggattatcaggcagtcaaagggttgtaaggcatgactgaaacccacctattgcagcctcaaatttagcacattttctactatacacaggctactcaagtctcaaaaaagtagaaataggctgctggagcatggtatttttaaaaatgtgttaatctatctccagagatacagaatcaaagtattcaccttacagaaaatgaaataaactcagaatatctacataaacttgggtttcttagctattttacagctactataacctactatggaaaaatccaagtattgtagacttaatgactaaatgtatcctatacattacacatttttatgaaagaatctcatatatttcaattaagaatttctgaacctctccctacccttccagaaatataaaaatatacatggtataaagacattaccttaaaagtctatttaataaaataactgaaatgatacttacaaaaactttatctccaactacattttccagatttaactgccttgtgatttcctttagggcgattttgtcattgatctgcagcagtcctaaaataaagtccatttaaaagtatttaattaaaattaaacatgtatttgatacagcaggttgttttccagttaagtaaatcttcccagtcaaagcctgtgagttcatatcactttcttcttaaaacttagcaataaagacattcggtagaatcaaaaaacaatcctccttgggattagaatgattaaaaaaaaaaaaaccaaaaaacccacaaaaaccagagtccttctgcgactccttcattattattattttaatttctaaaaatactgcatatggtgtgctaagtaaaacatggatctagttttcaaaatctaactattaaaatggatttgaaatatacaagtcatataaaaaccccacaaagtttacataatctccaatggcaaaataatggcatacttaccatttaagtgaacttgtaatacattttcactcacttcttctatttccatgagttctttcaaagcatgatttattaactaaatatgaaaagtttatgaaataataataggtaaaagataaaaataagtccatattcgtttttaaactacaagcagtaagaacagaatataaataaattgacctctttaacaagtaagttttcaaattctttacagataaaaggtttaactagaacatctcatatctgactctttttaagaaacaagagccaggactgatacaatattctctcaatcacctacccgaacttttaatacaaatttagaaacaaccaagttttaaaataaatatttctctacatgtcacattaaacatgtgacatggcccttataaacttcatgtctcagttagtacattacacatctctctgacaattactctactaaatatcattgtaatcagttaaaagcccattgaattaaaggtttctatgaagcatacttttttaaataacattgtattgctcttgtactgtgatatcatacatatctcttcatattaccaatgcattcttttttttaaagaatttgaaaatgaatgtaattaagaaaagccaaaaacctatttaaagagtaaagatggactgttccttccaatattaaaatataggtactatcataaataagtgaactgggaaaagcagttgtatacacaaaatattaatagagatggcatcaaaacttaggacaaaaagtattactcaacgaaggcactgggacaactggtaaactattttccaaaacaaaatactgtttgtatttgcaatatgctacttatttgtcattgcaacaccttatctaaaaagaaaaaagcaaatatgatcctcattttaaattacatatgtttcataacaagacaacaaaaataaaaaaaatttcctgttatacctgcatggtttttaaagcatagggaattccaggtcctctgaaaaggagacaatctcaagatatcacctgtcatactaccagtaatagcccaactgagaagtgacatttaatgagaagtgacatttaatgagaagtaacattaaaggactgcatagaggtacttcttcacctctggatcaggtcagacactataataagagtacatccctagatgatacagagttggtctctcaaaacagtgctttcagcaaaaattttttattttttattttttttgcaatccatggtattttctttcttccatctcttgatattttgcttaatatattttttcctaggttatgattttgttttaattcatacaatgttttatgttttgatgaattattcaaaaccatttcaaatcctttgctaaaaggaatggggattttaataataccttccattttatatatgcataaggagagttgtaacagatttatagctttctttccactcaacttactttaaacaccaacttatgctttgcttggatcagcccactaatattttatgggttgtgtgtatggtctgaaatgataaatatattagcaagtgagtcttcaaataatgttagttctaatctgggtattgctaaaatttattgtttatgcaatcaaccatttaagttagcttttttcttgaatatgttatcatttcaaatatttaaactacattatacactaaaaatatttagttggttattaatatcacactgaccaacataaccaaatttggtcatctcctttccacattctttgtgcctaaaatttaattttacaaacatactaagataattttcttagacctcccaacatccagtaatttttatgctcaccaacttatactattcccaaatattataataaacacaggtttcaccaatatgcaactaggagaaatatcctatttaaccatctagcaaatttgtctacagtaaattgcatgtgtaagagcattttctaagggtcggtacagtgggtcacacctgtaatctgagtgctttgagaggcagaggcaggaggactgcctgagcccaggaggttgaggctttagtgagctatgattgagccgctgggcgccagcatgggtgacagagagcctgtctcttaaaacaaaaaaaggtattttctaggggtcaatctgtcacttgaagccatatcaattttttttttaaataaaatgcttgtaatattataagccacactattgcctttttcaattaactatagagttagcatttttgtatttcagacagtttggccaagtatagtgttttaaatatactataatcttagggttaggattaggggttaaaacaaacaaacataagactacagtcttatgttttaaaatttgaatttatataattatactaatgaggctaggcacagtggctcatgcctgtaatcccagcactttggaaggccaaggtgggtggatcacttgagcacagcagttccagacaaacctggtaaacatggtgaaaccccatctctactaaacataaaaaacttagctgggtgtggtggcacatgcctgtcccagctactcgggaggcaaatgtgggaggattgcttgagcccgcgaggcagaggttgcagtgagtctagatcgtgccactgcactccagcctgggcaacagagtgagactctgtcaaagaaaaaaaaaaaaagaaaagaaaaagaaaaaaattatactatcgagagttattgtctaaaaataaattatatctgacaatttattcaatctatattttctctcaggatactcccacacatacaacaaattacaaaagtagcacaagtcaaacaatgctcatctcttcaacctgccagcatcagagtacatcaggaatatatgaaactatatcaaaatggaatgccatgcaagggactcttccagattccactatagtgaaaataaatgactgcaaggcaccacaatagggctctggtttaaaaagcaaaaagtagataaactgtcagtgtggccaagaataactgatccattttattaactgataaatactatgatttaatgcttttgcctttaaatttcagtacattgattaaacctataggggtttatgaaaaggtgctataacgtggaagggaacaacaagcagattaaaaagattaagttcagatttaaaatattaagcaagatggctgattagagactcctggtgctcgtactcccaacaagaaaggaccacagcaatgaatgaacagctaagatttgactggcgtgttgaagggagagtactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggaaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttccagtactaggggtccatcttcattccaccaagcccacataggtggctgaacacacaactctagctgcacagagactgagcctataattggttatgactctggtcctacacagcaaggaaaccaaccccttgctgccacacttccagccagagaaccaatctggcagtcccacccagggcaaactctcacttgaggtgaccaaaccagggtggggctctctcccaagaaggagaggcccccgagcatccaagcagctgatacaccccttgcactggcagagcggctatgcacccacactcagaacctgagaaacagccccacaataccgtgcacccctccctcccgcagacatacccctagcttgcccagtggtcctgtgcccacaatcagagcctgaaaaatagcccagaaggttacccctggcaggcatgcccccagcccagccgagcagccatgagccatgacctgtacctgagaaacagccctatgggccacccatggtgaatacacctcccacagggtggccaagcatccctgtgaacacatactaggcctgagaagtagcccttcaggccattcttgagcctgccaagcagtcttgtgctcacctcccaaacctgacaaacagcacagcctccctataactccatcagacatgccccaggaccagccaagcaatcatgtgcccacgtcgctaacctgagaagtacacttgccaactgcccctaacagacacattaccctagctggctgagcagcattacaccttaggcctacaaatcagccctgagggttgcctctggcagacactcttttgggccagtcgagcaaccctgctcctacttcccaggtctacaaaatggtccagtgggccatctgctgcagaaaagttcccaggccagccaagcagcagtgtcacaggcctgagaaacagcctcacaggacgcctctagtgggcatgcccataagccagctgaatagccttgtgcctgcatcctaaacctgagaaacaatcctgtggaacccctcagcagatacggccctaagccagtcgaggaactgtatccctacacctctgttgggatcaagcagccttgcacctggatcccaggcatctcctgggcctgagaaacaaaccagtgagttgttcctggcaaacattcaccaagactggctaagcaaccacatgactatgctcctggccacattaatagccccatctgccagtgtgtcagatcccaaggtgattgacccaccatatgcatgcatatgcccccaaactgagaaccagcccagcaaacccaccccttgcaaagctgtacaactgccaccacaaacaactctcagcctaggccactgagacacttgtaaatgacactagtgtggattacagctgaaaaaactacacaaagaccacactactgtatccaactagaaccaaggccaatgaaccacatcaaactgacacctcgagacacattgacacaaatcagtacttccttacgagatcaattctgtaagattggaaaagacaattttacttttctacctgaggcgtatcaatcaacatagggacacattaaacataaaaaagcaagaaaacatgacacttccaaaggaaaacaataattcctctagtaacagacaagaatcataaagaaatacagaaaatgccagaagaatttaaaataataatcttgacaacactcagtgaaattcaaaagaatacagatagaaaattgaacaaaatcagaaaaacaacttgtgattcgaataagaaattaacagagataccataaaaaaacaaacagaaatcctacagctgaagaagttaatgaatgaaatagaaaatacaactgagaccttcaataacagactacatcaagcataagcatttcttaaattgaagacaaattgtttgaaataacacaggcagacaagaaaaaaaatagaatgaagaaagtctacaggatttataagacttcaataagtgaacaaatatttgtattattgtactttcaggaggagaaaagaaggaaaaggtgagaaaaacatatttaataaaaccatagttgaaaacttcccagttcttgagagaggaatggacatccaaaggaagctcaaaactccaaacagactcaacacaaacagaaggtcttctctgaggcatattatagtcaaattgttaaaagtcacagacaaataattaaagcagcaaaagtaaagtgtcaagtcactataagggaatccctattatactaacagtagatttcttcttctttatagcagatttcttttttttaattaaaaattttaaactatcatttttttaaatgatattttaaaacatctttcatccttcttgtttacattttagctgattgtcagaatatacaacagcagatttcttaagagaaacctgacaggacagaggggaatgggatgatacaatcaaagctcagaatgaaagaactgtcagctaagaatataatacccagcagcttcagaaataaaggagaaataaaatctttcacagacaagcaaaaactaaagcaatccgtcatcactagaccagacctataagaaatgttcaagggagtctaacatccacaaatgcaaagatgatgaccaccatcatgaaaacagggaaaactataaaactcactggtactgcggatacataaaggagaaagagaaaggatcaagccttatcactacagagaggcacccaactggaaaaataaatgagaggaagtaagaaacaaaggatatatgaaacaaccagaaaacaatcactaaaatgacagggtaagtcctcacttatcaataataatcttgaatataaaccaattaagtttcccatttaaaaaatacagaacagataaaaaaaaaaactcaattatatgctgctacaagaaactcacctcacctgtatagacacacagacttaaaggtatgaaaaagatatcctatgaaaatggaaaataaaagtgataagaaagttgtaaaaacaaagaacattatataataataaaaggatcaattcaacaacagaatataacagttgtacatataaatgtacccaacactgaaacactcagatgtataaagcaagtattattagatctaaagagagataaattgcaataaaataataggaacttcaacaccctattctcagcattggacagataatttagacagaaaatcaacaaagagacattgaatttgaacttcaccatagaccaaatggacctaaaatacatctatagaacatttcacccaacaactgcagaatgtacattcttctcatcagcacacagaagattctccaagactgacctcatgttaggacacaacagaagtcttaaaacatttttttaaaaaaagcaaaatcctatcaagtatctgatctggccacaatggaataaaactagatatcgataataaaaacaactggctaggtgtggtagctcacacctgtaaccccaacactttgagacgccaaggtgggaggatcccttgagcccaggagtttgagaccagcctgggcaaaatagggagacctggtctatattttttttaaaaagtaataataatgacaggaacattaaaaactatacaaaaatatggaaattagacaacatgcccatgaacaatgggcaaaagaaattaagaatattacagattcctagaaacaaaagaaaatagaaacacaacttactaaaacttaaggaacacacagcaaaagcagaattaagaggcaagtttatatcaatatatgcctacatcaaaaaactagaaaaatttcaaataaagaatctaacaatgcaatccaaaaaattagaaaaattttaaattaaaaaatctaacaatgtattccaaagagctagaaaagaacaaaccaaaccccaaattagtcaaaggaaataaatatcagagaaggaataaacaaaattgagactaaaacaatactacaaaaaatcactgaaacaaaagttgcttagctagactaagaaagaccaaaataaataaatgagaaaagaaaaaggagacatcaaactgaatatcacagaaataaaaaggatcattagggactactatgaagaactatacatcaataaattacaaaacctaaaggaaatggttaagttcctggacacatacaacctttcaatattgaagcaagaagacacagaaaacctggagagaccaataacaaataatgaggtagaatcaggaataaaaagtcttccaacaaaggaaaatccagtactggatggctttgctgctgaattctactaaacccttaaggaattaatgccaattcttctaaaactattccaaaaaattcaagcagagaaaattcttcctaattcgttctatgaggccagcataaccctgacatcaaaactagacaaggacaaaacagcaacaaaaactacaggtcaacatctctgatgaatatagatgcaaaagtcttcaataaagtattagtaagctgaatgcaaaaagatcattcaccatgatcaagtgggatttatcccagggatgcaaggatggtttaatatacgcaaatcaataaacatcatacaccacatcaatagaatggaggccagaaactatatcatctcaatggatgcagaaaaaaacacgtgataaaattcaacatcccttcatgatagaaactgtcaaaaaggtatagaaaaaaaacaccacaacacagtaaaggccatatatgacaaacccaaaaccaacatcacaccaaatggggaaaaactaaaagtttctcctgtaagaactggaacaatacaaggatgttcactctccccattcttattcaatatagtactagatgttcaagccaaagcaatgggaaaggaagaagtcaattcattcctttttgcagatgacataatcttatatatagaaaaacctagagactctaccaaaaaactcttagaatttcagtaaagttgaaggctacaaaatcaatatacaataaccagtactgtttgtatatactaacaacaaactacccgaaaaaaaaaaatcaagaaggcaatcccatttataagagctaccaaaaaaacgtaattactgaggaataaattcaattaaggaggtgaaaggtacagttttgtacaaggaaaactacaaagcactgaagaaagaaattgaggaggatacacacaaatgaaaagacacccatactcacatgatagaaagaatgaatattgttaaaattactatattaccagaagcaatctacagtttcaatgatattcctatcataacactaatgatattcttcacagagatagaaaaaaaatcctaaaattcatatgaaacaacaaaagatgccaaatcgctaaagcaatcttgagcacaaggaataaggctggagtcaacatactgccttacttcaaatatactacaaagctgtagtaaccaaaacagcatggtactggcataaaaacagacatgtagaccaatagaacagaatagagaacccagaaattaatctgcttatcaacagccaactgatttttacaaaggccaagaacactcactcatcagggaaagggcaatttcttcaataaatggtgctgagaaaactggatatgcagaagaattaaactagattcccatctctcatcctgtacaaaaatcatttcataatagatcaaagacctcaatgttaagacctgaaactataaaactactagaagaaaacataggggtaatacttcaggacactagtctaggaaaatatcttatgaataaaaactgcaaatcacagacaacataaaaaaatagacaaatctgctaacatcaaactcaaaagcttctgcatagcaagggaaacaatcaacagcatgaaaagacaatctacagaataaatgaaaatatctgcaaagtattcatctcatagggattcatatccagattacacaaggaactccagtatctcaaaagcaaaaaaccaatttgcttaaaaaacaggcaaattatctgaacagacatttctgaaaggacatacatatagccaacgaatacatgaagaaatgcttaacatcatcaatcatcagggaaatgcaaatagaaaccacagtgaggtatcatctcactccagttaggatgtctattttcagaaaaacaaaaaataataaatgctggtgaagatgcaaaaaaaaggaacttttatacaccattggtgggaatgtaaactagccaatattgaaaacagtacaaaggttccccaaaaaccactacaaatagaactaccatatggtccagcaatcacactactgagaatttatataaaggaacggaaatcattacatcagagagacatctgcagcccgtatttattgttgtactattcacaatagccatgatatggatcaacctagttgtccaacaacagatgaatggataaagaatatgtgtatatacacacaatggaatactgttcagccattaaaaaaagaaatgaaattctgtcattcacagcaacatagatggaactggaagaagttatattaaatgaaataagccaggaaaagaaagttaaacaccatgcgttttcactcatctatggaagccaagaaaagtaggtcttacagaagtcaaaagtagaagagaggatagggtaggaagggtaggaggaaaggagggatagtgagagattcaataatgaacacaaaattacagcaagataggaggagtaagtaacagtgttgtactatcatttttctgtaactataggatgactataattaacaataatattttccaatagctagaagaaggatactggatgttccccacataaataaatgataaatgtttgagatgattgatatgctaattattctgatttgatcactatacactatatgcatcaaaacatcactatatatcccatgaaagtgtataattattatgagtcaatttaaaaataaagtataaaaaggttaattactacctaaaatgactattttatgaaataaatgttttgagctatttaagccagacttagacaagaagaaaagattcttagaaaactgaaatgcaatatcagattagaagaagcaaatgacagcactggcagtaaagaaaatcacattggccatatgacagaatgctgagagagggggaaaaaacatgaaaaagatggtagacatggaaaaatgaaaacaaagatttaagaactgaatattctaatattggatattcattttttctaatcataagaaaaaatgaaagaatattcaaaaataaaagaatattattctttagtgaacaataccctctaaatttatactaaatcagtatgcagagtattagtgaattttatgattaactgttagacatagtctatgaataactaatgcaataaaagaagaaaaggaatagaagtatggagatagggaaggaataattaaaactgtctttgttgacagataacataactgtctaagtaaaaaaatctcaaagaactgacaaaaaaactaatggaattgagaagcaattatagcaaggttgcagaatacaagcaaatatagaaaagccaagtgtttagctatctactagcaatgaagacttagaaaaggaaataaaaaacacagtactattcgcactagaaccaaaaaaatgaaaaattaggtataaatctaacgaaacatgtgtaagatctttattaagaaaactacaaaaactgacaaaagtcttaaataaatagatactccaagaacgggaagactaaatatagttaagatgtccattcttcctattgtgatgtataaatttaactcaaaatctagcaattcacaaagattcccagaattttctggatatgtacaaagtgattctaaagttaatatgaaaaggcaaagtatgcagacagccaacacaatactgcagaagaacgaggtcagaagactgacagtacttaccttaaagactcactaaaaatctacagtaatcaaaacaatgtgatattggcaaaagacagacaaagcaagggaatagaaagagaacctaaaaacagaaccacataaacatagtcaactgatctttgacaaagaagcaaaggcaattcaatggataaaagatagtctttctccaattgggcattcatttgcaaaaaaaaaaaagaaaaaaaaacgaatctaaacacagaccttacatctttcacaaaaattaactcaaaatgaatcacagacctatatataaaatgcaaaactataaagcttgtagaagatacataggaaaaaatctacatgactttcggtttggtgatgaagcttcagatacaataccaaaatcataatacatgatagaaaaaactgacaaattagattattaagatcaaagacttcagttgggcacagtggctcatgtctgtaatcccagcactttggaaagctaaggcaggattgcttgagctcagggttcaggaccagcctgggaaacatggggagacctcgtctctacacaaaattaaaaaaaaaaaattagccaggtgtgatggtgcatgcttgcagtcccatgtactcaggaggctgaggtgggaggactgcttgagcacaagaggccaaggctacagtgagctgtgatcatgccactgcactccggcctgggtgaaagagcaagaccctattcttgtaagtaagtaagtaaaataaataaataaaaactactctaccaaagatacagttaatagtatgaaaagacatagcaacatcccatctcaaaaataaataaataaataaatgaaatcttctgctctgccaaagacaatgttattattaatagtatgaaaagaataatattcttttaatattatgaaataatattaatagtatgaaaagaaaagccacagactgtaagaaaatacttgcaaaacaaaactgaaaatcagaaatataaaggactcctaaaacctatcaataagaaaacaaataacccaaattaaaaatgggcataagacacctcaccaaacatatatagatgaaaaagaagtgtatgaaaagatgctcaacagcatatgtcattagagaattacaagtacaaacaatgagacaccaatatatacctattagaatggttaaaataaaaagtttcttaaatttaaaaatttaaaaatttgaaatttaaaaacatttcacatagccctcttgtgaaaactacccaaaataacagtgaattcaaatgcaaagaaaaaccataataaaaaactcaagaatgaagaaatagtgattatagaagctgagtatgaggactaaaacaaattaaacatagatttgaaactaaaaaattactgcaaatatgattatatataaatgtgacaatttgtgaaatattgaaagaaattacctagatctaaattctcaatttatattaaacaatacttcagatgtgataacagtaaaatcctaacgtactcatcttaataatgtaatttcaatatacattgcttaaatgttaaaaaaaattttgcttctcatccatttttttaaagtacattggtcaaaaattgaaatttattgtatataatacatgagaacagattttacacagactacttagcattgaaattaattgctttcaaaagttaacacccataatttgtctcctatattgcataaaggatatcaaagaaaagagtaaagggaaataagtaagaatatctttttgaggtaactaagcaaatatgataaagagcaaaaggagacaagaatgatataagatgtgagcatgcactgaaaaactgtgtaagttagggttaaacaaatagtaatgatgtaggaaaaataaaaagaatgcatgatatgatagttccctaacctataacaaagggaaaaaccctaccgtgcagtgttgatgtaaagaataaatgagagaacacaataaaaagacacatagtacatgctcaatacatgctattttctttttccactggaaatctctacttctttaaggacaaaagaccatgttggaacaaacatcaattgacaatttttcactaggaggacaaataagggggaaaaaggtctgctacactcaaatataccaccctaagtttataaagttttacatgtcttctgtgattaaaaaagaaaaaaacaaaaaagtaaaacattacaaaataatgaaaagtattttcagtattacataaaataagatttatatatgaatttatttattcttatataaaataagaatcatcacatgccaacaaacaccagaaatcaacagcttttaccatagtttttcctgatcctcggggtccgataataaggacagagttactctctccatggagagcagttcttttcagcagctcacttaagtgtctaaaatgatataaataggacaaaattttaaaaatgaagctggaatactttgttatgttgtagtttttaaaaggcatatttgaatatgcacagaaatttcctctcttctctccctctgggtacttggcctagcttctgaatggtcctaaatagaaaaatacaaaagaaatagtagggcagtattgattctctgaaatcttcaggtgaaaacgtagtcagattggaatatattgatttatacgatagtaggggacaagggacaatagtggcaactctcgggacccttggattcaaatctcttttcctactaatactctggacttttactccatagctggctgctgggtattaagggcaagatggctagaattctctccacagtatcagataacagaaacaaaacaaaattgaaagttaaagtgctattgcattatggaaatatttgtatctgctcctgcttcatgctatgtggtgtttctattcacaaagcaaaattttttatttctataaaagtgtttgttagctttatttaatatcaaatttgtacaataatttttgcaaaacctggaaggcatctgtaagtaggtccataacagtcaagaggacagctagacttacttgtattgtacttgcactccaaataggttactatgtggactctgacgacaaaatctttcacgtaaaattctttgtacctgatgaaaataaagtgaataaatataaataaaaatattacacatgatataaaaaataaataagaaagcacatttacaatagtcagaattaggtattaatgaatcaattcaaccctccctaaattcttatcctctagagttctggcaccattttcatatgttaaaaaattaatggatttcttacctatctcaagtcccataggaagaatgagaatttagttgtgaaggtttcaacaagagggagaatcactgactttagctatattagcaacttaagggccattgtaatgcatgtgaacgagttaagaaaagaattcttgtaagcagctatattttgaggtcatcttagaactaaggccttagacttagtcatgaaaaattatgtcagataatctaccatactctttaaaaagatggaccattaaagtcgttccttttttggatctgcagctaatacagaggtctttcaaggacaacaacctgagggtgctatctcagatttggccccatgaactggaataaaaaggctccaagaatatttgcttctcctagactgacagcatggaactaatccttcatgtaccaaagaagtaaatctgagttcttgttccatgtacagaggcaaagcaaagaaaatgattcattagggacaaaacaatacatacttgttcattatcgaggaagttaaagagtaaggacattggctccagaagagtctattatatgaattttaaaaggttaagtctgttctaaattttaatttctgtatctataaaatagggacaataacatcttatggcaggcctgtttgaaagattaaaaaagggggctggccgctgtggctcacgtctgtaatcccaacactttgggaggtcgagatgggcagatcgcttgaggttaggagttcaagaccagcctggccaacatggttgaaatcccttctctaataaaaattcaaaaattagccagacgtggtggtggatgcctgtaataccagctacttgggaggctgaggcaggagaattgcttgaacccaggaggcagaggttgcagtgagccaagactgcaccactgcactccagctggggcaacagagcaagacttggtctcaaaaaaaaaaaaaggtttaaaaaaggcaattatttgtaacacaaataggctttgtacaggtaatagctaatatctgtaaaaatacataaaagaacatatatatgcctcaactaatcataatgtgtattcctctacctagatgagatcaaaagaaaaaactcaatcttttccttaaaaaaaaaaaaaaaaaaacccagaaaacctcattaaaatatcttagaggcagtaacggggtataaaatataagctagataaagctacagtgactagtcagaaggttcacaaatctcaaagtgatctggcatagaagttaaataggtatacacatgtattgatattaagtcagctgtacatggaggattcgtgcactttacatacaaaggtatgtaaagcatatttcagttaaaaatttttttagaaagagagttaaactacttccttcaaaaagaaagccaagtcgtataaaagaataccagtaacacttaatttttatttaaaaactacatggagttcaggtcaagctagataaatacaaatgccagggtagaaataccatgctcatttccctactaatctataagcttcttaaggaagagacatacagatagatgctcagcacttggaatacaatatacacttcttataacattcattataaaaacactcaacagatgaggaaacgtaacggaacttcctcaacttaataaagggcatctacaaaaaaatcctacagttaacatcatatataacagtgacagactgaatgctgctgtttctctaagatgaaaacatagacaagaatgtccattcttcccaatcctattcaacattttaaagaaagttcaagccagggcaattaggcaagaaaagggaaaaaaaaaaaaaggcatctagattggaaagaaaaaagtaaaagctagaattctgactacccagacttaataaggataaaattaaattacagtataaaacactaatattaaaaaaaatatatgaactgacaaaaagggcagagaacaatcataacaacaaaatctgttggtccacatttaattttgacagagtttggaaaattttgcttccagatgattgttcttacgaccttgtgctggcatctcgttaaggtctcgtactgatatctccctaaggttagaaagagtgattcttcctaaatgctaaagggaaaattcaggttaagaagataactatttctctgaacagctttacagggtaaaatatcttgagattaatgaaaatacatactaacctgtgaaaggcactctgtgtgaattaagctgttactctttgatttacgactgctcatttcaacaaattcaaatcctttaaaaaaattggcataaatattataaacgtagtgacttaaagagattacttaagaatttactgttctagaattaaaataaatacaagtttttaaaagtaaaaaatgctcaaaccctaagaccttcaaaatcttcgatggcttcattttgtctaagtacaggctgattcaacactctcataccacactttaggcacactttgttttactgtgctttgcagatggtgcattttttttttaaagtaaactgaaggtttgtagcaactctgtgtccaacaagtcgataggcaccatttttcaaacaccatgtccccattttgtgtctgtcagcattttttagcaataaggtattttcaaattaaggtatgtacattttttagacatgctactactgcacacttagtagactagtatactgtaaatataaattttatatgcactgagaaaagttttgggtgattcactttattgtgatatttgcttcactgcaatggtctggaactgaacctacaatacctccaggcctgtatgtggttcttacagctactcctccctttcgattaaatcttctattcaccttccctttcttcctttttctttttttaacttacatgcttcctttatgattctcccacccatccatcccacaggatcatcccttatagaaaaccttccctttcttgctccactcaccaacaatacacaaataatcattacagactaggttaaatgcctcttccttaaacactcataagtgcctgtattttgctttattattgaattattttaaacaaaattgtctgtttaattgctactgtttccaaattgagattttttatattctaagcattgtagcataatgcccaaaacaaagttggcaatgaataactggaatgaaaaaaaaattaatgaaaaaattatattttttgtaaaattctcctcaagtgtaccatactcatagacaaatgactaaaagacctttgactaaaagacctaattttcttagcactgatttcctataggaataaattttaacagatagacagtaacagcttaagcagtgtttaggtatcaggaattgttacaaatgctttgcatttatcaactcatttaatcctcaaaactatcatgtggaataactactattataatcctcttttaaggttagaagacacagataggctaggtatgttgaccaaaatcaaacagtatataaatggaagagccaggatttggatccaaccaagttaaccacttttttaaaaaagtgtattctggtctcatctaatctccagaaggaacacagctttgctaacaccctgaatttagctcagtgaaagacattttggaacttttttactgccagaactcataaaactcaaaaaaagctgacttatcatcaaatcaccaatgattaacattataataatgcgagaatgacagcagcaagatgaaataggaggcccttcagcttgtgtccccaaatagcaacaataatttcacagccacccacggacaaaatggtctttgtgttagcgttgagattcaggcaggcgtctgtgaaaccccagtggggcccaagacctggaaaagtcaattggagggcagatcttcattcacgtgacagattccccaactgtggtccaggcttcagacttggaaagggccctgtcctcccgataggaccttgttaccaggggctgtagcaggatatgaaccctatctggtcccttggcggactggactttttctaggacctcggtctgtacagtggatgaagatatgcagagaaaagacctgttaccaggtgtgtggatggtttggctttctctgggaacctgggagggctcctactggatcactgagtagattccttaacaggcagtactgccctagtccacagctgagtggggctggaactaagctacagggttgcttcagggcctacagtcaagacttaggtcttcaggcctaaggtgtcacaaacctgcatgtctcccttcaggtccttaagttagcgggcctgctgtattgagaggggctggagccacttttcaggggtgtttcagggactgatgagggacctaggtcaggtggcctgtttgcagggctatggacagccccatctccctccaggatgctgggtaggcagaactgctctctgaccacagctgagaggggcttatgccaagattcagggttgtttcaggacctgctgtgggactgaaatctgcctgcctgtcctgaggacacagaaggatgtatctcctgactacaggaggatttctgtgcaggatttctgtaagactgtggctgagtggagctgaatccccgattcagagctttttcagcatatgctatgggacagagattggcaagtctgtactgatggcacagacaggtgagtctcctagcagttccttgtgcaggcagggttgctctcaggctgcaaccaacagtggcaggagctgagcttcagggctgtttcagtatttaatgcaggaccaagttcagaaagcttgacccagggattcagacagttttgtcttcttgtgggtccttgaactgatctcagaccatagccaagttaaagtgtcttatcagggtccgcagttgggactgaggacagtggacttattttctgaggtaccagtgtgcatgaattttcccaggcctcttggtgaacagtttcggtagcaggccaatatccttgatgaatataggtgcaaaaatcctcaacaaatactggcaaatctaattcaacagtacattagatcaattaccatgatcaagtgggatttatctttggaatgcaaagacggttcaacatatgtaaatctataaatgtgatataatgcattaacagaatgaaggacaaaaatcacatgactgactcaacagatacagaaaaagcttctaacagaattcaatattccttcaggtttaaaaactgtcaatatattaggtataaaaggaatatacttcaacacaataaaggccatatataacaaactcacagctaacatcacaccccaaaggtaaaaagttggaagctttccctctaagatcaagaacatgacaagaatgcccactttggccatttatattcaatatagtactgcaagtcctagccagaggaattaggtaagaaaaaataaataaaaggcatccaaatcaaaaaagagaaagttaaatggtctgtttgcagataacataattttatatagagaaaatccttaagactctaccaaaaaactgttagtactaatacatacagtaaagtggcaggatacaaaatcaacataaaaaaatcaataagatttctccacactaataactatttgataaaattaaaaaccagtcctaattacaatagcatcaaaaacaaattagaaagaaatgtaacaaaagaggtgaaaggtctgtcactgaaaactatacaatattgatgaaagaaagtgaagacacaaataaatggaaatatactccatgttcatggactgaaagaatcaatgttattaaaatgtccctactactggaagtgaaggttcaaagtaatccatatcaaaattctaatgacatttttcatagaaatagaaaaaaatcctaaaattcatatggacccacagagacatttaatagctaagacaatcatgagctaaagaacaatgctggaggtatcagactacctgatttcaatacctagtgcaaaactaagataattcaaaacaacatggttctggcataaaaacaaacatacagaccccagaatacagagtcgagaaataaatccatacttttacagttgacttatgttcaacaaaagtgccaagaacacacaacggagtaaggacagtctcttcaagaaatggtgttaggaaaactggatatccacaggcagaagaatgaaattgaacccttattgcacaccatatacaaagatcaactaaaaatggattaaagacaaacataagacctgaaacataggggaagaaaacacagggggaaagctttttgacactggactcggcaaagatttttttgggatatgactccaaaagcagaagcaagaataatgaaaacagacataaaactaaaaagcttcaatcaacagagtgaagagacaaccttcagaataagtgaaactatttgcaaatcttacatctgctaacaggttaaaatccaaaatatgtagtcgctcctcatcagcagattcaaccaacttaagagagagaaaatttagaggggaaaaaaaatgcaacaataaaaattaatataaattttaaaaacaatacattataatagctatttacaaagcacttacattgtattagaaattataagtaatctagtgatgatttaaagaatatgggatatgtgtaggttatacgctaataccatgccaatttatagaaaggacttgagcatctacagattttggtatctcaggggagtcctggaaccagtttcccgtggatacagagggatgactgtataaggaactaaaaaaaacaaaaacaaaaacaacaacaaaaaaaacttaatagcaaggaaacaacccaatttaaaaaatggtcaaaaagatttctcacaggacataaaaatgtcaaataggtatttgagaaaattctcagtgttactaattgtcagggattttcagggaagtacaaacaaaaccacaatgagataacatttcacacctgctaggaaggctattgtcaaaaaaaggcaaaagatgatgagtgttgttgaggattatgaagaaaggaaactcttgtacactgttggtaaaaatgtaaattagtataatcattatggaaaacagtatggaggttcttgaaaaaattagaagtcaaattacatgaccggtaatcccactcctgaatatccatcaatatatacaaaggaaatgaaatcaatatgtcaaagatatatcctcactcccatatacactccagcattattcacagccaaaatacggaatcaacctaagtgtccatcaatggatgaaaagataaagaagatgtggtatatatacacaatagaacactaactcagccttaaacaaaaaagaaatcctgtcatttgcagcaacatagatgcatttgggagatattctgttagctgaaataagccaggcacagaaagacaaacaccacataatctaatttatacagtagtctctccttatccatgggagatgaattccaaggcgcccctcgcatgtctgaaatcatggatagtacccaactctctctatatactatgttcttttaatctgataacctagatggctactgagtgattatgggacacatgcaatacacagcatggatacgctggacgaagaaattatgtatgtcccaggcaagacagagcaggacactgcaagatttcatcacattactcagagtggcatgcaatttaaaactcatgaattatttatttctggagttttccatttaatattttggaacttcagctgaccaaaagtaactgaaacaatggaaagtgaaactgaggataagggagggactacaataggtggaacctctaacaggggaactcatagaatgaaagcagattttaaattttcttactacaaaaaaatggtatgtgaggtaacagatatattaataggcttaattttgtcattccacaatgtatacctatattaaaacattatgctgtataccataaatggataagatttttattcatcaattagaaaaaaaacatataaaatatacatcaaaaagcaagtaagtgcagagccaggatttgaatgatttgaacccaaataagttgtactcttatgaaattgttacgtatttagcaaacttttttgaaaaaagaagtacaaacacatttcaataacctgaaggaagatcagccaatatattttacattcacatttattaatttcatatagtgacaattagaaagcaaaccatggtaatgctgttttcttctctagaaatgttaacaggtccttagctgagccaggccttgacagacagacagcaagcaaatctgtgtcctccttaatgtgtaagccaggtagctaaggcctcagccaccaaaagtcctctggctccaggcttcctaattgaaaattaaataacagagtactcaattattgtcttgacccttaagcatcttctttcttagaagaaaagtggtcttctcagctgtcttaggataccttctagcagtcttttatatctaaagttttatcttattctattttttatttttcctaatcagtgttatgagagggaaaaacctttttagctaataaaatatcctcaactctggtttatgatgctcttgactatcagccaaaatctaaaatcacaaagaactatgtaataattgtctcctagattataagactaattaaaatgtaaaaaggagaaagggcttttgcagtatgttttattttgtagaactacattagctatcttacagtattgttagaattaaaagatattttttacccacttcatgaattaagaaagaattactcaaaaaagctaaataaatgtccacagttccaaggcaggtatctaatctgcccctttgcatcatatataaatcaggtaagctattaagataattcattttttcttcatgtggggccagcattcataaaagaaacaacaaacatgccactatggtatctaccttataacctacataaattttgactgtaaataaagttttagtccaaaggttattttgacatcttcccccttcatgtaatggtcaaatatctactatataataaagaatatttcaaagacaattctaatagtacagatgagacaagcttcagactgggagaaaatacctgcaaaccacatatctgacaaaagatctgtatctaaagaaccctcaacactcaataataaaaaaggaatcccattagaaaataggcaaaatacataagtagacatttcaccaaagatatgcaggtggcaaataagcatatgcaaagatgtttaatatcattatccgctaggaaaatgcaaagtaaaaccatagtaagataccaccacacactgattaaggcagctaaaataacacaaagatggtgaggatgtaaagaaaatgaatctttcatttaaccactggtgggaatgtataatggcatggctactctgaaaagtttcttgacagcagtttcttagaaaactacaaatactcttaccaagccacatagcaattgcactcttgggtacttacctgacagaaaaacttatgttcacacaaaaacctgtaacacgtatgttcatgataaatttattcgtaatagtcaaaacactggaaccgattcactcaatgagccaatggggttaatgaattagttccactgatgctttgtcactgaagtcaggaagtacccagacagtaagggactgccttttgaagttcttctgatattggacaatgcccctggctacccagaatcccatgagttcaacaccgaaggcttttgtccaagtggtccactggtccccaaacacaaactctctaattcagcctgtagatcagggggtcatagggacctttaaggttcattacacacagaactctatggaaacgaatgtcaacactatggaaaaacctccacagacagaacatgatgaaagtctgggaggattatcccattgaagatgccctgttgtcatagaaaaagccatgaaagccaacaagactgaaacaaatttctgctgaagaaatctatgtccagatgttgtgcatgacttcacaggatttactacaaagccaatcaagaaaatcatgaaagagattgtagacacggcaaaaagggtggggagtgatgtgtttcaacatatgggtcttagagaaattcaagagctaacagataccacaccagaggaattaacagaagacaaggtggagatagatgcttctgaaccactgccagacagtgagaaagatgcagaacagtgccagaaaacaaactgacattagacaatctggcagaacggttctgaatatacaagactactcttgacttcttttacgacatggacccttctatgatacaggtactggaatcaaagcaaatggttgaggaagggttgatactgtatagaaacattttaaaagaaattagaaaccaaaagagatagacagaaattacctgtttagttacacccagtgtgcctaacctgtcttgtctccccttctacctcctccacctcttctacccctaggcaacaagatcaacccctcctcttcctcctcagcctactcaacaggaagacaagtaggatgcagacctttacaatgagccacttcaacttaatgaatagtaaatatattttctatatatagtagatatattttctaaatatcttttctttaccttactttattataataatacaatatataatacatacataaaatatatattaattgactatgttaccagcaaggcttccagtcaagtaggctattaacagttaagtttttggggaggcaaaagttatatgcagattttcaactgcttttggtagggagggggtgtttcgacccctaacccttacattgttcaagagtcaactgcgtatggaggaaattctcattactgcagttccagagcactactatacatcagagagctactgaccattttaaatttacttctgtattgacaaaggacaaaaattataggaattgtaaaaatgtgtcatctaaagctgtctgctctctaaattgcctatgtgcatttccccatgacagtaagtcccctacaatctatacctttacaaaggaagggatgaattctgaaatatattcactgaccactacttactgtatctgtatttgaaattttatagttacatgctaactaaagcaggatgactaaataatctcaagactcaatcacatgtatattcatactcccatttttcaactgaggtggcttatttattgtaattctccattcctatgctttccaagggttgcttgttgataaattctaaaaattatgaagtacatcctttactgctcttgaggtttcatgagtacttataactcttctttctcatgatgccttcctcagatccaaaccctcactcagagcctctttgtctaccacactgattctgcataatgtattttagactaactctgtttggccaacaataatgataactattcagtaaactctctgttttttttgtttttttgtttttttgagacagagtctcgctctgttgcccaggctggagtgcagtggcgctatctcggctcactgcaagctccacctcccgggttcacaccattctcctccctcagcctcctgagtagctgggactacaggcgcctgccaccatgcccggctaattttttgtatttttagtagagacggggtttcaccatgttagccaggatagtctcgatttcctgacctcgtgatccgcctgcctcggcctcccaaggtgctgggattacaggcgtgagccaccgtgcccagccttagtaaactctcttaacatctaaagacagaattagaaaatagctgacactaacaacttattcctacatatagctcaatagccattcagatgtcaaatgttttcctaccttagaaatagaacataaaagccctccatttagtttgcacaactaacttaagctcctcatcttaggttagttctaatcactgttttttagactaacataatcctaaactttgtgggagaagcaacctggatgaactcctggtgacagtccttcatgtcaaatttgaagtttggtcaatttaccaaatacctctctgcttgctgactagcaatggtatacaatgacctgcccaagatgacatagcttacttaacagcagcagtagctgttaggtctattgactcccaatcagaggttggttagtctcaactggcatgaaaaaaaaccctgcaaacatcagaaagttcatcaaaatcatcactgggcttttctttaggagacaaaacatagcagaggaatacattctgaaagaacacggttattataacagatgttcaataccaacaattcacttctctttgaatgtctatgtgtacaatttgtatttttttctgtacacatctttatttttaagatcataaactttcttcccatcgctaaaaaggaatacatgtttcgtacagaaactctggaattttaattaggaattgtgcagataaaatggtaaaaaatggaatcagagaatctttctcctctaataaaacaaaacaaaaaactgttaaacagaaatactttagcagtaactaaacaaagagacaagttaataataaacaagcctagaaaattctacaggagttctccatagttcctaactttaacctcactcttaaaagctatacttgcatcaataaaatctcctaaactctcatcaatgtatcaaatatgaaaagaagaaaactgataaaaactgtaattcaattattaaatttcaagcctaaaaaaaagaattcactgggactcagcctgaaaaacacctacaagggagaaaaaaatgctaaaatatggtgtcataatatctacaaagttctgagagagagaccaagactcatacctagcaaagatgtcactcacatataaaggtaacaggtatagccttatcaaataagaatgaacttatttagtacacagagccaataaagccttgtgtggagtgtgtgtgttgcaggaggatatggggaactcaatgacaaaatccagccaactaaagcataattaaaaacacaattttatacagacacacacacacatacacacacacacacacacacacactagtgacctttgaatccactaaaataaaaaactaaaaccaaaaaaaggtaaataattatagtagcaggtggaaacataagtcgttacacagtgaaaataatcattcaacaaaaaaatgaaaaaaaagtggcatgaatgcatacggttgctaatttcattcttcagagtagaaagaaaatgtctaaacttaaaacatgaagtgtaaaaaaggaacttaaaactattttttttttagacccagggtctcactgtattgcacaagctggatttgaattcctgggctcaagagatccttccgtctcagcctcctaagtagctgggtcaacaccttgagcagcttgaaactttttttaacctaagattgagatctttaaaaaaaaaaaaatctcttgggtttaataaatatctaaagtccagcaattcctataatttttattaggttaaaaatgtggcctgcctacacacacacatactttttcaaccaaaatgggctctatttcataatatttgtcatttaaaagaacaagaactttccatatatagatatatatatgtgtgtgtgtgtgtgtatatatatacacacacacacacacacacaaaaagtaacatattttaaattattttttctacagctaccataaggtaaaaaacaaaaataagaattagtggatcaaattgtttaagaaaaagaaccatgtacctcagctggataatcaaaagtactctagtattatgagcatcttactagtaattacgacgccaggagctgtaacactgtgtacccaaaaaaaagcatttaaggagaaaacaggtgtgaacatgtccgatttatttagtttcaaagttgtccaagcacaggtcaaagaggtaacaacaaacaatttttcctatctttcatataaatggtcagtaaggtggctggtgcaaaataaccctctggaataagaaagtattgtaggctgggcacagtggctcccacctgtaatcccagcactttgggaggccgaggcgggcagatcatgaggtgaggagatcgagaccatcctggctaacatgatgaaaccccatctctactaaaaatacaaaaaattagccaggtgtggtggccggcgcctatagtcccagctacttgggaggcttaggcaggagaatggtgtgaacccgggaggcggagcttgcagtgagccaagatagagccactgcactccagcctgggcaacagagcgagactctgtctcaaaaaaaaaaaaaaaagaaagtattgtaatatgtttacctataaatatctatccaaaaaataagagctaaattaaacttaactaatatttaatatatacattgacaaattttacttggtctctgtatcagcaggtcaagtcatgttactcaacccagacgccctaaggaaagggaagagttcaagatcaataacaagaaggggttccgagtggcaccatcacatattcatttactgtcagctcattaatacacaatgtaggtatatgaatccagtttggagacattactgaatccagctgacttactgaatttttttttttttttgagacagaatctcgctctgtcgccctggtgggagtgcaaggttgcaatcttggctcactgcaacctccgcctcctgggttcaagctattctcctgcctcaggagataggagctgggattacaggcatgtgccaccatgcctggctaatttttgcatttttagtagagatgggggtttcaccatgttggccaggctggtctcgaactcctgacctcaagtgatccacccaccttggcctcagttgggattacaggcctgaatcaccacgcccagcctcacttgctgaatttaaagatgttattatttttaaaatgtaagtgaaataatctcagctgttccaactgcagctttttcctggaatgaaaaatggctgcctgtcaacagcatgctgcttagtaaataaaaaacaaaaagcaaaaaaaaaaaaaagatttacttcatctggaattttaaaataaaagtaggaaagaaactgctttttagaagaaatttgtgttatagggcattttgaaaatgtttccaacactgattttatagccaaaaattaggtgttacctataaaaattctcatatctatacacttaaaacatttataaacataactttttattctattcacaaatatttctgtaaataatgtaagttttatatgtgttgacctaaaaggaaagaagttgaggcaaaattaataacatacatagagagttcatttgagccaagcttgagggttgcaaccaaggagcataaattcaagttgccctgaatatgctcattagcagcagtaacaagtagatttttaaagagaaaaagaaaaataaaaaggcacgctctgagttgttcaccaagaatctacattaaaataacaaactatccattggctacagagtggcagggggtagggagttggggtggagtatgggggcataactgaagtcccatactactcacatctctctgggcctgcatacctcagagctcagactgttctgagcattttttgttttctcatacccatttgttaaaaatataaaaacataccacttttcggctgggcgcagtggctcacacctgttataccagcactttgggagactgaggtgggcagatcacttgaggtcaggagtttgagacgagcctggccaacatggtgaaactccatctctactaaaaatacaaaaattagccaggtgtggtggcacgtgcctgtaatcccagctactcaggagacttgaggcaggagaactgcttgaacccaggaggcggaggttgcagtgagccaagatcgccaacactgcactcccaccagggcaatagggcgagactcatctcaaaaacaacaacaataggaacaacaacaacaagaaacaaaaaccatgcaccactttccaagaacactaatttatatcaagtttttcttagtttggaataagaactaacacatcaagagaagatgaaattggctaacaactcctacaaaaaccttggtaaaattagtggatgagactagaaaatataattcaaaaatacacaaatgatcatgtattattttctctaatacccttactttgaggcaaaaccttacagctccagcagatgggggcattactttgtgaaaagaactcttagtaaattaaaaagatgtttaatactgctttctttccagatggtggcagaagaaaacaccgaaaacaataccactaccccactccctttattagaaaaaagttaaaatacaaattctattactgtttacctaggacctaacttcacacggctgacatttctcaaagataggtaagtatggacaaaatttcagaactttgcctctcttcagttcgataaaatgttcttgatttgctagctaaacagtcaaataacgtaaaatgaaaggtattttaggagaaatttgaaggtggtttccatgttttgttactgtcctttgagatgaaactgaggcaagaaaaatacatttaagctgtttttcagtccatcagaattagttttcattcttttttctcccccagttggattgtttgtacagaggtaaagattaaaatagagttaaaagaatggttgagtgtggggagaaataagggccaatactgatatatattccaagttagaaaataagtaaactctgttagttcttcctaaagagatcagctcaaaaatgctatctatatcaagttggggcacagcctctggtgagatgtttccttgagttctccagagctgaagaataattccacacaaatcaacttttggaccacaggtgaataaaccatggtaattactgacagttttgtaaaatctttttttcctcctcatttgttgccagtgaatattaaaaggacacaatttacttaaggacacattcagattaaatgattccaaggtttgataacctttagttaagtaatatgatgccatgatattttctcattgatattaaaatgaagaaaaatattttataatgtcttggtacttaaactgattaaataattgaaaaggcttgcaattctccagaaaagccatgttctctctaacctctgaatttcagtaatcttcactagtacatggcagtatgtctggaatcatatatacacagacacacacaaccacacatacatatatatacacacatatgaatataaacgtatatacatatatatcttttttttttttttttgagctggactttcactctgtcgcctggctggagtgcagtggcaccatctcagctcactgcaacctccacctccagggttcaagcgattctcctgcctcagcctcctgagtagctgggattacaggcatgcgccaccacgctcggctaatttttgtatttttagtagagatggggtttcaccatattggccaggctggtctcgaactcctgacctggtgatccgcccacctcagcctcccaaagtgctgctgggattacaggcgtgagccactgcaccccatacatatatatcttttaataagtgtacttactttataaagtacctattagagccttgatattcatgaataagccaataaagttgttttcaagaacatgggaggtaaatagttatgaaataaacaacccccagaaggataatcagagagttaatactatgatatgttcagtaaagaaagacatttagaaattactacagttggccgggcatggtggctcacacctgtaatcccagcactttgggaggctgaggcgggtggatcacctgagttcaggagtttgagaccagactagacaacatggtgaaaccccgtctctactaaaaatacaaaattagccaggtgtcgtggtgcgtacctgtaatcccagatactcgggaagctgagacaggagaatcgcttgaaccggggaggcggaggctgcagtaagcggagattgcaccactgcactccaaccagggcaagacagagcaagactccgtctcacaaaatgaaaaaaagacattactacagttgttttgattattaaccatggaatacaccttgtaaatgatacaaagtatcaattctgcagtagtgttgatgaatgaataaaaaagaaatactagttggaggacttctttaaagtatacgtcttaaaatgcatttacttctgaattatataggctaacaaaagaactaacacaaatttgcaacgtatttagaaatcctttagaagctttggaaatgcattatatgatcttactggcactgacataactacatcttaaatattatagtgatcaacagtagtctatgttctctgagcacatggaagtaggctaccttcaggatttaagcttgtgaatccaagctaatgtgtttaattggatggataaatagtataagggcgacagacacttgaatcaacgaaaacttttttttgtttttggtttaagagatggggcttccctctgtcaactagggcagtggcacgataatagctcactgaagtcatgaactcctggcctcaagcaatcctcctgactcagcctcctaaatagctgggattacaagtgtgaggtactgcccctgacaaaaatatcatttttgtgaaggatggttgcattatatgggacacaagatttaagactagggcactaaaattggtgggtgagaaggcacatgtagacaaattttccttgaaaagccccaaactacacataaattacagaactgtactttcttgcaatatcaattacttcagggtatatgttcatttgagaagaataatgaatagaatactgtccactattcaaataaatttttcctttgccacgtttacagacttgagtttacttaaatgtaagtatgatactgctagggctaaggaaatgatactccaaaataaagtcctccaaagcagctctctctgaccatctcctaacttcctgtctctggcctctcattctcctgaggctagccactgaaactaccatccctcgtccccaaggtagtccacagaaaccagaactccctttccccaaagccagccacagaacctaaatatattactctaatgttccctgccctcatctttctgtgtaaaaactaactataaagacatatctgacctattctgtttgattgtaggtcataggatccccattccagaaagggtgctgttccatacccggaaggaaagaatgctgcacagagaggccaagaagaatctatacagacaggcaggccttgctgggtttccccactcagtatatggctgtccagactttgctgaacctaagcataccaatgggcagttttctcctatatctttaggtctttattctgaaggctcccatgtcacgtaacaccaagatcaaataaaatcatatgccctttctcctattaatctgccttttttcagctgattttcaaagaaccttcagaggctgaaagggaagttttttcttggcccctacaatatgctacaactccagtaagttaattagtaaatattaaactatttttggaaggaaaaaaaactgaaaataacattgctttagagataaattatttaagaattgctagaaattaccctagaaattatcctagaaaaatcttaaaattttccctaaaaacttttaggaataatacattgtttctaatgagacccttcagcttatgcaaaaagcacaggagactaaattctagagtcaacgaaacgatattctccaattctgttttgctaatgaatatgttgtccatccccccatcagcatgcttaggtaatcttgcaaggataaatggaaatgtcagttgacatttacaatgaaataggatttttagacagttgtgctttttgggtgggaaaaggagagctaaaaattagggggttgggggcttaaaaaagacagcattatatggcttagaactttggtaccctaccttcatccttttctgcaatcccttttactccccaaagttaaaaggctatcaatgggacaataattgatgatcaactatgaagaaataggctcaaatacactgttttattatatttttatcattctttatataccttttctcatcattctttgtcccaatagtatgctatgattatgcacgtagaaaatcccaaaataacaacaaaatcactggaactaataaactactgtagaaaggttgcaggatacaaggttaatatacaaattgtcaacttccttcctatgtatcagtaatgaacaactgaaattagaaattaaaataataccatatacattagcaacaacaacaaaaaacattcaccaaaaatgtagatataaatctaacaaaatatgtacaagatctctatgaggatcactataaaactctgattcaagaaatcaaagaaagtctaaataaatgagatcattcaagagtagaaaaaaattcgtattgttaaatgtcagttcttccaaccttgatctataaattcaatgcaatcccaatcaaaattctggatagttattttgtggatatgacaaactgattttaaagtatacacagaaagacccaggagaaccaacacgataccgaaggagaacaaagttggaggacaaaacctacccaacttcaagacattataaaactatactaatcaatacagtgtgataatggtgaaagaacagacaaatcaagggaacaaaacagagcccagaaataggcccacataaacatagtcagctggtcttttacgaataagcaaaggcaattcaatggagaaaagaacaatctttgcaacaaatggtaatggaaaaactagacatacacatgccaaaacatgaattgacacagaccttacaagtttcacacacaaaaaatctaaaaatggatcacagacctaaatataaaatgcaaaactataaaactccaaaaatggccgagcacagtggctcacgcctctaatcccagcactctgggacaccaaggcaggtggatcacctgaggtcaggagttcgaaaccagcccgaccaacatggtgaaaccctgtctctactaaaaatacaaaaattagctgggcattgtggcaggctcctgtaatcccagctacttggtgacaggtgaagccagctggacttcctgggtcgagtggggacttggacaacttttctgtctagctagaggactgtaaatgcaccaatcagcactcaataaaaaaacgcaccactcagcgctctgtggattaaaggattgtaaatgcaccaatcagcactctataaaaacgcaccaatcagcgctctgtgtctaaaggactgtaaatgcaccaatcagcactctgtaaaaatgcaccactcagcattctgtgtctagctaaaggattgtaaatgcaccaatcagcactctataaaaacgcaccaatcagcactctgtgtctaaagtattgtaaatgcaccaatcagcactctggtctagctaaaggattgtaaatgcaccaatcagcactgtgtaaaaacgcaccactcagcgctctgtaaaatggaccaatcagcaggatgtgtgtggggccaaataagggaataaaagttggcatggaccaatcagcaggatgtgcgtggggccaaataagggaataaaagctggccacccgagtcagcagtggcaacctgctggggtccccttccacgctgtggaagctttgttctttcgctcttcacaatagatcttgctgctgctcactctttgggtccgcactgcctttatgagctgtaacactcaccaggagggtctgcggcttcattcctcaagtgagcaagacacaaacccactgggaggaacaaacaactccagacgcgccacctttaagagctgtaacactcactgcgaaggtccgctgcttcactcccgaagttagcgagaccacgaacccaatggaaggaagaaactccggacacatctgaacatctgaacaaacaaactccagacacaccatctttaagagctttaacattcactgcgagggtctgcggcttcattcttgaagtcagcgagacgaagaacccaatggaaggaataaattccagacacatcgggaagctgaagcaggagaatcgcttgaacccaggaggcagaggttgcagtgagccgagatcacgccattgcactccagcctgggcgacagagcaagactccatctcaaaaaaaaaaaaaacaaaaaacaggccaggtgcggtggcttacgcctgtaatcccagtgctttgggaggcagaggctggtggaccatgaggtcaagagatccgagaccatcctggccaatgtggtgaaaccccgtctctactaaaaattcaaaaattagctgggcatggtggtgtgtgcctgtagttccagctacttgggaggctgaggcaggagaaccacttgaacccgggaggtggaagttgtagtgagccaagattgtgccactgcactcaagcctggtgacagagtgagactccatctcaaaaaacaaacaaacaaacaaacaaaattccaaaaatgtaacacaaaagaaaatctaggtgaccttggttatggccatgtgtttttagatacaacaccgaaagtacaatccatgaaagaaaataaaaaattgatttagacttcattaaaattaaaaacttctgctctaccaaatggcactactaagaaaattaaaacacaaaatacacatggggataaaatatgtgaaaaacacttattttgttacacaaaatatacaaagaactcaacaaggaaataacccagtttaaaattggcatccaaataaacatctcaccaaataagatacagaggtggcaaataagcatatgaaaagatgctcaacatcatatgtcaatagggaattacataatcaaacaatgagataccattgcacacctattacaatggctaaatccaaaacaatgacaataccaaatactagtgagaaggtagagcaatgggaactctcattcatggctcatggaaaagcaaaatggcacagacactttggaaaacagtttggcagcttcttataaaactaaacatatttgttttacataatctagcaatcatgtaccctggttacacccaaatgagttgaagacaggtccacacaaagacctgtaccttcctgtttacagcagttttatttataattgccaaaacttggaagtaagcaagagtgtccttcaatatgtgaatggataaaccaactgtggtacatccatacaatggaatcttactcagcatgtaaaagaaataaagccatgaaaagacatgaaggaaacttagatgtatactgctaagtgaaagaagccaatctgaagagactacctactgtatgtttccaactatatgatattctggaataggcaaaactacagaaatagatgttttagtgatcttttcactaaaagatcagtggttgtcaagaaaagagaagtatggaacatgagatttttagggcaattaaattattctgaatgatactgtaataatggatcattatatatttatcaaaatccatagaatgtacaaaacaaagaatgaatttattcatatgtttgtcgtttttaaagaaataagacatttcaagaacatttatataccaaagtaagaaaattttttatatcttatctttctttgtcaacaccaatcatcacactattcaagagcataattcctaatggttgagaagagactcttgcaatataaagcaaacaaacatattgttattttgtaagtatttaatataatgaaaacatgttatctatgattatttcttctcaaagtacatgacaaagctctatgatctcatgctgccattaaatgtataaaaacatagcttaaaaagactaatattacacatattagcatcttggaattatttctgggtgcaaaggttataggtaattttcattttttaatcacttttatactgaatgtatattatgtttgtaactttaaaaattttcttgcacatttaaatcaaatcttgtactttacaatttgaatatataaatttctaagtgtaaattatgatgctaaaattctattttaacttttaaacatgttacaaacataaaatgtgttttaacataaaattttaaaaacatgatgctcaccagatattgcagcagtgttggtataacatgctggacataattaaaaaaacaccaaagtctaatggatattagctgaaacccagctttttagggaaaatagttttggtatttactcattataaagtaagttgactgagacataaacaaaccatacaagtggtcatattaagagtgcatttaagactgacatgtctgggttatctgtattagatatttttgtaaacaatacaaaaaagaaacaaaggagaaagtgaaaatgtgcaagtgaaaagccaacagatcagaacttaattcttgaaaaagtctgacctcactttggtcatgctataatttggatttggtttctttatcaccaccaaagctaatgtggaaatttgaaccccagcgtggcaatattgaaaggtgaggcctagagggaggtgtctgggttctacgggtagatgcctcataaatggctcagtgctattctggagttagtgtgttctggctctcatgagactggattagttctctggcgaatggcttagttccttcccacaagagtgggttgttataaggccactatgcactcctcagattttcctctctttgaatgtttctttttctcctttgaccttgtccaccgtgttgtgaagtatgaaagatcttgccagaagccaggtctatgctcttgaacttctcagtctgcagaactgtgagctataaaacctcatatctttataaattacccagtcttaggtattcttttatagcaatacaaaacagactaaggcaggtcaaaatttcacactattctcaattcccctattaatcaaaaaagtagtataggactaagaatttgttatgttttattggaggtgaggagagatatgggagaatataagataaaggttaaaaagagattaggaaaaggtagcaaccccaaagcatgtttaagatcagtgctttgagcaagatcaggaatgaaaagagagaataaaacagaaatgaaaggatgggaacagctgtcaattccaggtttcatctaccttttggtttataatcttcaactcatgtcttatttttctacttatgcatttagtaaaatatacaaagccatccagtctcgtcagctaatactctaaataatataaacatacaacaagttcactaaataactggtcttttaatttgggctagaattcaatgagaaaaccatttctaaaagacttgcagtgctaacatggctcaaattaaacagaagcctctaacccacttcatcagaggccatgaggcttattttctacacagggtaagacagaagaaatctaccctgaggacacaagacacagcagaaggtgagggtatcagacaaaaaggttttgagggggaggagaggattaagagagtgtttatatattgaacgttgaggccccctagctctcttctttcacatagttctcatactactggcaatcagacttataccctaaagcagggtttctcaggataacattttaaacttgattgttcttcgttgttggagctgtcctatgcactgtaggatgtaacaagacccccagattctatgcatcagttttcaggagcaacctatctgtggcaatcaaataagtctctagacactgctaaatttctcttagggggccaaattgtcccacttgagaatcactgacctaaaggcagaagcttggagaactcttcttattagactcttattaaccctagaaaaaaggtttccaaacttaaagataatgacaccaggggtttccacccacaaaatgcccagccatattcacagagctctaaaatagctttctaatgaatctaacataaatttgaacatgcaatcaatgattgctacatagctgaggaaagcctcgattaaaaagatgaaaacatattaacagaaagaataatttggaaaaagtagagaaagcaggaagcaataaatttcaaaaccaaacaataattttaattcataaaaagaaaacataacaggatataataagaaaattatacagagatcaaaaaaggccttggaaattaaaagtatgatagcagaaatcaaagtctcaaaagtttgaaaaaggtaaattttccagaaagtatgaagaaaaaaaaaacataaaaaatgacagaaaaaaaataggtccaggaggtagaatgtttaattagagttccagaaccaaaaacaaaggcaagaaaattaaagaaaaaacatgaggaattttcccagagttgatggacacaaattgtcagactgaaaggacccataaaatgcatggcaaaatgaaagactatagactcataataagtaacatggctgtgacatttcagaactctagatacaacaaagagaaacatttgataagtttcaaaatgagatcgtataatcttccacagaggagacaaaagtgatctgaagagtgatggaagtaagaagggcttctaattttacaacagatgctatgaattccttcaaagctcttaagaacaatttcacctttataatttgaaagccagctaaactaatagttggggtaaaataaagacacttatataaatataataccacagaacacttgcctttcagaaagctactagaaaatggaataaaccaagagaatacacaagccaaaggattacataggatataggaaacagaggaactagcataggatagagactgcaccagcagcaactatatcaagcaatgggctaaaactgcagcacataagaatgctctgggagaaatttcttgatgatggataaactgataaaaatacttgatacctctgaatatatggaaaggctgttttgacaaccagcagatagtttgggtctaaatgactaataaatatttagaactatacaaatgctcaatggtcgtatatgaaaaattaaactatcaatgggaagatggggggaatggatgggatgtttgtggaaaaaggctaaatctacatcacctatagtaagtcaagagataatgcctaaaactgaaaaaacaggaggtagcaatataaaatgttatttagagatacagaagtatataccaaaagaataagccaaaaaaagttttagaagtatttccctctatttggggaaaactggggtagtgacagctaccttgtccaacatcacagccttcctgggattaagcaaataaggcgataaaggcccaatcatttcgttgcaccatggtatcaatctgaaggaaaatattctggagaacctaacctgtgacaaagaagtaagaactgtttttaatcataagctatggagaagcagttaaaaacttaagcatgtgttcttttacctttgcaacagttaaaagaaaaagagaaagagaagaaacaggctgcttaaatatattttctaatttcattaacttggcttcttatactgcagagccgaatgttattttagaaatttaaagcccatcagactaacaacggatctctctgcaggagccctataagccagaagagagtaggggccaatagtcaacattcttaaagaaaagaattttcaacacagaatttcatatccagccaaactaagcttcataagtgaaggataaataaaatcctttatagacaagcaaatgctgacagattttgtcaccaccaggcctgccttacaagagctcctgaaggaagcactaaatatgtaaaggaaaaactggtaacagccactggaaaaacataccaaattgtaaagaccattgacactatgaagaaactacatcaactaacgggcaaaataaccagctagcatcataatgatagtaccaaattcacacataacaatattaaccttaaatgtaaatgggctaactggcccaattaaaagacacagactggcaaattggataaagagtcaagacccatcggtgtgctatattcaagagacccacctcacttgcaaagacacacaaaggttcaaaataaagggatggaggaatatttaccaagcaaatggaaagcaaaaaagagcaggggttgcaatcctagtctctgataaaacagactttaaaccaacaaagataaaaaaagacaaagaaggacattacataatgacaaagttatcaatgcaaaaagaagtgctaactatcctaaatatatatgcacccaataagggagcacccagattcataaagcaagttcttagagacctacaaagagacttagacccccccacaacaatagcagtgggagactttaacaccccactgtcaatattagacagatcaacaagacagaaaattaacaaggacactcaggacttgaactcagctatggaccaagtggacctaatagacatctacagaactctccaccccaaatcaacagaatatacattcttctcagcaccacatcgcacttattctaaaattgaccacataattggaagtaaaacactcctcaacaaaggcaaaagaatgaagtcataacaaacagtctcccagaccatagtgcaatcaaattagaactcaggattaagaaactcactcaaaactgcacaactatgtggaaactgaacaacctgctcctgaatgaatactgggtaaataacaaaattaaggcagaaataaatacattctttaaaaccaatgagaacaaagacacaatgtaccagaatctctgagacacagctaaagcagtgtgtagagggaaatttatagcactaaatgcccacagaagaaagcagaaaagatctaaaaccaacacccttacatcacaattaaaaaaactagagaagcaagagcaaacaaattcaaaagccagcagaagacaagaaataactaagaccagagcagaactgaaggagatagagacacaaaaaccccctcaaaaaaataaatgaatccaggagctgcttttttgaaaactttaacaaaataggtagaccgctagccagactaataaagaaaagagagaagaatcaaatagacacaataaaaaatgataaaggggatatcaccactgatcccacagaaatacaaactaccatcagagaatactataaacacttctacacaaataaactagaaaatctagaagaaatggatgaattcctggacacagacaccatcccaagactaaaccaggaagaagtcgaatccctaaatagaccaatagcaagttctgaaattgaggcagtaattaatagcctaccaaccaaaaaaaagcccaggaccagatggattcacagacaaattctaccagaggtacaaagcggagctggtaccattccttctgaaactattccaaataaaagaaaaagagggactcctctctaactcattttatgagtccagcatcatcctgataccaaaatctggcagagacacaacaaaaaaagaaaattccaggccaatatccctgatgaacatcaatgcaaaaatcctcaataaaatgctggcaaactgaatccagcagcacatcaaaaagtttatccaccatgatcaagttggcttcatccctgggatgcaaggctggttcaacatatgcaaatcaataaatgtaatccatcacataaacagaaccaatgagaaaaaccacgattatctcaatagatgtagaaaacgccttcgacaaaattcaacaccccttcatgctaaaaactctcaataaactaagaatcgatagaacgtatctcaaaataataagagctatttatgacaaacccacggccaatatcacactgaatgggcaaaaacaggaagcattccctttgaaaaccggcacaagaaaaggatgccctctctcaccactcctattcaacatagtattggaagttctggccagggcaatcaggcaagagaaagaaataaaaggtatttgaataggaagagaggaagtcaaattgtctgtttgcagatgacatgattgtatatttagaaaaccctgttgtctcagcccaaaatctccttgagctgataagcaatttcagcaaagtgtcaggatacaaaatcaatgtgcaaaaataacaagcattcctatataccaataatagacaaacagagagccaagtcatgagtgaactcccattcgcaattcctacaaagagaataaaatacataggaatacaacttataagggatgtgaaggaccgcttcaaggagaactacaaaccactgctcaaggaaataagagaggacacaaacaaatggaaaaacattccatgcgcatggataggaaggatcaatatcatgaaaatggccacaccgcccaaagtaatttatagattcaatgctaaacccatcaagctaccactgactttcttcacagaattagaaaaaaaactactttaaatttcatatggaaccaaaaaagagcccgcataagccaagacaatgctaagcaaagagaacaaagctggaggcatcacgctacctgacttcaaactatactataaggctacagtaaccaaagcagcatagtactggtaccaaaacagatatacagaccaatggaacagaacagagtcctcagaaataacaccatacatcaacaacaaccatctgatctttgaaaaacctgatgacaacaagcaattgggaaaggattccctccctatttaataaatggtgttgggaaaactggctagccatatggagaaaactgaaactggcccccccttccttacaccttatacaaaaatggattaaagactaaaacataagacctaaaaccataaaaactctataagaaaacctaggcaatatcattcaggacataggcatgggcaaaaatttcatgactaaaacaccaaaagcaatggcaacaaaaggatacgaacagacacttctcaagagaagacatttatgtggccaacaaacatgtgaaaaaaagcttatcattactggtcatgacagaaaaggaaatcaaaaccacaatgagataccatctcatgccagctggaatggtgatcattaaaaagtcaggaaacaacagatactggagaggatgtggaaaaacaggaacgcttttacactgttggtgggaacataaattagttaaaccattgtggaagacaatgtggcgattcctcaaggatctagaaccagaaataccatttgacccagcaatcccattactgggtatatacccaaaggattataaatcattctactataaagacacatgcatacgtatgtttattgcagcactgttcacaatagcaaagacttggaaccaatccaaatgtccttcaatgatagaccagataaagaaaatgtggcacatatacgccatggaatactatgaagccataaaaaaggatgagttcatgtcctttgcagggacacggatgaagctggaaaccattattctcagcaaactaatacaggaacagaaaaccaaacaacgcatgttcccataagtgggagctgaacaatgagaacacatggacacagggagggcaacatcacacactggggcctgctgggggatgggggggctaagggagggatagcattaggaaaaatacctaatgtagatgacaggttaatgacacgtgtatacctatgtaacaaacctacatgttctgcacatgtatcccagaacttaaattataataaaaaagaaaaatttaaaatagacattgtttttccttgcagaggaggcagaacaagattgctgaagagaatcccccaggaatcatcccgtagcaggaacaccaaactgaacaactatccatgcaaaaaaaaaaaaaaaaaaaaaaaacaaccttcataagaatcagctggcacagtggtacatgcccataatctcagcactttggaaggtcaaggcgagtggatcatttgatctcagttcaagaccagtctgggcaacctgatgaaaccctgtctttacaaaatatgaaaaaattagctgggcatggtggcatgtgcctgtagtgccagctactcgggaggctgaggtgggaggatcacttcagcccaggaggtcaattgaggctggaatgagttgagatcacgccatgcactccagcctgggtgacagagtgagaccctgcctcaaaacaaacaaataaacacactaacaaacaaacaaaaaatccaaaatcaggtgagtaatcacggcacctggttttaacataatatcaaggaaagaagcatcgaagagggtaggaaagacagtcttgcgctgactacaccaaccctcctccaaccccaggcagcacagcactgagatagaatctgtgtgcttgggagagagagcgaaagtaagtatgggactttgcgctggaactcagtgctgctctgtaacagcagaacacaacacagggcattctgctggtgcccacagaaggagcatttagcttagtcctgggccagagagaaatcctccccccaaggagagtaattggttttcatcacattctgactaaagtagtctagggcccggaataaattggagtgacaggccacaaggactgcatcctttggcaagccttggtactgcactggccttggaggtaatggacttaagataaaacccagtgcaataccacccgtggcagctaagggaatccctgaggcacccctccccaactacttcagcttggggtaaggaaaaggaagagtagacagaactttgttttgcaaccggagtattggttcagtcacagtaaaataaagcaaaagacagatttctgaagcttttgatagcaagcttttgctccgggatggcatttatagattgaccctaggcaggaagggaatggctgccatgatgggatggactcagtcttggcagaattcaccacctgctaactaaagtggcctttggccttgaataaccagtggcagtcacgcaggactggccgtggaccttgggtgagccccaatactgtgctggtctgcaatgcttcagaggcaactcagcatagttccaactgtggtggctacaggaatgcctgtatcaccccccaccaacactgggcaggccagtacagagaaagactcctgattgaaggaaagggaaggtagagagcaagagactctgcctggtaacccagggaattctcccaattatcttcccaagtccatcaggactgtgtatgtaggagtctgcaagactcacagcgttcctgtgctttggatgctccttaatgccaaaatggctgcagtgactacaggcttaggtcacaacactcaatctgctttgatttcctggaaagccccctggagagtgacaggaatgaacaaacccaaactgtgaagactagctcttcgatgcctagacatcaatgaatatccacaattatcaagaacatctaggaaaacaggacctcaccaaacagactaatcctggagcaataaagatacgtgaccttttagatgggaaattcaaaatagcggtcttgagaaagctcaatttaattcaagataaaagagataaaaaattcagaattatatcagagaaacttaacaaagagactaaaatgatgaacaagcagaaattctgaagctcgaaaattcaacaagctgaaaatgcatcagtctcaacagcagaagaataaattagtgagcttgaagacaggtttatgaaaatacagtcagaagagaaaaaataataaaacaataatgaagtatgcctacaaaatctggaaaatagcccccaaaagtcataatctaagagttactggccttaaagagggcttacagaaagagattgaggtagaaagtgttttcaaagaaataatagcagagtacttttcaaactgagagaaagatatgaatatacaggtacaagaaggtcaaagaacaccaaatagattcaacccaaataagattaccttaaggcatataataattaaagtctcaaaagtaaaggacaaagaaaggatcctaaaagcggcaaaagaaaagaagtaacttcatatgaaggagttatactacatctggcagcaaacttcagcagaaacgctacaggccagaagagagtaggatgacaaactttagcagaaaccctggcaggccagaagagagtagaatagtattaggttggtgcacaagtaaccacggtttttgtaattacttttaatggcaaaaaccacgttaacttttgcaccaatctaatacatccaccgaaattatccttgaaacagggagacatgaagactctcctagactaataaaagctgagggatttcatcaacaccagactcatctttcagaaaatgctaaagggaagttcttcaatctgaaagaaaaggacattaacaagcaacaagaaatcatctgaaggtataaaactcactggtgaaagtaagtgcacagataaatacagaatactctaaccgctcatatctttagcaggaagattaaaagacaaacctatattgttagaagagttctaaactctaccttatctagagaaccttcttcttttagaaaatcaagcaaaacaactaagccaagacatgttaagaaaagtttgaaaagaaagctgtaaggaaatacaaggggagggattgttagatatgagttctaaatttcttttcaaagaattagtgtgtcagtatgttcaattctttgccttctagttttaaacttaacttcctcgtaaagcaacctttttcgattacctactccaccctgactcattctgatcatctgctccacccaacattccaatcacctgctccaccctaactcattccaattacctgctacctgctctgccctgactcccgccaaagcattcaccctgtcattctctttaaattagccaattggaattagtttagcccgtgcggtctaaccccagccaataggggaacgacagagcagcaggggccacatacgtcagggattagaaccccttcccatcccttgtccaaatgtgcgctcaccattgttccatctgtaagggtgcacccttctatatagaagtagcttgccttgctgaatattaaaaagaaaattttgtattcgagtgctatttcttttgcagcatcgaaactttctatataacactatcaaaaaaaaactactccaaaacttaaaatataaaaatatatagagacaaaaagtcaaaaagtgaagggatggagtagaagtgtacaggtttttagttttttctgtgcgtgtattttttcttttctttgcaatcagagttgtcatcagttgcaaataattggctataaattgttatttgctaacctcatagtaaccacaaaacaaaaacctctaataggtgcacaaaaaaataaaaagcaagaaattaaaacatactaccaaaaaataattatcacaaaggaaaacaaggaaaaaaatgggggaaaagccctagaaaataaccagaacaacaataaaaaggcagtagtaagtccttacctatcaataataatactgaatgtgaatggactaaattcttcactataaaaacatagactaacaacaaaaagacggaaaaagatactgcaccaaacagaaacccaaaaagagcccaagtagctttgtatctatttttagataaaatagatttcaacataaaaactatgaagaaagaaaaaaaggttatcatataatacaaaaggttttaattcagcaagaggacataaaaattataaatacatatctatccaacacagaagcatctagatatatagagtcaagtgtattagagttaaggagacagaacccaatacagtaatgacttgggacttcaacagcccactttcaccattggacagatcatctagacagaaagaaacaatgaatttaatctgcactatagattaaatggacctaatagacatttacagaagctgtcatccaacagccgcagaatacattcttctccttagcacatggaacatttctcaaggatggatcctaaattctccaatcaaaagacacagaagagctgaagggctaaacaaaacaaggccctactacctgctacatataagaaacccacttcatttataaaaacatagatagaccaaaagatggaaagagacattgcatgcaaacagaaatccaaaaagagcaccatcatgttaggccgcaaaacaagtctgataaaaagtatattttctaaccacaatggaataaaagtagaaataaataacaagtggaactttggaaactatacaaacatataagaattaaacaatacgtgcctgaacaaccaatgaagtaattaaggaaattaaaaaatgtcttgaaacaaatgaaaatggaaacacaacctactaaaacttatgagatacagttaaagctaacactaaagggaatgtttatagcaataaatgtgcaaatcaaaaagtagaaaaccaagaaataaacaacctagtaatgcatcttaaagaactagaaaagcaagagcatgccaagccccaaattaagaagagaaataataaagaaaacaagaaaataaataataaaaaacagaaataaaattgagacaaaaaaatagaaaagatcaatgaaatgaaaagggttgtttggaaagacagacaaaatcaatgaacctttacccagactaagaaaagaaaaaaaagaagatccaaataaaatcagagacaaaaaaggagacattacaattgatatcacaaaaattcaaaggatcattggagaccatttgaacaactgcatgccaataaattgtaaaacctagaagaaacgaataaattcctaggcacatacagcctaagaagaatgaaacattaagaaaaccaaaatcgaaatagacccataataagtttcaagatagaaacaataataaaaagtcccccatcacagaaaaggccaggacttcatggcttcactgagttctaccaaacatttaaagaagaactaacatcaatcctactcaaatcattctccaaaatcaaggaggatctccaaattcattttatgaggccagatttattctttttttttttttttttttttttgagacagagtctcactctgttgcccaggtgatctgcaacctccacctactgggttcaagcgattctcctgcctcagcctccagattagctgggattacaggcataagccaccatgcccagctaatttttgtattttttgtagagatggggtttcaccatgtcggccaggctggtctcaaactcctggcttcaagagatctgcctgcctcagcctcccaaagttctgggattactggcgtgagctaccatgcctggccccagatttattctgataccaaaaccagacaacgatacaacaacaacaaaaaagaaactacaggccagtatctctgatgaaaatagatataaaaatcttcaacaaaacacagcaaaccaaattcaacagcacattaaaaagatcatcataatcaagtgggattcatcccagggatgtaaggatggttcaacatatgtaaatcaatcagtgtgatacatggtatcaacagaatgaaggacacaaagtgtattgtcatttcaatagatgccaaaaaaatcttttttgataaaattcaatatcccttcataaaaactctcagcaaactggggacagaaggatcatccctcaacatgataaagccatacacaacaaacccacagttagtatcagactgaatgggggaaaaactgaaagcctttattctaggatctagaagaaggatgggcactttcaccactattactcaagttagtaacagaagtcctagccagagtaaacagacaagagaatgaaataaagggcatttaaattggaaaggagtaagtaaaattatcattgtttgcagctcatgtgatcttatactaacctaaagactccaacaaacgactattagaactaataaattcagtaacattgcagaatacaaaatcaacacacaaaaatccatagaatttctctatgccaacagtgacaacctatctgaaaaagaaatcaagaaggtgatcccatttacaatagctacaaataatattaaatatctagaaataaacttaaccaactacaatgcaaactatcaaacattgatgaaattaattgaagaggacacaaacaaatgaaaagacatcccatgctcatgggttgaaaaaaattgtattgttaaaatgacaatacttcccacagcaatctacagattcaaagccatccctatcaagagcaatgacattcttcacagaaatagaaaaaaaaaatcctaaaattgtatggaagcacaaaagaccccaaatagccaaaacaatcctgaccaaaaagaacagagctggtaactggtagacttaccacactaccaaacctcaaaatatactacaacgctatagtaaccaaaatagcacgatagtggcataaaaacagacatgtagaacaacagaacagagagtccagaaattaatctgtgtatttaaagccaattagttttttactaaggtgccaaaaacactcattgggaaaggacagtctcttcaataaatggtgttgggaaaactggatgcccacattcagaacaacaaaagtagaccccaactcttgccatatacaaaaatcaaagaaaaatgcattaaagacttacatctatgaaactaatcaaggaaaccattaggcaaaaactccaggacattggtctaggcaaagacttcttaaataagacctcaaaaacacaagcaactaaagcaagaaaataaaataaaataacaacaaatgagatctctccaagccaaaaagcttctgcacagcaatgaaaacaataaaatgaagatataacatgtagaatgggagaaaatatttcaaactaatatctgacaaaggattaataaccagaatatataagaatctcaaacgactcaataggaaaaaaaaatctgattttaaaatgggcaaaagatctgaggagacatttctcaaaaagacatacaaatggcaaacaggcatatgaaaaaaatgttccacattattaataatcagagaaatacaaatcaaaactataatgaggtatcaactcactccagttaaaatggcttttatcgaaaaggcagtcaatatcagatgctggtgagaatgtggagaaaggggaacccttgtacactgttggtggaaatgtaaactggcacagtcacaacagagaacagtatggagcttcctaaaaacacaacaaatagaactataatccagcaatcccactactgtgtatatacccaagagaaaggaaatcagtatataaaaggtatctgtactcccatgttaactgcagcactatacacaatagccaggatatggaatcaacctaactgtcaatcaatggatggataaagaaatgtggtacatatacacaatggaatgttattcagccataaaaaaaaaatgaaatcctgtcattttcaacaatatggatgtgactgacattataagggaaataagccaggcatagaaagacaagtatcacatgttctcacccatatgtggaagcttcaaaaaaattgaagtcatagagatagtgagtaaaaagatgttagcagaggctgggaagggtagtgttgagaggagaatcaagaggagatggttaatgggtagaaaaatatagttagatagaaggaataaaatatagtgttcagtagcacaatatagtaattacagctaacaataatttagtgtatgttttagaacaattaaatgagtggaaatgaaatgtccctaacacaaagaaatgacaaatacttgaggtaatggatatcccaattacctgatttgatcattacacattgtatgcttatatcaaatatcacatactccccattttatgtatccatagtaattaaaaattaaaatttttaaatatatgagttaagttaaaaaaattttggctcaaagcataaatatattaaaatcaaatctcagaagtaaaaaagaaagacaattagggttttatttatggtagtggcagacaggaccaacctttctgctgacgccaacaaaaaaactaaataatgaatgaaataaagtaatgtgaaattacttaccaaattccatgtgaaggtaaaccagaaacaaaccatacaccaagtaacttttgttctgaggacattttcctgtctagaagaaaaggctgagaaaaaaggctgagctaatggaagatgtgccggtctatggtaaaaaaatcaaagcacaaggccaggtgtggtggctcatgcctgtaatcctatcctttgacaggccaaggcaggaggatagcttgagcccaggaattcaggatgattgtgtgcaatacagcgagacctcatttaaaataaaaataaacacaaaaaatcaaaatcaaaaataaaaataaaagcacattgcctaacaaagctggggactcagataaactacccaatttatgttcagagtttaaggacaacatcattaggataagaggaaattgaaggaaaatagaattcatgatcttaaagtcttccttaatgtcatgtgtataacagaaggaatcccaactcttgaacatgaatagtgacttgggactgaaagcactcctagagacctttcctagaaaaatgtaccttcttaaaaaagatactattattctaggactcatatattcctataattttttaaatacaactggtactcaaggcacacaagaaaaaaatatcataagctagcagacacagacttagaaaatttagaaactggaattatcttcaacaaacaacaaatgaactatgaatatagtcggcccttcatagccacagattcactcaaccaaggattaaaaatacatgtatatttttaaaaacacgactataaaaaataatagaaatttttaaaaagccatgacagtataacaatatttacatagcatctacattgtattaggtaccataagcaatctagagattatttaaaatacgtgggaggatgtgtgtaggccgtatgcaaacatgatggcatgttatataaggaatttgagctgcctgtggattgtggtatctgcacggggttctgaaaccaatttccagcagatactaaggagcaactatactaggccaataaaagcaagattgtaattttcagcaggtaaccagaaacagtaagaatatcaccaatatctttaaaaagatactgatgcattgatctaataatctcgatgaatacagggcaagataaagaatgccacacgatgattgaacatttcctctacccccacaaccacacttgactaggagaaaaaaaaaaaagaagaaaagaattccacacaaaaagattagagtgaaacagcagaaaaattacaaccaaaaaaagaaacaaacaaaaaaaaattctaaaagagagatttccttcaaagcagcatgaattattaggttggtacaaaattaattgtggtttttgcattgttggaatttgccatttgatattggaatttttttttttttttttttttttttgagatggagtctctctctgttgcccaggctgggctgcagtggcgcgatctcggctcactgcaagctctgcctccagggttcacaccattctcctgcctcagccttctgagtagctgggactacaggcacccgccaccacgcctggctaattttttgtatttttagtagagacagggtctcaccatgttagccaggatggtatcgatctcctgacctcgtgatccgcccacctcagcctcccaaagtgctgggattacaggtgtgagccaccacacccggcctggaatacattcttaaataaatgtggttatgttatatgtcattttaatgggcatttcttgctttttttttttggctaatgacttattacttgctgtttatatttattttggactatggaaatgatgctagacaaaaagcaaagttgagtgattttcttatttaagttcaaagtgggtcgtaaaacagcagagacaacttgcaatatcaacaatgcatttggcccaggaactgctaatgaacgtacagtgcagtggtggttcaagaagttttgcaaaagataccagagccttgaggatgaggagtgtagtggcaggccactggaagttgacaacaaccaattgagagcaatcattgaagcagattgatcctcttacaattacatgagaagttgctgaagaactcaacgtaagaactcaacgtcaaccattccacagttgttcagtatttgaagcaaattgaaaaggtgaaaaagctcgataagtgggtgcctcaccagctgagcaaaaatttaaaaaaacaccgttttgaagtgttgtcttctcttattctccacaacaacgaaccatttctcaatcggactgtgaggtgcaacaaaaactagattttatatgacaagcaatgaccagctcagtggctggaccgcgaagaagctccaaagcacttcccaaagccaaacttgcaccaaaaaaggccatggtaactgtttgctggtctgctgccggtctgatccactacagctttctgaatcctggagaaaccattacatctgagaagtatgctcagcaaatcaatgagatgcacttaaaactgtgatgcctgcagccagcatgggtcaacagaaagggcccaattctccacagtaacacccaaccgcacactgcacaaccaacacttcaaaagttgaacgaactgggctacaaagttttgcctcatctgccatattcacctgacctctcaactgactaccactccttcaagcatctctacaacttttttcagggaaaatgcttccacaaccagcaggatgcaggaaaaagctttccaagagtttgtggaatcctgaagcatggatttttacattacaggaaaaaacaaacttatttcttgtcggcaaaaatgtgttgattgtaatgacctattttaattaataaagatatgttagagcctcgttataatgatttaaaattcgctgtcccaaaccacaatttcttttgtaccaacctaatgcattgacagctgatttctcaaaatcaataatgaaaaccaaaaacagtgaaatgttatcttcaaggtacaagtaaaacaaccacaaatctgtaatatcccccaaaacattcttcaagattgaaggcaaaacaaaaaattaagacaaagcaaaaaaattaagagaactgaccatcagaatgtctgcattatgaaacttctactgagtgtgctaaagtaaaagttaaaagattccaaaagaaaagtcagagacgcaggaagaaattaagacatggtaaacacataggaacatctagctcaaagtactgtccagcagcaatacagtaaaagtgacataagtaatttaaaattttctattgttcacactaaaagaaaacaaggtgaaatcaattataatttcaacatgtaatcataatgaaaagctgaggtattttacattgttttcatactgtctttgaaatatggtgtttatacaacattacaatgcagatgctaaattaaaactgccatataaaatacttgatctatatttttatataatttgcagctaatgccgggtgcagtggctcacgtctgtgatcccatcactttggaagcccaaggtgggtggatcacttgaggtcaggagtttgagaccagcctagccaaaatggtgaaactttgcctctactagaaataaaaacattagccaggtgtggtggcacatgcttgtaatcccagctactagggaggctgaggcaggagaatcacttgaacttgggaggcggaggttgcagtgagccaagatcatgccactggactccagcctgggcaacagagcgagactccatctccaggggggaaaaaatctccaaaaattaaaaaataataatttaataatttgcggttaagaaaggtttatgtatccgagttgttccaaacatacaggttttacagtaactgaatcaagtgtcagtttttaaacttaattgaacactaaataaaactaaaaattcagttcctcagtcatactagccacatttcaagtgctcaaaagccacacgcagctagtagctactgcaatgaatagcacaagcatagaacttgttatctggagtttaaactacgtatacaattcaaagaacaatgacagcctataagacctacatgaagataaaagttgccatcccagaagagagtaatgctccaagcacagagaagatattggccatactgctagaaatccctgagtaaaacagacaacccaattaaaacaaaaaacaaacaaacaaaaaaacctcccaaaaagatttaaaaagacaatgcacaaaagatttaagaattaaaaagacaattctagaaagaggaaattcaaatagccggtaagtttttgaaaaagtgctcaaactctttagtgtcctgggcagaataaattaaaacaacaataagataaagccacattcatcaagttgggaaaaaggaaaaataactcttggtgagacagtaaaagtaaagggatctaccatatactgctgtcggggtatacattggtgtatctactttggaaaaggcataactagtgaagttgaagataaacatacgtactctacaaaaacccatggtaatgtacattaagaatacatgtacaagaacattcataatagcattgttcataactactaaaaacggaacacaatccaaatgtttattaatattagactaaactgtggctcatttccattaagactttttatactatacttattatactatagattactacaatccaatataagaactagagctaaatgtactaatagagttatatcccagctgcatgagagaaaaagatacataatgatatgtaatatataatccacttacatacaattaagaaacaggcaaaacgaacctaaattgcttaggaatgctgacataggtggttaagaaatactaagaaagaaagcagtaaatgattgccataaaaatcagtatagtgttaaccactgaaaagaattgaggaaagggatgatcaggaatagaatggagaggggagcttctcaggtgccacagacgttctagttcttgactgtggcagcgcttacatagagttcacactttatagtttttcattatactatgtatcgatgtttgtatgcttaaatactaaatgtatggaaaaagacacaaaatatttaaaattgtagctaaggcacattaactgccttgctggtatttttttttttcattacaaagtggcagacaattggttacactataaagacagacaattggttacactacaaagaaaattttaaagcacaggagtctagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgggcgcggtggctcacgcctgtaatcccagcactttgggaggccgaggcgggaggatcatttgaggtcaagagatcgagaccagcctgaccaacatggtgaaaccccgtccctactgaaaacacaaaaaaattagccaggcgtggtggcacatgcctgtagtttcagctactcgggagggtgaggcaggagaactgcttgaacccaggagacagaggttgcagtgagccgagatcgcgccactgcactcgtctgggagacagagcgagactccgtctcaaaacaaaaaacaaacaaaaagaacccacccaacagaattaagtaccaacataataaatacgaagaattttagattcttggtttttaaaaaacatacaaagatgatattccttcaaaatatctttacaaaacatattgagactgtgatgctttatattgattgtatgaaaacaatgaaaaagaaccagcactgtttcactataaaagctttactaatgtaaatttataaatcctttcttaaatattttgagttaattctaattttatgatagaaattcattattttcagcaaaaacagctggcatttgggaaaccaaaggctcaaaaactaagaatagtaaccaaagaaacttgacaaaacagtccttttaaaactctcatctacactataaggggaaactttgatcacgtcccttctccttcatcaatcgtagaactcaacattaaggactacacaatcccacatccctctccgagaaaaagcaaaggctttgtgttgtagcaacaacgcaagacatggagggaagctccactcaagacttccctgcctgctccttccccaaagccactccagaataccagggagggttgagaggtaaggcatgaagggcgcaatatccaatatgagcaacgcgtgtgatgcatctggtcaaaatgcatacagaggacttgtctctgtccctagatagaagtcctccgtcctgcagtcatgagggtcaattgctgaggcttcacagttcccttctctcttacactcggaccgtcacgctcctcacctactaccccgatgcagaggtagactcaggatccctgcacttgtcaaggattcctcggcaagctcacggggcgggagtggccacaagacggagctcgcctggtcctggccttcccggcctatacaagcctgcccccttcccaattcccaatctccacagccttccatcctcccactttcgattcaccttgcgccaccgacgcccctggccttcgtttgcagcaagtttacccccaccattacctctcgcataaaagcctgcatttaccaggtcaaagaggggaaccaacgcctgcaggaatcgcttcaccgaatcgcctggccgcgtcctctgctagacttcacctgccgctgcggaccgtacacaaccact

SEQ ID NO: 2660 - DNA, 90364 bp, Homo sapiens
  source 1..90364: mol_type = genomic DNA
actttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatgatttgcatatgcagtttttctttagctatgtttttttttttttttatactttaagttttagggtacatgtgcacattgtgcaggttagttacataggtatacatgtgccatgctggtgcgctgcacccactaactcgtcatctagcattaggtatatctcctaatgctatccctcccccatccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtgtttccagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggataaaatactggcaaaacgaatccagcagcacatcaaaaagcttatccaccatgatcaagtgggcttcatccctgggatgcaaggctggttcaatatacgcaaatcaatgaatgtaatccagcatataaacagagccaaagacaaaaaacacatgattatctcaatagatgcagaaaaagcctttgacaaaattcaacaacccttcatgctaaaaactctcaataaattagggattgatggggtgtatttcaaaataataagagctatctatgacaaacccacagccaatatcatactgaatgggcaaaaactggaagcattccctttgaaaactggcacaagacagggatgccctctctcaccactcgtattcaacatagtgttggaagttctggccagggcaattaggcaggagaaggaaataaagggtattcaattaggaaaagaggaagtcaaattgtccgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagctactgctcaaggaaataaaagaggatacaaacaaatggaagaacattccatgctcttgggtaggaagaatcaatattgtgaaaatggccatactgcccaaggtaatttacagattcaatgccatccccatcaagctaccaatgactttcttcacagaattggaaaaaactacttaagttcatatggaaccaaaaaagagcccacatcgccaaggcaatcctaagctatgtgttcttaaagaggggagtggtagctttgtaacttacagtgaggcttacaccttgacaactgcaagaatgaggatagtggtgagtgaagggagatttgttaattatggcatttccctctattatcgtctaaacagattatattcccactaaagtatgtgtgttggtcctgccagtattagaaaccagaggcttgttggcattgtgtcacacagtacacaccaatggattctcagattttctagggtaaaggtgaaggatggggcagcacttaggttatggtggtttgaaagaaactgaattgctttctaaaccagatgaggatcagagtgcgaaccatggtgaaatatgcatggaaactacagaaagactgaagtgtttcttacggtgttttctgcaaaacgtgattcattaggacattaacaggtattacgttttcaacatatacagcattatgatacagtaagtttggaccaaacaggtattcattccccagagcctttcacatgcacgagaatcagtcattttaacaagaattccgtttctgctgggccacttggatcccttggattcagatgtaaaaacacactgaaatattcctcctttcacctgcttttcagtttgaggtaatcagattgaaaagcaggagttcatgcattttttggttctatttttcctcctctagtaaatgaagaaaataagctatatgtataagtttacattattcttgaaccgctttttaaactagggtttttcatatttgtttttattgatgacaattaaagcaatttaagagacgaagttagctcaaaactcttgcgaatagattttagcatttttgtatgagggaatatggaaaggccaacaagcagcactgttcctccccacaaaaatgccttgggaatataataggcgtacacttcatttgtgtaacttttcctaatgtatttttttttaatttgctttataacggtttcatgtttacctcaattggtacttagtcttaaaatctttctttatacttggttattgatggatcttctgcagctcttatgtagccaatgagacagatgagggctgtcagcttttaagtgacatcttaagctaataagaaattggaatcctcaagtcatttcatgaggctgttaccctttaagacaaataatactttcctcaaatagttcagaaaatttttaaaaggatcacttagagcataagtgtaaaattcttgcttctagtatataatagtgatgttaccatgtcaagtattttggtgaaatatcccctaaaaatgtgtagactacggcacagattgagtatgcaagccttagcttgaatgagactgctgagaagtaaatgacagggatctgaatacttagcaggcttaactttttgcagggaaggaaaggctatgtatgcaaaagaataggttgtaactactgaagagctactttatgctcagaaaccttttattccactttgtatccaagatttcattaaaacattgttccttagagcatactttaaaaactatttggtaaggaatccactgttgaacttcaggtcttaatagcactggctttggtgctaaactgagttgaattccaagcctgttggccattcccagcattgccactgctgtgttagttttctcatctgtaaataactgcctacatctcacagggcctctaatagttaaatagattgtaagctgcacaagcatagggacagtctgtcttttgtaaacctcccatgcacacaataggaaatcaaatattcttgaacaaatgaagtcactaagtgctcattaaatttcattttaaatatatgcctctgttaattcatggatcttggaacttacttaaaagacaatgctttgacggacatttccacattcctcatagggatttactttttaatacaaacaggttcagttaacattgccatacacatctcattacttttgggagtgcttttccagaaatctctggtagtcacgtcacttcatgatggggctacgttctgagaaatgtgtctttgggtgatttcatcactgtatgaacatcacagagtatacttacacagaccctgatgatatgtatatagcctgttacacacttaggctatacagatagcctagcctattactcttcagctatagcactgtacagaatgttactgtaatcatactgtaggcaactgtaacacaatggtaaaacatttgtatatttagacatagaaaaggtacagtaaaaatatggtataatcttatgagaccaccctttatacaatgtcattgaccaaaatgttacgtggtgccatgactatacttgttaagaaggaaaattccagtccttttgacctatggtaggctcaacaatctgtaattttagaaaatcctacaagggattctgatgtggatggtatgagtaccacattttgagatgtctagaagaaaaatcttcaaactccttggcctttttcttccatggaaccatcttctgactaagctggttagtcttctgaactagaaaacctgggtctgggatagaatccaaaatttgcatgtggacagaaaaaaacactgcagcaaacctgctgtaccaaaggttacttattatacttcagtgcttaccattgttttttttactcctttggtttaaggtttgtaaagacatctagctgttaggttgaagtgagctcttcaaatagaccattatatatataagtgttaaaaaagcacatggtctagtccctaaaacagtcatattttattcttctgaacagctacttacaaagtaatctcaatcagtgaaattataaatcatgtaactgttcatgattaaaaggcaagacacagccaagacagtagatgggcaagtctcacataaatacaagaatgtttatagaatgtttagcatatcatgttaatggacaatagttttccgttctctacagaagtatgaatgaaatgccaaagttgaagtcactggttatattcataaccagcttagtgaggatgttgcccactgcctcacatctgtaggacagttgggatatttctgcagagcattcataatttgagtattatccaaaagcagtttcatcagctggtactctctctgtgaatttcctgaagttctttccatgggctttattaattctaattgctgcaagtgttcaaaagcctgaaagatgaaagaaatagtttaggttgaataggagaggagagtgacaactctcctgttctctcccagagaacagttagcattttggtcagctgcagaacagagtactgggaagcaaaatgtaacaacaatcaataggattaaaaaaactctcacaaccccatgaaaactcatattatcaggtaaaacagtgtcagtgcacacttacttgtccatatattgttgaatgtaaacacggcaaactttaattcaatatatacaatatggttttcttcctagcctcattctctatcatagctcctcctagtactttaataaatagtttccagttctctgtaaaaacctaagaatcagataagactttctgatcaattccctaggctactcagatttgcatttatattttgtctgtctctatttttgctttgctatgtaaaaaggtaacacagctgtaacagagggaggcagaaaaagacccttgagtcaactagacatattcagctgatcctgtaagtaaaggattcagcaggctagtatggacatggaggagaagggacaggctcctgtttcctctaagaagtctgactgagactgtcacaaccttcttccatcttccccatcttaatagggctctttcttgtctacttcctcttatccttaatattcacctattatatcttttctaaccttgagtgttgtgttaggtacgttattaggttatgaaaaaaaaaaccattaaatcatgatatactaaccattaaataatgatacactgaaatagattcctgaggattctattatattcttacaactcactgtaaaaaacatcactggaacatattctctatgtatcacataaattcttctgatagagaaacagctcagataccttcatatctgaacatgagaaaatactggaggctgcaggtgttaagagctgaatagaactgtgcagatttaaaacatttctaaatagcaaaatacttcataattgaaaattcagaaatgagcagctacaaattattgagaatttaaatgcaggctgggcgcagtggctcacgcctgtaatcccagcactttgggaggccgaggtgggcggatcatgaggtcaggagtttgagaccagcctgaccaacatggtgaaacactgtctctactaagaatacaaaaattagatgggcatagtggtgcacgcctgtaatcccagctattcaggaggctgaggcaggagaatcgcttaacttgggaggcagaggttgcagtgagccaagattgcgcccgccactgtactccagcgtaggcgacaggagactccatctcaaaaaaaaaaaaaaaaaaaaaatttaaatacttgggtaacctttccattttcacagctctcacaaaataagactattaggggaaaaaaaccctccagtattgtaaaatacttttcctgtttctttgaagaaatggcaatgctctgtactcatttttgttgctacaagaaatgaaattctggttactagggcctataagggatgccaatggacttggggaatccactgttttaaaagtttctttccttaaaatcttcaagagctgcactgtccacgctaggctactgagcacttcaatgtgtgactcaatttttttttaaacttaaaaatggatatttagttctattagaaaattctgagcatgtttagaacaatttcaaaatgtaaatttactttctcagctatacattttatggaatctaaacagcaagaatttccagtaaacatttaggccattgagatgtgcttaaatataatgtacaccaaatgttaaagacttaattcaaaagaatgtaaaataccttactgttcttctataatgattatagaatgacacatttttgatatgttgcattaaatatataattaaaattaaacctttttatttttcttacaggtactagaaaatttaaaactacattacatggctcacattatctttgtagtggacaatggtaatctacatgaagtcctgaagttgtaaaactcatgactcagcccccaaataacactttctctgtatgccctcacaggccaataagattttgtcttttaagtttcttaatggctctaattttcattgttttctccttttactgctgagattataaaagccaatccttgggttggaaagggaaaggttatatcacacactatactgaatagttgttttcgggatgcaagtgctctgaagagacagcagagggcagtatacctccacaaactaaaacaaccggtcacttcctcagatttttccaaaatatttcatttttagataattttcttgttttgaaaaaaatctctataatacttaatgtttaaaaatgaaagtgcaattttaatacataatcaaattggatgtaaaaaatatacttgtctgtagaaaaatgacagcaaactaaatcttaccttcatgacaacaggtttttcaaaattataaacggaatgtgctttcctttgaacaaacttctgaaactctgagtagaaagcaatgacaacattataccttcaaataagcagtggggaagagtcagaaaaaagctacttaagtctcatctcaccattatagaccatttgaaaattaaatggctcttcctcatagatgtcatttaaatgtttcattgctattataagacagatttccaagactgatagacctacagtaaaagggaaaaaaaactatcagtttaatgacatataagactgaaataactgttctccaaagaatacaatatagtgaaagatctatggttctgaggggtgaagaaggtcaagattcttctagatttcaatgtgtttcaattatctatataaatttaagttacttaacctccctgagcttagtttttttcctatctgcaaaataaggatatttttaaacttttagaaatgtcacaaagattggcgaaatattatcaggcactcaccatatggcccacagtaaacaaaataaacttcaattgttatgtgactttaaatcacacagggcctttgcgtaggatttatctagagacttcctaaactcctggaaattatatccaaatctgtgtattccttttttccccggagaggaaaaggttcattacatttggaaaaggaaataacaaacccaaaatgactgaaacccagagaatgctcttcagtagttcttgatacaatgataacatcagcaacacagtcttacctggatttccaatgtggcaaaagaggcagagcgtcaaatttttttttcactttaaatgggagtgatagtacctttaaaaggactaagttaaaggctatatggatacgaaagtattttataaagcattatgcccacgttaattgtaattttaaaaacattccattatctaaattcaaagttttaaaaaccacaatttaaaaaataaggctgggttctcaccatgtacaatatttgctttcgagtccatgctacacagttggcttgcttccattagatctacggcagtcataaatgggtgcgatgctgttactcgatttaaagcaagcatctagggaaagacagatcagaaaaacaattacgtatttacatgggcattttggagatactgtgcaaaacttctgaatttgtatagttaattcttaagggagagtaaatattaatgcttaggaaggtattctcaaattcagttgtattaaaatacagtatttcaatttgtgtgtcacataactgcagatgtaaagcataaaaaaagttcctgctgctctctctaacccatcccagttgcataacttgtttacttactgcttggaagaacaatgtttaaagaggagtaggtcaaggagaagaaactgaaaataattaagaatacttactaataaaagccccaaacacaagcccaaaaggcagatctacgccttacttgttaactttttcaccacccaatcatccagccaggttagtattaatttagacagaagttagctgttttatgttcaattgtacaaaaaagaaaagaaaatagcacatttatactcaggaataactctccttgaaagcacagtctccttctcttgtgctgcttctctgttcaaaaatgaacagaggtcctggaccagagttgctactcaagtatttgaagatttccttccttccttctttatttgtatttttcatgaaagttaaatttggtcatttagggttacaagatttagcagataaaaatgcatgacctctggttaaatttcaatttcaaataaacaataaatagtttcttagtagtatgtgccatgcaatatttgggatataattatccaagaaactctccttcaccttaacaagggcgcaactgattagctgggcagagagtttggcaatccttgtccttcattctcctactggttgggacctagattgccagtgctccctccctttctctctcctttcctttttcctttagttattaattttttaatttttattttttaacttcatttttccataagttattgtggtatgggtggtatttggttacatgagtaagttctttagtggtgatttgtgagactttggtgaatgcatcacttgagcagtatacactgcatcatatttgtagtcttttatccctcgccccactggaaaacaatgtggagattccttaaagaactaaaagtagaactaccatttgatacagccatcccactacagggcatctacccagaggaaaagaagttattatttgaaaaagaaagaagtcattatttgaaaaagatgcttgcatgtgcatgtttatagcagcaaaactcacaattgcaaaatcgtagaaccaacccaaatgcccatcaatcaacgagtggataaagaaactgtggtatatatatactatggatatggataaagaaactgtggtatatatatactatggatatatggatatatatatatatgtggtatatatatactatggatactacacagtcataaaaaggaatgaactaacagcatttgcagtgacctggatgagactggagactattattctaagtgaagtaactcaggaatggaaaaccaaacatcgtatgttctcactgatatgatatgtgggagctaagctatgaggacacaaaggcataaattttttttaacatatacaaaggcaacagagaataataaatatctatgactactttacctgcttaagaaatatgattttagagttgaagcccatctcctccggattggactctactcttccccacataaaacaaccaagtatgtctatactattaggttggtgcaaaagtaattgccattttgggcactgaaagtaatggtaacttttgcaccaacctaatacttctactacatatacatgtattatacaacagagtaattttcaacttttatataaatatattgtatcttcacaactctcttcactgtgaggttttacccatgttgaggcagtatcaattctggtttattcattttttcattatatttctttgtatatatccacgattattcatttcctaatttcctattgacagacatctttcatttctttttttttcccaattataaacaagactgcaataaacaaccttggacatgtcttcctgtgcattaggtaactagactttctctaattagtatgtttctctagttacctaatttgctaaataaattgctctccaaagcacttacacatatttacattggcagcagcaataaatattaatagtcacagtcatgataccatcaagcataatctttaacacccactagattggcaagaaaaaaaaagtttaattgtagtatttctctggttactggagaggctgaaaatctgtaatctataatgagcttccacagtaagacaatgacaacaaataatgggatgagctaagaatatgagtaagcagccctcaaagtagaatcccatatgacaaaaaacaagccattatttaattcattaccatgaattaaaaatgtaatagaaaaatggcagaacaatggccgttaatattgacaatactgaggcagagatattttcccagatggagatgtgtgtgtatatatatatacatacacacatacacacacacacccctcctctaaaaattactagtccccaaattccttcatgatatgctgaaaatggcagtatgcttttgacaatagaagaaaagtaaatagggataaaaagacttaaattcctcagcagaagcagcaatgaggaaagaaaacttgtatataaacatgggtgaaccatacagccaagtaggacacaaacttgaagccagagagctttggattaagtcctggctttgttatctactagtagtgtgaccttcggcaagttacttagctttaaggagcctcaatttctttaggggtaagaataaaaaataagattattccaatggccagacataatataggtactactagcatcaacagtacttggctcatatgccagtccataaatggtagctactgtcattattattctattattattaaaaatgacctttctatgaaaccaaaactatcttgtctttcaaaggtatttgccataattttctagaaatattagactaaaaccaaatactcttagtgaagaaagttaattttcagaacaattaagtacttcttgtttgatattggtattatgtaagcttaagatataattacttggcaaaacatcataaccaggtaggatttattccaggtatataaggctggttcaacactcaaaaaataacataatcaaatatatcaacaggttaaagagaaacatggtcatgcgaaacgatcgagaataagcatttgacaaaatccaacacccatttataagaaactctcagcaagttacaaacagatgaggattacctcaacctgataatgaacatgtataaaaaacctacagctaacattatacttaatggtaaaagtttgaatcctttcttcctaagactgggaacaagaaaggatgtccactctcactgctctaattcaacataacactggaaattctagccattgcaaaaaagcaagaaaagaaataaaaggcatacagattggaaagaaaaaaaaaaccgtcactatttgtgaaaaatgtaatggtctacatcaaaagtcccaaggaatctattaaaaaacctcttagaataagtgagttcagcatagactataagtcaatcacatttctatatattaatgtgtatatatataatcaatcacatattctatatgtaatgaatatgtgggaaatgtaatgaatatgtgggaaaccaaaatttcaaaacccatttacaattgttctaacaaattaaatattggtatacacattaaataagtacatcatctgtgtagtaagagctataaaatgctgatgaaagtaatcaaacaagaaatcaaataaaaggagatatgaaccctattcagagattggaacactcgatgtagtgttccaatgcatgtcgattctcccaaaatttacctacaggtttaatcaattcccataaaaacttaattatctaatgaaagatagaaaatgataaaagtaggctgggcacagtggttgatgcttgtaatgtcagcacttagggaggcagaggtgggaggatggcttaaggccaggagttcgcaaccagtctgagcaacaaagtgagaccccgtcactattaaaaacaaaaacaaagcaacaagcaataaaacaaaactaatacaaaccaatagcatgtgtaatgaccgcaggtttttgctgatattgaaatgcttctgtagtacttcttgcacacttctatcttctgagagatactaaaaggaaaaaaaaaaaaaaagccaaaattgaggaaagatgtagtttaaaacctaaatataatcctgtgccttactggttggtgtaccttagtaactctatctaatattaattcattattaaatagatgttggtcttatttgtagaacactaaaaccaaaataaagtttccagtctactgattttcttatcctgttctttacgttaattcaataaacacaatgataaaacaatcctggctaaccccaaattcgtacttgaataagggaaactactacacagtcatactagtgaaatgaacaaaatgcagcacaaaaacagaagtgcatgagttactgtacctagggatacaaggtaaagtattacaaagaatgcttaaactggatgagacaagagatttaaaaaagaaggaagaacattccagttacagggaacagcatgagtagcaggaaaattatcacattggcagaaaatgagtagtcacgtactggagtttcaattactggcaaagtgaatgtacaaaaagaaaaggcagaaaaacctaactggaggtagctgtccagacaagaggtaaagtgggtcggaattatctgagtgttatgaagaaaaaagaattaagacgtttataggagtacatctggtagagaattaactggtagcagaagagaaggaagggtttgaaaggtagaagataaaaatcaaacatgatctatgggaaacaaaatggcctgtgaaaagtgaaatgtggtcaaaaaatgaatcttggattattaatatttaagtagtaggtgggaaaagagaaaaactaagaaattaagaaagataccaaagactggaagagaatctaagacagagtagagatctagaaaacaagggaacaaagttttaagagagaagtgaggttcaacaatataaactactttgtaaaaagatatatttgagaagaggctaatggctttagaaattcaaagatcaccacagccctttgagaaagtaccatctaaagaggcaagtgactgcagtaattagggttgaatggaaggtgaggaacactggcattgaagaaaagattagatgaaaaaagagtaaattcagaagtagcagagccaagaaaggcctggaaaagattgtcataatttttcaaaaatcatctgcatggaataaggattcttttaaaaaaaaaaaaaagcccagaaaactaagcatttctgtattttctagagctgtaattatatgtctttactttgtccactctaagaagaccagattcagaagtaagttctagtctactggaataaaattttatactctcaggaaatatattatcttaattatagttcccactcccttgctattgtttctagtcttctctttgtattttaaaggacttctggttactatatctttttctatcacaaacacggtagaatatccttggaagtacacagggtgaacataaaaaaaacaaagtaataccttttggaaattaaaaaaaaatttgtttagcttttccagttttaaaattgcaatatggaagatatgtggctaaatatcacaggcaaactatagtcttggtttctgtaatctgtaagttgtaaaagttgatgtggtaaaatcggagcacttaggaaaactaaagaaaatcacctgggacaaaattgaagaaattttctctgcaagaatcaattatttttaaaacctgcatttgcctctctttgacatgatgcttcaaaggttaatcttctatactccaccttcctactttatctctttattttttagtggtttgactccaattccccctctttctaaaagctatcgccttcttgcttctataattacttattctgctttttaaaatgcctaccttatctacatgagccatttaaacaaaaaaaattgtctaacctcgttcattatatttttaattccatcttgattcaaacactatactctatttgaggataaggctattatcaacaaccacataagctacagtactttgggagatttcatttgaggagaataaggtatgattcttttaaatgttcttttcaaaggatccctcttatactgccatgctaagatagagtctactttgcttatttgactcatttgaagtagggctaaaacaaaccttcaaattaggcaggatatcaaggttcaatcttatcctgaagatatttcttggatgagattccatgtgtgacctgttatctgtatcactgctattggcttaatcctgccattcaaaatagcttcctggataatcggcactaagagaaagaatagctcccttaatgcagctaccaccctactccacaaggcagggactctgaccatggtgctgacagatttttcaagtgaagctcattttattcacataccaaagacaggcacaagatgatcaggataggggaagaaaatattagaactcagagacacaaacaccagtgatgctggttctacttaatgaaactgactattaagactatcaaaatgatgacaagacagtgctcacatgcaggggatttaaggtctgcaacaaaagtccagaaagtagattagttatgctactaacacatggttatcattttctaagtcacgcagttatacttcttcaccagtaactcccagcatcctctttatttatagactcaatttgagatgctcagaatgcaacacagttgggaaggaaagtggatgaaaaatggcacagtgcaacctagaccatgtagttaccttaagaagattaagtgtgagcaggtatggaaaaaaaaaagcccatggaaagtacagacatttaaatactatgaaagactacatttgaatctctaaaacagccagaaaaacatactggtggaataagacaatcagttcaggagttgtagaagatgaaagtctgtgaggcactgaaaagtagatctaaaagctgaagatccagaggtctggttcacaccagaccccagtaaaaggggacaatgtgggagtaccaactacaaagaaggtgctcctatagatggaatcctataattagaaatagtatcaaagacacttggtcaggtaattgaaatacccgagtctcaggaaagattgagtggaagggaggatccatacctaattatatcaaggcataatatctgaattttaaagataatgtcagctatttttacatacaattatgtatagttgtattaagaaaaagaacagggaattattaatcataacaatgggaaaaaagtaatataaaaatatgtaggctttgagtcctttatgtaaaaacaacatatttagcatgtatataaactctgcaatgttgtagaccaagtaattattccatagtagaagaaaggagaattgatatagtcttaagggaaacttccactgtttatcatgtattcttttgcactaattacattttgttcaataaacttttatgatattttaaaaaaatgaaatgtgtcaaaatactgcttacatgagcagactatattttataatcaaacaataatcatttaaagaacaaactaaatgcaaaacgcttccaatttagtattagtatttaaaaattcacggtaaaaatacaatctaccactattgctttaaaataaaatgatcctttttatagagtcagtgaatatagactgtgtaattctattcaaagatctaattatccttaccggtattttaacattataaatcagtttttcccaattccttcagagccagggactctatattattttccactctcacgaggccaatattttttgagattctagcataagggacttattcattaatgatgtttttcaattatattattaaatacacacacatatgcatacttcctcctttctctttgccaactgaaactttttgacagcgtaagattaaaatgctagtgtgttgagaatattttaagcacaggtaaatttatagtctcaaaggtgtggcaaatctttaaaacaacatatgaacctgcctttgtatctaagactctcaagtctccagggactgtgagatgtgatcacctattagataatataactggaggtgccacagtctgtactgcctcttaaggcccaacaaaataaaagctgaagttgctaatgaaaactggaagaaaaaaaatatccacacataataggtatgagtcattaacatttatttatcattatttactatttattattattgctaaatatgtaaaatatataaaataaaattatctaaaatataaaccacatacagataaaactaaagcctcattaaagtttacttcaaactaataacataaatcctaaagcttaactgtgatgttcttttgagatagaatttaggagaaatgacatttcaactgtctaagaagaaaatttttaaaaagtatataatttgtattactgcagcattatccttcagcaatattagaaactttgtgttaatttactaatttctaaaatttgtgttttaattgctttaaatcatatagcaaggaacatttagctttattgccttttaagatacctgaacattttcattccacttctcagcaaaaaccttgtctggaaactctgcaggtagagataactgttctttaaatattttaacatactgtggaaaaccaaatgaattcattaagtgtatctgccggtgagaaaatcttgacttcactcttttttctaagagttccaaaatatccttaaaaacaaacagaaatctctataaggaagatgaatgtttttaaaaaaacaaaaacactgtaccaatgttagaggtataagtaaactatcacctataattagtaatgtttagtctacaatacataattaaacatttaaaacattttatgcaaactaaataatccacctccaggcatttgctggcttggtgatgtcatgcctttttcccaccatgttactctcagctaatctgtaacattccaagacccaacatgactgtttaaaaaaactgacaatattgaatagctatatgtcacaataacaccaagagtgtcaataaggaattctgtacattctatgaagaactgagattaaaaaattaatagcatgataggcagcaggaaccaactttaggagaggaaagtggcagaaatgcaacatggcattcgtaagttatcttccggcttttttttttttatagtaatgcttttagactctatttgtatttgtgctatttttccttaaaaagaaatcaggaatcaaatttactgtcaaagaacactaaaaaccaaaggataactaatatgtactgcttgtaaggacatacgaagtgttcttaaatgaagaaaatacttccacaaaactgataggcattcaaactatccaagacatcaaaagcacaataggtaagctgtcttcctaagtcacatatattgcaggaactgtcattcctaaatctctttttaataatgaacttgagcaatttttcaaaatatattatagtacacagcatattatatataatatatataatttatattatatatgtatatatacatctatatatatacagtatagtataatatatatttattacttaagttacactccaaggtatacaaccaagacaaatgaaaccagataaccacaaaaaaagtgtatgtgaatgtttgcagcagtattatttttaatagcttaagaaatataaacaacccaaatgtccatcaactgatgaatggataaacaaagtgtggtatatctacacaacagaatattatttggtaataaaaaggaataaagggctgatatatgctgtaacacagatcaactctgaaaacatgttaaagaagccagtcacacaaaactatacgttgtatgattcaaaaattactaaacagtcagaaagtggattagcagattagtggttgcatagggctggggagggaacaggggatttggggtgatcactaaaaggtacgtggctcttaaactgtggtgataaatgcacaactctatgaataaacaaaaaccctgttaattgtataatttaaatgagtgagttgtatggtataaattacatctcaataaagctgttttaaaaacagtgacatgatatttgatgactttaaggaattacagctaatataacaattatattagggaaatatatttttaaagagctcttatctcctaaaaatacattctaaaatacttactgataaaatgatataatacctagtttttgcctcaaaataatacaggaatgaaaggagatgttgaggataaataaaattagtctgtagtaattgaatcttggcaatgagtggagaagggaattcagggctcattatttattctttcctatgtatattgttgaaatgttataaagatttttaaaaggggagtagtttaagcccagaaatatacatctccacatctagccagatgactctcataatacctacgtgaagaaatcatgatatagaggaaagaattcaagtgatcaaaatgggatcatggttagtttgggaaggtggacaggaaagactaatagcctgaggtaggaggtgggagggtgaataaaaaattttgaatgtttttatgaggtcaaagaaaagtatagtgccagcatgagaactaaaagacaagaaaggttatattcagagattcagatattgtacatttattttctattaagaaagagttctaggtcacccatataggtagacagtggaagtaataatctatacaagcaacaattcagaccctaaatttgggaatgaaaagagatggaagtaaatactgtctttgtagtaggcagtaatgacagaagttggcaatgtgggcatacaggaactagtaaaaacaaaacaaaaccaaaaaacaaaaatggaattactcccaatggggaagaagatgcttgctggcaaagtcactactccctctatacttttgttctctccctataaacgtggatacacagataaaattatacttgaggccaggcgcagtggctcacgcctgtaatcccagcactttgggaggccaaggggggtagatcacgaggtcaggagttcgagagcagcctgggcaacatggtgaaaccccatctctactaaacatacaaaaattagccaggcatggcggtgtgtggctgtaatcccagctactcgggaggctaaggcaggagaattgcttgaaccccgaaggtggaggttgcagtgagccgagattatgccattgtactccagcctgggcgacagagcaagactccatctcaaaaaaaaaaaaaaagaaaaagaaaaaaaattacacttgaaagaactacacagttggagaattatatatatacaataaaaaagaacatctgataacactgctaagaagttactggcattttatttggtccgttattgggtcaacaacactcaccacagccacttccacccaaaggaagatttttttttttttggcaagaaggaggatgcttctttgatccttgtcatcgcctgctgcttttggcaaggaggaataaagatatgtggagcaccagccagtgatgtatgagggatgtttatactaaagccatgtatcataagctctagagcacaggaaaggaggggcaaatgacagtcactctatagagaaacagcactggaaggaggactgttgaaatatgaattagaaaaaagtttcacttttctgaaaaagaaaaagggttgtaggaaaggagatgtgaacatgtaaatgtgcctgacacatctgccgagaatggagggggaagaggattgcaagaaagctatggaggcatggcagtcatagcatgagaaaagagacaactttgctatggtttggatatggtttgtccccaccaaatctcatgttgaaatttaattgccagtgcaacagtgggaagtcactggagtggaccctcataaatagatttaatgccttcttactggagtgagttcttgttctcatggggatagattagttcttgagacagtgagttgttataaattgaggttccaactcctatctggttcgtttttgcacatttcggttccccatttgaccttccaccatgtcatgcagcatgaaaacccttgcaacaaagccagtgccatgcgcttgaatttttcagcctgcagaactgtgagataaataaacttcttttctttaaaaattaccaagtctcaggtattatgttatagcaacacaaaatgggccaaggcactcttcaataccagttttatctgaattcagtaagttaatactacatgcgtgtaagaaggtaaacacaaaaaggcctgtactgctgtccaaaggtacacatggttcaatatgtacagagccttcacaaggcaaagtgatagtgatattgagactatagttaaaatcattctaaaatatcccatggaatgaagaagccactatctactgtcagtgcttggtagaatcttttccatttctggagatgtgtactttgaaagttggaatagtattacttagagttgatttcaagccttttcaaaatatggaaaaaaatcttaaaataaaaactattaccaagttttctcaaatattggtgagatttaaccgcctcattacttgataatgtagaaattatatttattagcataatctgatttcatacttttttcttcagtaatttcactgggaggagggaggtattcattaatgggctaaggtaactactaaactgttttcctcaatttgagttgaaagcaggataaatacaccaggcactgctgaaacaaaatttttaaaatgacctaaataagtgaaaaaaactagcagtgtcagcaattaagcttgaattttaaaatattataatcaatttttttaatgaacagaaagacttaccaatctacatgtaagaccaataactgctattggggtctgtgcagactgagaaatgtcaaaaagattatagagaagtgtttggtttttatgatgagcaaaaagatcaaattcatctaatatgaagatcactgggcaactgctagttcggtcacctaagataaaataagagcattacattaataagaaattatatccacctttcctaaatttccaaaccatttactatatttcagtttttaaaactcaattctgtaaacattctgatagcctactttgggtaggggatttactgatgcatatacgttcattcaacagaaaaaaattattcaaaggacaaacacagccccgactgctctcaagaagttcagtctaggctgggcgtggtggctcatgcctgtaatcccagcactttgggaggctgaggtgggtggatcacctgaggtcgggagttcgagaccagcctgacaaacatggagaaatcccatctctactaaaaatacaaaattagtcaggtgtggtggcgcatgcctgtaatcccagctactcgggaggctgaggcaggagaattgcttgaacccaggaggcagaggttgtggtgagccaagatcgtgccactgcactccagcctgggcaacgagagtgaaactccatctcaaaaaaaaaaagttcagtctaggccgggcatggtgactcacgcttgtaatcccagcactttgggaggccgaggtaggtggatcacctaaggtcaggggtttgagaccagcctggccaacatggtaaaaccccatctctgctattaaaaaaaaaaaaaaaaattagctacttgggaggctgaggcaggagaatctcttgaactgcggaggcagaggttgcagtgagctgagatcacaccattgtattctagcctgggcaacaagagtgaaactccatctccaaaaaataaaaagtgcagtctagttcctagactctagtagagtttgttgttgaaaaatgtcaaaaatcatttaaatgactaaagactattatttttataattacgtaaatataattcttatttaatgattataaaattgacagagttttctatacctacacagaaccaaaacactttaagattaaaatataaggggagtcactaattaatgaacaaaactaatgctttaaaagagagttgtttatttagtagaaatacaaggtacatttcttgtagaaatactttttataaacaaacttgtagattataaagttcaactaaagccacttaaactcccttgaagcacaacttttagcatttcaactacaatgcttttcatggggaaagttccacatcaccctctggttacatttttctcacttcaataatggaaacaactttagtaaaagaatcccttttaccttaggcttaacgcctttatatttgtgttaaaaagtgaaacaaatatctgataaaagaaagacttatttcaacaaataacaaatacagtagcctaaatgacttaatactggtacaaaaccaaagggattactcaaaagtctagaaagagacttatgtactaatatagaattttagtatttgataaaatattgcattatacatcagtggggaaaattagtctattcaaagtcagatccctactttacaggtaaaatcagaataaattccaaacaaattataaattacaaatatatatatatattaaataaaaagatggatcaatgaatgtttttataatctgaaggagagaaaaaactttctagataaacttaactatgtggaaaacataaaactttagatcagcagaaaagtccaaaccaaacttaagggaagagaaaaataaaacacaaaaattccgataaataagcataacataaacattaccacaataggtcaaagacccaacaggaaatacagtcgtgtgtcccttaatgacagagatacgttctgagaaatgtattgttaggtgactgcatcgttgtacaagcatcctaacagtgtacttacccaagcctagatggtatagcctactagacacctaggctatatggcatagcctattgctcctaggctatgaacctatgagcatgtgatagtgtagacaactgtaacacaatgcgaagtatttgtgtatctaaacatatctaaacacaggaaaggtacagtaaaaatatggttttataatctaataggaccactgtcacatatgtggtctatcattgaattaaaggttgttatgtggcacatgactgtacataaaccaggaaatttcaaaggtcaataaaaatatgaaatgacaagcatcaccactatcagaattatgcaaattaagtaaccagaattatgcaaattaaagaacaaaattattcaaattaaactaagagctgaaagtttttctattatatgggcaaacataaaaataataattgtttttgaggttgtgaagaaaaaggtattatcaaatatttttacaaattaaacctttagggtagtttttaaatgttaaagatggtgccttttaacccagaattctacccacagaaatttatcccaggaaatatctggatgatcatcaaagtatctcttcttaattataaaaaattagaaacaaaagcccataattggtgattaataaatagcaccttataaaacaagaaccataaaaatgatgatgcagatcaaaatcttattacaaaataggtaaaataattttattgttgtaaaaaatcacatttatctctatcaataatatactgatataaagatcagtatatcattgaataaagataagaaaccaaatgctaattgagataatcactgttatagtggtgggaatacagtgaacattgtattctttttaatgtttctgtattttatgagagcttttttttttggcaaaagcttgtattacctttataatcagggaaaaaataaagttaaaacagatcttctgaaacggctgaatatgttaatatttacctttttttaaagcttccagaagaaatgaaaggttttcagcaaagcttccctgaacaacaaaatgagataaaatgattaaaagtttagtgaaataaagaacaaaagatggctgtctgattctcaaattttatataaacactgtatatcttctagttattagagtcattgcccagactctgctgagtgtctctatacttcctatctaaaacttaaatacttaagcaaagatggcacatcactgaaaatggcaattacaatgtcatctttgaaattttatattttagaacttgaggataaaacggtcaaagaagaaaaagaaaagtaagaaattttatattttccggaaaaaatctgaaagaatgttaaatttatttgaaggtagttttgtagaattgccatattctaaatatagtttgagacctagaaatggattctactttgtgtcttcaaacacaatggggtcttgcaagtctctaatttgtactggtaaagaaataaccatgaatttaaatgagaaacaaaaagaaaaggcttttttgaaacattagatactataacagtgtttgtctattcaagagtatactgaagaatttatgtatatcatatcatgtttggctatgtttacttggaatatagccaaaacatttttggatactattaaatattcttgatgaaacttagtgtagtagatgcattatccaggtgctccagattgtgggtagaagccccattaaaatatttgtttcattaaaattattaacttttacttcattcagagttcataactaaaagaaacagccaactttaaatttgaggagatataaaggagaaaagaaacacacttattcactctccagttgagagatctaacataaaaatagcataaaggttttaaaactttcacatattgtgatgttgttatgctatttccaaggcaggcagaccaagaggtgttatccataatttaccgtaatataacaaatcctcaaagagacaatctgttgggaaatcagtggtcagttactcaaaggtagcttgtctttcaggctttttgcttaaaagattattacatctgatactaagtatatgcttctataaatacgtatttgtgcatgtataatatacatatatatgtctgtttatatcaaaccagaaaagctgtgggttgaattaagtgacttaggttcttataatgtccaggctctgccattttatgaccttcggcaacctaattatgctctctgagcagaagccaaatttatataatgaaggaattaaactattaatttctatagcagtatttctctattcaagagtacattgaagaatttatgtatatcgtatcatgtttggctatgcttactcggaacacagccaaaacatttttgggtacaacttaaactaataatctctatatatgataataatagcgaagattagaacagaatgataaaaaattgtcatttttattatttcacataaaaccaatatgaatatgtaacatttaaaaatgtcagaaacacctacccagatcaactgggaaccaaaagccaaactgagcatacttaacaagaactgtctttggctcagtataggccactagcttcaacatcacattctaaacaggaggtagaatattagatttatagatggggcattttgaaactgcacttcaaagacctacagactttggaagggacaaatttactcaaccttttagattagattaacattttatattaatatttttatagattaatatattatattaataatttagattataatctataattacatataataaactataattatatataatctattagataattatatagatataacctattatagaattacatagattatataattatataattatataattaataattttatagagtatataattatataattaataattttatagattgattattaaagaaagaaactcataaatgctaggagtcttacacaactatggcggtgtcattgcagcacaaagcacacagttcagaaattagagcgatgccaccgcatggtcaccagtaaccagaaaatgaagttggaatgtgtataatccactccaactgcataagcagtatgaggctaggtaatttcatcatgaaaattcaggtaggtgcaaaattaaattatcatgttttccttaggccctatatattaggtgaaaggtaaaagtttaatacaagtttcaaaacatttcaagtcagtttcttttactgatgttgttcactgccctgagactataagatgatatgataatgaagtatgaataaatttctgaaaacagaataactgacatttgtacagcacattaccatccagcaaattattttttaagttaaatgatgtgtaatgttttctttcttcttcaaaataatcctgtgaagtatggataataaaataacgcccaattaacatgtaaagaatctgaattcagagatacttgttagctcaggattatcaggcagtcaaagggttgtaaggcatgactgaaacccacctattgcagcctcaaatttagcacattttctactatacacaggctactcaagtctcaaaaaagtagaaataggctgctggagcatggtatttttaaaaatgtgttaatctatctccagagatacagaatcaaagtattcaccttacagaaaatgaaataaactcagaatatctacataaacttgggtttcttagctattttacagctactataacctactatggaaaaatccaagtattgtagacttaatgactaaatgtatcctatacattacacatttttatgaaagaatctcatatatttcaattaagaatttctgaacctctccctacccttccagaaatataaaaatatacatggtataaagacattaccttaaaagtctatttaataaaataactgaaatgatacttacaaaaactttatctccaactacattttccagatttaactgccttgtgatttcctttagggcgattttgtcattgatctgcagcagtcctaaaataaagtccatttaaaagtatttaattaaaattaaacatgtatttgatacagcaggttgttttccagttaagtaaatcttcccagtcaaagcctgtgagttcatatcactttcttcttaaaacttagcaataaagacattcggtagaatcaaaaaacaatcctccttgggattagaatgattaaaaaaaaaaaaaccaaaaaacccacaaaaaccagagtccttctgcgactccttcattattattattttaatttctaaaaatactgcatatggtgtgctaagtaaaacatggatctagttttcaaaatctaactattaaaatggatttgaaatatacaagtcatataaaaaccccacaaagtttacataatctccaatggcaaaataatggcatacttaccatttaagtgaacttgtaatacattttcactcacttcttctatttccatgagttctttcaaagcatgatttattaactaaatatgaaaagtttatgaaataataataggtaaaagataaaaataagtccatattcgtttttaaactacaagcagtaagaacagaatataaataaattgacctctttaacaagtaagttttcaaattctttacagataaaaggtttaactagaacatctcatatctgactctttttaagaaacaagagccaggactgatacaatattctctcaatcacctacccgaacttttaatacaaatttagaaacaaccaagttttaaaataaatatttctctacatgtcacattaaacatgtgacatggcccttataaacttcatgtctcagttagtacattacacatctctctgacaattactctactaaatatcattgtaatcagttaaaagcccattgaattaaaggtttctatgaagcatacttttttaaataacattgtattgctcttgtactgtgatatcatacatatctcttcatattaccaatgcattcttttttttaaagaatttgaaaatgaatgtaattaagaaaagccaaaaacctatttaaagagtaaagatggactgttccttccaatattaaaatataggtactatcataaataagtgaactgggaaaagcagttgtatacacaaaatattaatagagatggcatcaaaacttaggacaaaaagtattactcaacgaaggcactgggacaactggtaaactattttccaaaacaaaatactgtttgtatttgcaatatgctacttatttgtcattgcaacaccttatctaaaaagaaaaaagcaaatatgatcctcattttaaattacatatgtttcataacaagacaacaaaaataaaaaaaatttcctgttatacctgcatggtttttaaagcatagggaattccaggtcctctgaaaaggagacaatctcaagatatcacctgtcatactaccagtaatagcccaactgagaagtgacatttaatgagaagtgacatttaatgagaagtaacattaaaggactgcatagaggtacttcttcacctctggatcaggtcagacactataataagagtacatccctagatgatacagagttggtctctcaaaacagtgctttcagcaaaaattttttattttttattttttttgcaatccatggtattttctttcttccatctcttgatattttgcttaatatattttttcctaggttatgattttgttttaattcatacaatgttttatgttttgatgaattattcaaaaccatttcaaatcctttgctaaaaggaatggggattttaataataccttccattttatatatgcataaggagagttgtaacagatttatagctttctttccactcaacttactttaaacaccaacttatgctttgcttggatcagcccactaatattttatgggttgtgtgtatggtctgaaatgataaatatattagcaagtgagtcttcaaataatgttagttctaatctgggtattgctaaaatttattgtttatgcaatcaaccatttaagttagcttttttcttgaatatgttatcatttcaaatatttaaactacattatacactaaaaatatttagttggttattaatatcacactgaccaacataaccaaatttggtcatctcctttccacattctttgtgcctaaaatttaattttacaaacatactaagataattttcttagacctcccaacatccagtaatttttatgctcaccaacttatactattcccaaatattataataaacacaggtttcaccaatatgcaactaggagaaatatcctatttaaccatctagcaaatttgtctacagtaaattgcatgtgtaagagcattttctaagggtcggtacagtgggtcacacctgtaatctgagtgctttgagaggcagaggcaggaggactgcctgagcccaggaggttgaggctttagtgagctatgattgagccgctgggcgccagcatgggtgacagagagcctgtctcttaaaacaaaaaaaggtattttctaggggtcaatctgtcacttgaagccatatcaattttttttttaaataaaatgcttgtaatattataagccacactattgcctttttcaattaactatagagttagcatttttgtatttcagacagtttggccaagtatagtgttttaaatatactataatcttagggttaggattaggggttaaaacaaacaaacataagactacagtcttatgttttaaaatttgaatttatataattatactaatgaggctaggcacagtggctcatgcctgtaatcccagcactttggaaggccaaggtgggtggatcacttgagcacagcagttccagacaaacctggtaaacatggtgaaaccccatctctactaaacataaaaaacttagctgggtgtggtggcacatgcctgtcccagctactcgggaggcaaatgtgggaggattgcttgagcccgcgaggcagaggttgcagtgagtctagatcgtgccactgcactccagcctgggcaacagagtgagactctgtcaaagaaaaaaaaaaaaagaaaagaaaaagaaaaaaattatactatcgagagttattgtctaaaaataaattatatctgacaatttattcaatctatattttctctcaggatactcccacacatacaacaaattacaaaagtagcacaagtcaaacaatgctcatctcttcaacctgccagcatcagagtacatcaggaatatatgaaactatatcaaaatggaatgccatgcaagggactcttccagattccactatagtgaaaataaatgactgcaaggcaccacaatagggctctggtttaaaaagcaaaaagtagataaactgtcagtgtggccaagaataactgatccattttattaactgataaatactatgatttaatgcttttgcctttaaatttcagtacattgattaaacctataggggtttatgaaaaggtgctataacgtggaagggaacaacaagcagattaaaaagattaagttcagatttaaaatattaagcaagatggctgattagagactcctggtgctcgtactcccaacaagaaaggaccacagcaatgaatgaacagctaagatttgactggcgtgttgaagggagagtactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggaaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttccagtactaggggtccatcttcattccaccaagcccacataggtggctgaacacacaactctagctgcacagagactgagcctataattggttatgactctggtcctacacagcaaggaaaccaaccccttgctgccacacttccagccagagaaccaatctggcagtcccacccagggcaaactctcacttgaggtgaccaaaccagggtggggctctctcccaagaaggagaggcccccgagcatccaagcagctgatacaccccttgcactggcagagcggctatgcacccacactcagaacctgagaaacagccccacaataccgtgcacccctccctcccgcagacatacccctagcttgcccagtggtcctgtgcccacaatcagagcctgaaaaatagcccagaaggttacccctggcaggcatgcccccagcccagccgagcagccatgagccatgacctgtacctgagaaacagccctatgggccacccatggtgaatacacctcccacagggtggccaagcatccctgtgaacacatactaggcctgagaagtagcccttcaggccattcttgagcctgccaagcagtcttgtgctcacctcccaaacctgacaaacagcacagcctccctataactccatcagacatgccccaggaccagccaagcaatcatgtgcccacgtcgctaacctgagaagtacacttgccaactgcccctaacagacacattaccctagctggctgagcagcattacaccttaggcctacaaatcagccctgagggttgcctctggcagacactcttttgggccagtcgagcaaccctgctcctacttcccaggtctacaaaatggtccagtgggccatctgctgcagaaaagttcccaggccagccaagcagcagtgtcacaggcctgagaaacagcctcacaggacgcctctagtgggcatgcccataagccagctgaatagccttgtgcctgcatcctaaacctgagaaacaatcctgtggaacccctcagcagatacggccctaagccagtcgaggaactgtatccctacacctctgttgggatcaagcagccttgcacctggatcccaggcatctcctgggcctgagaaacaaaccagtgagttgttcctggcaaacattcaccaagactggctaagcaaccacatgactatgctcctggccacattaatagccccatctgccagtgtgtcagatcccaaggtgattgacccaccatatgcatgcatatgcccccaaactgagaaccagcccagcaaacccaccccttgcaaagctgtacaactgccaccacaaacaactctcagcctaggccactgagacacttgtaaatgacactagtgtggattacagctgaaaaaactacacaaagaccacactactgtatccaactagaaccaaggccaatgaaccacatcaaactgacacctcgagacacattgacacaaatcagtacttccttacgagatcaattctgtaagattggaaaagacaattttacttttctacctgaggcgtatcaatcaacatagggacacattaaacataaaaaagcaagaaaacatgacacttccaaaggaaaacaataattcctctagtaacagacaagaatcataaagaaatacagaaaatgccagaagaatttaaaataataatcttgacaacactcagtgaaattcaaaagaatacagatagaaaattgaacaaaatcagaaaaacaacttgtgattcgaataagaaattaacagagataccataaaaaaacaaacagaaatcctacagctgaagaagttaatgaatgaaatagaaaatacaactgagaccttcaataacagactacatcaagcataagcatttcttaaattgaagacaaattgtttgaaataacacaggcagacaagaaaaaaaatagaatgaagaaagtctacaggatttataagacttcaataagtgaacaaatatttgtattattgtactttcaggaggagaaaagaaggaaaaggtgagaaaaacatatttaataaaaccatagttgaaaacttcccagttcttgagagaggaatggacatccaaaggaagctcaaaactccaaacagactcaacacaaacagaaggtcttctctgaggcatattatagtcaaattgttaaaagtcacagacaaataattaaagcagcaaaagtaaagtgtcaagtcactataagggaatccctattatactaacagtagatttcttcttctttatagcagatttcttttttttaattaaaaattttaaactatcatttttttaaatgatattttaaaacatctttcatccttcttgtttacattttagctgattgtcagaatatacaacagcagatttcttaagagaaacctgacaggacagaggggaatgggatgatacaatcaaagctcagaatgaaagaactgtcagctaagaatataatacccagcagcttcagaaataaaggagaaataaaatctttcacagacaagcaaaaactaaagcaatccgtcatcactagaccagacctataagaaatgttcaagggagtctaacatccacaaatgcaaagatgatgaccaccatcatgaaaacagggaaaactataaaactcactggtactgcggatacataaaggagaaagagaaaggatcaagccttatcactacagagaggcacccaactggaaaaataaatgagaggaagtaagaaacaaaggatatatgaaacaaccagaaaacaatcactaaaatgacagggtaagtcctcacttatcaataataatcttgaatataaaccaattaagtttcccatttaaaaaatacagaacagataaaaaaaaaaactcaattatatgctgctacaagaaactcacctcacctgtatagacacacagacttaaaggtatgaaaaagatatcctatgaaaatggaaaataaaagtgataagaaagttgtaaaaacaaagaacattatataataataaaaggatcaattcaacaacagaatataacagttgtacatataaatgtacccaacactgaaacactcagatgtataaagcaagtattattagatctaaagagagataaattgcaataaaataataggaacttcaacaccctattctcagcattggacagataatttagacagaaaatcaacaaagagacattgaatttgaacttcaccatagaccaaatggacctaaaatacatctatagaacatttcacccaacaactgcagaatgtacattcttctcatcagcacacagaagattctccaagactgacctcatgttaggacacaacagaagtcttaaaacatttttttaaaaaaagcaaaatcctatcaagtatctgatctggccacaatggaataaaactagatatcgataataaaaacaactggctaggtgtggtagctcacacctgtaaccccaacactttgagacgccaaggtgggaggatcccttgagcccaggagtttgagaccagcctgggcaaaatagggagacctggtctatattttttttaaaaagtaataataatgacaggaacattaaaaactatacaaaaatatggaaattagacaacatgcccatgaacaatgggcaaaagaaattaagaatattacagattcctagaaacaaaagaaaatagaaacacaacttactaaaacttaaggaacacacagcaaaagcagaattaagaggcaagtttatatcaatatatgcctacatcaaaaaactagaaaaatttcaaataaagaatctaacaatgcaatccaaaaaattagaaaaattttaaattaaaaaatctaacaatgtattccaaagagctagaaaagaacaaaccaaaccccaaattagtcaaaggaaataaatatcagagaaggaataaacaaaattgagactaaaacaatactacaaaaaatcactgaaacaaaagttgcttagctagactaagaaagaccaaaataaataaatgagaaaagaaaaaggagacatcaaactgaatatcacagaaataaaaaggatcattagggactactatgaagaactatacatcaataaattacaaaacctaaaggaaatggttaagttcctggacacatacaacctttcaatattgaagcaagaagacacagaaaacctggagagaccaataacaaataatgaggtagaatcaggaataaaaagtcttccaacaaaggaaaatccagtactggatggctttgctgctgaattctactaaacccttaaggaattaatgccaattcttctaaaactattccaaaaaattcaagcagagaaaattcttcctaattcgttctatgaggccagcataaccctgacatcaaaactagacaaggacaaaacagcaacaaaaactacaggtcaacatctctgatgaatatagatgcaaaagtcttcaataaagtattagtaagctgaatgcaaaaagatcattcaccatgatcaagtgggatttatcccagggatgcaaggatggtttaatatacgcaaatcaataaacatcatacaccacatcaatagaatggaggccagaaactatatcatctcaatggatgcagaaaaaaacacgtgataaaattcaacatcccttcatgatagaaactgtcaaaaaggtatagaaaaaaaacaccacaacacagtaaaggccatatatgacaaacccaaaaccaacatcacaccaaatggggaaaaactaaaagtttctcctgtaagaactggaacaatacaaggatgttcactctccccattcttattcaatatagtactagatgttcaagccaaagcaatgggaaaggaagaagtcaattcattcctttttgcagatgacataatcttatatatagaaaaacctagagactctaccaaaaaactcttagaatttcagtaaagttgaaggctacaaaatcaatatacaataaccagtactgtttgtatatactaacaacaaactacccgaaaaaaaaaaatcaagaaggcaatcccatttataagagctaccaaaaaaacgtaattactgaggaataaattcaattaaggaggtgaaaggtacagttttgtacaaggaaaactacaaagcactgaagaaagaaattgaggaggatacacacaaatgaaaagacacccatactcacatgatagaaagaatgaatattgttaaaattactatattaccagaagcaatctacagtttcaatgatattcctatcataacactaatgatattcttcacagagatagaaaaaaaatcctaaaattcatatgaaacaacaaaagatgccaaatcgctaaagcaatcttgagcacaaggaataaggctggagtcaacatactgccttacttcaaatatactacaaagctgtagtaaccaaaacagcatggtactggcataaaaacagacatgtagaccaatagaacagaatagagaacccagaaattaatctgcttatcaacagccaactgatttttacaaaggccaagaacactcactcatcagggaaagggcaatttcttcaataaatggtgctgagaaaactggatatgcagaagaattaaactagattcccatctctcatcctgtacaaaaatcatttcataatagatcaaagacctcaatgttaagacctgaaactataaaactactagaagaaaacataggggtaatacttcaggacactagtctaggaaaatatcttatgaataaaaactgcaaatcacagacaacataaaaaaatagacaaatctgctaacatcaaactcaaaagcttctgcatagcaagggaaacaatcaacagcatgaaaagacaatctacagaataaatgaaaatatctgcaaagtattcatctcatagggattcatatccagattacacaaggaactccagtatctcaaaagcaaaaaaccaatttgcttaaaaaacaggcaaattatctgaacagacatttctgaaaggacatacatatagccaacgaatacatgaagaaatgcttaacatcatcaatcatcagggaaatgcaaatagaaaccacagtgaggtatcatctcactccagttaggatgtctattttcagaaaaacaaaaaataataaatgctggtgaagatgcaaaaaaaaggaacttttatacaccattggtgggaatgtaaactagccaatattgaaaacagtacaaaggttccccaaaaaccactacaaatagaactaccatatggtccagcaatcacactactgagaatttatataaaggaacggaaatcattacatcagagagacatctgcagcccgtatttattgttgtactattcacaatagccatgatatggatcaacctagttgtccaacaacagatgaatggataaagaatatgtgtatatacacacaatggaatactgttcagccattaaaaaaagaaatgaaattctgtcattcacagcaacatagatggaactggaagaagttatattaaatgaaataagccaggaaaagaaagttaaacaccatgcgttttcactcatctatggaagccaagaaaagtaggtcttacagaagtcaaaagtagaagagaggatagggtaggaagggtaggaggaaaggagggatagtgagagattcaataatgaacacaaaattacagcaagataggaggagtaagtaacagtgttgtactatcatttttctgtaactataggatgactataattaacaataatattttccaatagctagaagaaggatactggatgttccccacataaataaatgataaatgtttgagatgattgatatgctaattattctgatttgatcactatacactatatgcatcaaaacatcactatatatcccatgaaagtgtataattattatgagtcaatttaaaaataaagtataaaaaggttaattactacctaaaatgactattttatgaaataaatgttttgagctatttaagccagacttagacaagaagaaaagattcttagaaaactgaaatgcaatatcagattagaagaagcaaatgacagcactggcagtaaagaaaatcacattggccatatgacagaatgctgagagagggggaaaaaacatgaaaaagatggtagacatggaaaaatgaaaacaaagatttaagaactgaatattctaatattggatattcattttttctaatcataagaaaaaatgaaagaatattcaaaaataaaagaatattattctttagtgaacaataccctctaaatttatactaaatcagtatgcagagtattagtgaattttatgattaactgttagacatagtctatgaataactaatgcaataaaagaagaaaaggaatagaagtatggagatagggaaggaataattaaaactgtctttgttgacagataacataactgtctaagtaaaaaaatctcaaagaactgacaaaaaaactaatggaattgagaagcaattatagcaaggttgcagaatacaagcaaatatagaaaagccaagtgtttagctatctactagcaatgaagacttagaaaaggaaataaaaaacacagtactattcgcactagaaccaaaaaaatgaaaaattaggtataaatctaacgaaacatgtgtaagatctttattaagaaaactacaaaaactgacaaaagtcttaaataaatagatactccaagaacgggaagactaaatatagttaagatgtccattcttcctattgtgatgtataaatttaactcaaaatctagcaattcacaaagattcccagaattttctggatatgtacaaagtgattctaaagttaatatgaaaaggcaaagtatgcagacagccaacacaatactgcagaagaacgaggtcagaagactgacagtacttaccttaaagactcactaaaaatctacagtaatcaaaacaatgtgatattggcaaaagacagacaaagcaagggaatagaaagagaacctaaaaacagaaccacataaacatagtcaactgatctttgacaaagaagcaaaggcaattcaatggataaaagatagtctttctccaattgggcattcatttgcaaaaaaaaaaaagaaaaaaaaacgaatctaaacacagaccttacatctttcacaaaaattaactcaaaatgaatcacagacctatatataaaatgcaaaactataaagcttgtagaagatacataggaaaaaatctacatgactttcggtttggtgatgaagcttcagatacaataccaaaatcataatacatgatagaaaaaactgacaaattagattattaagatcaaagacttcagttgggcacagtggctcatgtctgtaatcccagcactttggaaagctaaggcaggattgcttgagctcagggttcaggaccagcctgggaaacatggggagacctcgtctctacacaaaattaaaaaaaaaaaattagccaggtgtgatggtgcatgcttgcagtcccatgtactcaggaggctgaggtgggaggactgcttgagcacaagaggccaaggctacagtgagctgtgatcatgccactgcactccggcctgggtgaaagagcaagaccctattcttgtaagtaagtaagtaaaataaataaataaaaactactctaccaaagatacagttaatagtatgaaaagacatagcaacatcccatctcaaaaataaataaataaataaatgaaatcttctgctctgccaaagacaatgttattattaatagtatgaaaagaataatattcttttaatattatgaaataatattaatagtatgaaaagaaaagccacagactgtaagaaaatacttgcaaaacaaaactgaaaatcagaaatataaaggactcctaaaacctatcaataagaaaacaaataacccaaattaaaaatgggcataagacacctcaccaaacatatatagatgaaaaagaagtgtatgaaaagatgctcaacagcatatgtcattagagaattacaagtacaaacaatgagacaccaatatatacctattagaatggttaaaataaaaagtttcttaaatttaaaaatttaaaaatttgaaatttaaaaacatttcacatagccctcttgtgaaaactacccaaaataacagtgaattcaaatgcaaagaaaaaccataataaaaaactcaagaatgaagaaatagtgattatagaagctgagtatgaggactaaaacaaattaaacatagatttgaaactaaaaaattactgcaaatatgattatatataaatgtgacaatttgtgaaatattgaaagaaattacctagatctaaattctcaatttatattaaacaatacttcagatgtgataacagtaaaatcctaacgtactcatcttaataatgtaatttcaatatacattgcttaaatgttaaaaaaaattttgcttctcatccatttttttaaagtacattggtcaaaaattgaaatttattgtatataatacatgagaacagattttacacagactacttagcattgaaattaattgctttcaaaagttaacacccataatttgtctcctatattgcataaaggatatcaaagaaaagagtaaagggaaataagtaagaatatctttttgaggtaactaagcaaatatgataaagagcaaaaggagacaagaatgatataagatgtgagcatgcactgaaaaactgtgtaagttagggttaaacaaatagtaatgatgtaggaaaaataaaaagaatgcatgatatgatagttccctaacctataacaaagggaaaaaccctaccgtgcagtgttgatgtaaagaataaatgagagaacacaataaaaagacacatagtacatgctcaatacatgctattttctttttccactggaaatctctacttctttaaggacaaaagaccatgttggaacaaacatcaattgacaatttttcactaggaggacaaataagggggaaaaaggtctgctacactcaaatataccaccctaagtttataaagttttacatgtcttctgtgattaaaaaagaaaaaaacaaaaaagtaaaacattacaaaataatgaaaagtattttcagtattacataaaataagatttatatatgaatttatttattcttatataaaataagaatcatcacatgccaacaaacaccagaaatcaacagcttttaccatagtttttcctgatcctcggggtccgataataaggacagagttactctctccatggagagcagttcttttcagcagctcacttaagtgtctaaaatgatataaataggacaaaattttaaaaatgaagctggaatactttgttatgttgtagtttttaaaaggcatatttgaatatgcacagaaatttcctctcttctctccctctgggtacttggcctagcttctgaatggtcctaaatagaaaaatacaaaagaaatagtagggcagtattgattctctgaaatcttcaggtgaaaacgtagtcagattggaatatattgatttatacgatagtaggggacaagggacaatagtggcaactctcgggacccttggattcaaatctcttttcctactaatactctggacttttactccatagctggctgctgggtattaagggcaagatggctagaattctctccacagtatcagataacagaaacaaaacaaaattgaaagttaaagtgctattgcattatggaaatatttgtatctgctcctgcttcatgctatgtggtgtttctattcacaaagcaaaattttttatttctataaaagtgtttgttagctttatttaatatcaaatttgtacaataatttttgcaaaacctggaaggcatctgtaagtaggtccataacagtcaagaggacagctagacttacttgtattgtacttgcactccaaataggttactatgtggactctgacgacaaaatctttcacgtaaaattctttgtacctgatgaaaataaagtgaataaatataaataaaaatattacacatgatataaaaaataaataagaaagcacatttacaatagtcagaattaggtattaatgaatcaattcaaccctccctaaattcttatcctctagagttctggcaccattttcatatgttaaaaaattaatggatttcttacctatctcaagtcccataggaagaatgagaatttagttgtgaaggtttcaacaagagggagaatcactgactttagctatattagcaacttaagggccattgtaatgcatgtgaacgagttaagaaaagaattcttgtaagcagctatattttgaggtcatcttagaactaaggccttagacttagtcatgaaaaattatgtcagataatctaccatactctttaaaaagatggaccattaaagtcgttccttttttggatctgcagctaatacagaggtctttcaaggacaacaacctgagggtgctatctcagatttggccccatgaactggaataaaaaggctccaagaatatttgcttctcctagactgacagcatggaactaatccttcatgtaccaaagaagtaaatctgagttcttgttccatgtacagaggcaaagcaaagaaaatgattcattagggacaaaacaatacatacttgttcattatcgaggaagttaaagagtaaggacattggctccagaagagtctattatatgaattttaaaaggttaagtctgttctaaattttaatttctgtatctataaaatagggacaataacatcttatggcaggcctgtttgaaagattaaaaaagggggctggccgctgtggctcacgtctgtaatcccaacactttgggaggtcgagatgggcagatcgcttgaggttaggagttcaagaccagcctggccaacatggttgaaatcccttctctaataaaaattcaaaaattagccagacgtggtggtggatgcctgtaataccagctacttgggaggctgaggcaggagaattgcttgaacccaggaggcagaggttgcagtgagccaagactgcaccactgcactccagctggggcaacagagcaagacttggtctcaaaaaaaaaaaaaggtttaaaaaaggcaattatttgtaacacaaataggctttgtacaggtaatagctaatatctgtaaaaatacataaaagaacatatatatgcctcaactaatcataatgtgtattcctctacctagatgagatcaaaagaaaaaactcaatcttttccttaaaaaaaaaaaaaaaaaaacccagaaaacctcattaaaatatcttagaggcagtaacggggtataaaatataagctagataaagctacagtgactagtcagaaggttcacaaatctcaaagtgatctggcatagaagttaaataggtatacacatgtattgatattaagtcagctgtacatggaggattcgtgcactttacatacaaaggtatgtaaagcatatttcagttaaaaatttttttagaaagagagttaaactacttccttcaaaaagaaagccaagtcgtataaaagaataccagtaacacttaatttttatttaaaaactacatggagttcaggtcaagctagataaatacaaatgccagggtagaaataccatgctcatttccctactaatctataagcttcttaaggaagagacatacagatagatgctcagcacttggaatacaatatacacttcttataacattcattataaaaacactcaacagatgaggaaacgtaacggaacttcctcaacttaataaagggcatctacaaaaaaatcctacagttaacatcatatataacagtgacagactgaatgctgctgtttctctaagatgaaaacatagacaagaatgtccattcttcccaatcctattcaacattttaaagaaagttcaagccagggcaattaggcaagaaaagggaaaaaaaaaaaaaggcatctagattggaaagaaaaaagtaaaagctagaattctgactacccagacttaataaggataaaattaaattacagtataaaacactaatattaaaaaaaatatatgaactgacaaaaagggcagagaacaatcataacaacaaaatctgttggtccacatttaattttgacagagtttggaaaattttgcttccagatgattgttcttacgaccttgtgctggcatctcgttaaggtctcgtactgatatctccctaaggttagaaagagtgattcttcctaaatgctaaagggaaaattcaggttaagaagataactatttctctgaacagctttacagggtaaaatatcttgagattaatgaaaatacatactaacctgtgaaaggcactctgtgtgaattaagctgttactctttgatttacgactgctcatttcaacaaattcaaatcctttaaaaaaattggcataaatattataaacgtagtgacttaaagagattacttaagaatttactgttctagaattaaaataaatacaagtttttaaaagtaaaaaatgctcaaaccctaagaccttcaaaatcttcgatggcttcattttgtctaagtacaggctgattcaacactctcataccacactttaggcacactttgttttactgtgctttgcagatggtgcattttttttttaaagtaaactgaaggtttgtagcaactctgtgtccaacaagtcgataggcaccatttttcaaacaccatgtccccattttgtgtctgtcagcattttttagcaataaggtattttcaaattaaggtatgtacattttttagacatgctactactgcacacttagtagactagtatactgtaaatataaattttatatgcactgagaaaagttttgggtgattcactttattgtgatatttgcttcactgcaatggtctggaactgaacctacaatacctccaggcctgtatgtggttcttacagctactcctccctttcgattaaatcttctattcaccttccctttcttcctttttctttttttaacttacatgcttcctttatgattctcccacccatccatcccacaggatcatcccttatagaaaaccttccctttcttgctccactcaccaacaatacacaaataatcattacagactaggttaaatgcctcttccttaaacactcataagtgcctgtattttgctttattattgaattattttaaacaaaattgtctgtttaattgctactgtttccaaattgagattttttatattctaagcattgtagcataatgcccaaaacaaagttggcaatgaataactggaatgaaaaaaaaattaatgaaaaaattatattttttgtaaaattctcctcaagtgtaccatactcatagacaaatgactaaaagacctttgactaaaagacctaattttcttagcactgatttcctataggaataaattttaacagatagacagtaacagcttaagcagtgtttaggtatcaggaattgttacaaatgctttgcatttatcaactcatttaatcctcaaaactatcatgtggaataactactattataatcctcttttaaggttagaagacacagataggctaggtatgttgaccaaaatcaaacagtatataaatggaagagccaggatttggatccaaccaagttaaccacttttttaaaaaagtgtattctggtctcatctaatctccagaaggaacacagctttgctaacaccctgaatttagctcagtgaaagacattttggaacttttttactgccagaactcataaaactcaaaaaaagctgacttatcatcaaatcaccaatgattaacattataataatgcgagaatgacagcagcaagatgaaataggaggcccttcagcttgtgtccccaaatagcaacaataatttcacagccacccacggacaaaatggtctttgtgttagcgttgagattcaggcaggcgtctgtgaaaccccagtggggcccaagacctggaaaagtcaattggagggcagatcttcattcacgtgacagattccccaactgtggtccaggcttcagacttggaaagggccctgtcctcccgataggaccttgttaccaggggctgtagcaggatatgaaccctatctggtcccttggcggactggactttttctaggacctcggtctgtacagtggatgaagatatgcagagaaaagacctgttaccaggtgtgtggatggtttggctttctctgggaacctgggagggctcctactggatcactgagtagattccttaacaggcagtactgccctagtccacagctgagtggggctggaactaagctacagggttgcttcagggcctacagtcaagacttaggtcttcaggcctaaggtgtcacaaacctgcatgtctcccttcaggtccttaagttagcgggcctgctgtattgagaggggctggagccacttttcaggggtgtttcagggactgatgagggacctaggtcaggtggcctgtttgcagggctatggacagccccatctccctccaggatgctgggtaggcagaactgctctctgaccacagctgagaggggcttatgccaagattcagggttgtttcaggacctgctgtgggactgaaatctgcctgcctgtcctgaggacacagaaggatgtatctcctgactacaggaggatttctgtgcaggatttctgtaagactgtggctgagtggagctgaatccccgattcagagctttttcagcatatgctatgggacagagattggcaagtctgtactgatggcacagacaggtgagtctcctagcagttccttgtgcaggcagggttgctctcaggctgcaaccaacagtggcaggagctgagcttcagggctgtttcagtatttaatgcaggaccaagttcagaaagcttgacccagggattcagacagttttgtcttcttgtgggtccttgaactgatctcagaccatagccaagttaaagtgtcttatcagggtccgcagttgggactgaggacagtggacttattttctgaggtaccagtgtgcatgaattttcccaggcctcttggtgaacagtttcggtagcaggccaatatccttgatgaatataggtgcaaaaatcctcaacaaatactggcaaatctaattcaacagtacattagatcaattaccatgatcaagtgggatttatctttggaatgcaaagacggttcaacatatgtaaatctataaatgtgatataatgcattaacagaatgaaggacaaaaatcacatgactgactcaacagatacagaaaaagcttctaacagaattcaatattccttcaggtttaaaaactgtcaatatattaggtataaaaggaatatacttcaacacaataaaggccatatataacaaactcacagctaacatcacaccccaaaggtaaaaagttggaagctttccctctaagatcaagaacatgacaagaatgcccactttggccatttatattcaatatagtactgcaagtcctagccagaggaattaggtaagaaaaaataaataaaaggcatccaaatcaaaaaagagaaagttaaatggtctgtttgcagataacataattttatatagagaaaatccttaagactctaccaaaaaactgttagtactaatacatacagtaaagtggcaggatacaaaatcaacataaaaaaatcaataagatttctccacactaataactatttgataaaattaaaaaccagtcctaattacaatagcatcaaaaacaaattagaaagaaatgtaacaaaagaggtgaaaggtctgtcactgaaaactatacaatattgatgaaagaaagtgaagacacaaataaatggaaatatactccatgttcatggactgaaagaatcaatgttattaaaatgtccctactactggaagtgaaggttcaaagtaatccatatcaaaattctaatgacatttttcatagaaatagaaaaaaatcctaaaattcatatggacccacagagacatttaatagctaagacaatcatgagctaaagaacaatgctggaggtatcagactacctgatttcaatacctagtgcaaaactaagataattcaaaacaacatggttctggcataaaaacaaacatacagaccccagaatacagagtcgagaaataaatccatacttttacagttgacttatgttcaacaaaagtgccaagaacacacaacggagtaaggacagtctcttcaagaaatggtgttaggaaaactggatatccacaggcagaagaatgaaattgaacccttattgcacaccatatacaaagatcaactaaaaatggattaaagacaaacataagacctgaaacataggggaagaaaacacagggggaaagctttttgacactggactcggcaaagatttttttgggatatgactccaaaagcagaagcaagaataatgaaaacagacataaaactaaaaagcttcaatcaacagagtgaagagacaaccttcagaataagtgaaactatttgcaaatcttacatctgctaacaggttaaaatccaaaatatgtagtcgctcctcatcagcagattcaaccaacttaagagagagaaaatttagaggggaaaaaaaatgcaacaataaaaattaatataaattttaaaaacaatacattataatagctatttacaaagcacttacattgtattagaaattataagtaatctagtgatgatttaaagaatatgggatatgtgtaggttatacgctaataccatgccaatttatagaaaggacttgagcatctacagattttggtatctcaggggagtcctggaaccagtttcccgtggatacagagggatgactgtataaggaactaaaaaaaacaaaaacaaaaacaacaacaaaaaaaacttaatagcaaggaaacaacccaatttaaaaaatggtcaaaaagatttctcacaggacataaaaatgtcaaataggtatttgagaaaattctcagtgttactaattgtcagggattttcagggaagtacaaacaaaaccacaatgagataacatttcacacctgctaggaaggctattgtcaaaaaaaggcaaaagatgatgagtgttgttgaggattatgaagaaaggaaactcttgtacactgttggtaaaaatgtaaattagtataatcattatggaaaacagtatggaggttcttgaaaaaattagaagtcaaattacatgaccggtaatcccactcctgaatatccatcaatatatacaaaggaaatgaaatcaatatgtcaaagatatatcctcactcccatatacactccagcattattcacagccaaaatacggaatcaacctaagtgtccatcaatggatgaaaagataaagaagatgtggtatatatacacaatagaacactaactcagccttaaacaaaaaagaaatcctgtcatttgcagcaacatagatgcatttgggagatattctgttagctgaaataagccaggcacagaaagacaaacaccacataatctaatttatacagtagtctctccttatccatgggagatgaattccaaggcgcccctcgcatgtctgaaatcatggatagtacccaactctctctatatactatgttcttttaatctgataacctagatggctactgagtgattatgggacacatgcaatacacagcatggatacgctggacgaagaaattatgtatgtcccaggcaagacagagcaggacactgcaagatttcatcacattactcagagtggcatgcaatttaaaactcatgaattatttatttctggagttttccatttaatattttggaacttcagctgaccaaaagtaactgaaacaatggaaagtgaaactgaggataagggagggactacaataggtggaacctctaacaggggaactcatagaatgaaagcagattttaaattttcttactacaaaaaaatggtatgtgaggtaacagatatattaataggcttaattttgtcattccacaatgtatacctatattaaaacattatgctgtataccataaatggataagatttttattcatcaattagaaaaaaaacatataaaatatacatcaaaaagcaagtaagtgcagagccaggatttgaatgatttgaacccaaataagttgtactcttatgaaattgttacgtatttagcaaacttttttgaaaaaagaagtacaaacacatttcaataacctgaaggaagatcagccaatatattttacattcacatttattaatttcatatagtgacaattagaaagcaaaccatggtaatgctgttttcttctctagaaatgttaacaggtccttagctgagccaggccttgacagacagacagcaagcaaatctgtgtcctccttaatgtgtaagccaggtagctaaggcctcagccaccaaaagtcctctggctccaggcttcctaattgaaaattaaataacagagtactcaattattgtcttgacccttaagcatcttctttcttagaagaaaagtggtcttctcagctgtcttaggataccttctagcagtcttttatatctaaagttttatcttattctattttttatttttcctaatcagtgttatgagagggaaaaacctttttagctaataaaatatcctcaactctggtttatgatgctcttgactatcagccaaaatctaaaatcacaaagaactatgtaataattgtctcctagattataagactaattaaaatgtaaaaaggagaaagggcttttgcagtatgttttattttgtagaactacattagctatcttacagtattgttagaattaaaagatattttttacccacttcatgaattaagaaagaattactcaaaaaagctaaataaatgtccacagttccaaggcaggtatctaatctgcccctttgcatcatatataaatcaggtaagctattaagataattcattttttcttcatgtggggccagcattcataaaagaaacaacaaacatgccactatggtatctaccttataacctacataaattttgactgtaaataaagttttagtccaaaggttattttgacatcttcccccttcatgtaatggtcaaatatctactatataataaagaatatttcaaagacaattctaatagtacagatgagacaagcttcagactgggagaaaatacctgcaaaccacatatctgacaaaagatctgtatctaaagaaccctcaacactcaataataaaaaaggaatcccattagaaaataggcaaaatacataagtagacatttcaccaaagatatgcaggtggcaaataagcatatgcaaagatgtttaatatcattatccgctaggaaaatgcaaagtaaaaccatagtaagataccaccacacactgattaaggcagctaaaataacacaaagatggtgaggatgtaaagaaaatgaatctttcatttaaccactggtgggaatgtataatggcatggctactctgaaaagtttcttgacagcagtttcttagaaaactacaaatactcttaccaagccacatagcaattgcactcttgggtacttacctgacagaaaaacttatgttcacacaaaaacctgtaacacgtatgttcatgataaatttattcgtaatagtcaaaacactggaaccgattcactcaatgagccaatggggttaatgaattagttccactgatgctttgtcactgaagtcaggaagtacccagacagtaagggactgccttttgaagttcttctgatattggacaatgcccctggctacccagaatcccatgagttcaacaccgaaggcttttgtccaagtggtccactggtccccaaacacaaactctctaattcagcctgtagatcagggggtcatagggacctttaaggttcattacacacagaactctatggaaacgaatgtcaacactatggaaaaacctccacagacagaacatgatgaaagtctgggaggattatcccattgaagatgccctgttgtcatagaaaaagccatgaaagccaacaagactgaaacaaatttctgctgaagaaatctatgtccagatgttgtgcatgacttcacaggatttactacaaagccaatcaagaaaatcatgaaagagattgtagacacggcaaaaagggtggggagtgatgtgtttcaacatatgggtcttagagaaattcaagagctaacagataccacaccagaggaattaacagaagacaaggtggagatagatgcttctgaaccactgccagacagtgagaaagatgcagaacagtgccagaaaacaaactgacattagacaatctggcagaacggttctgaatatacaagactactcttgacttcttttacgacatggacccttctatgatacaggtactggaatcaaagcaaatggttgaggaagggttgatactgtatagaaacattttaaaagaaattagaaaccaaaagagatagacagaaattacctgtttagttacacccagtgtgcctaacctgtcttgtctccccttctacctcctccacctcttctacccctaggcaacaagatcaacccctcctcttcctcctcagcctactcaacaggaagacaagtaggatgcagacctttacaatgagccacttcaacttaatgaatagtaaatatattttctatatatagtagatatattttctaaatatcttttctttaccttactttattataataatacaatatataatacatacataaaatatatattaattgactatgttaccagcaaggcttccagtcaagtaggctattaacagttaagtttttggggaggcaaaagttatatgcagattttcaactgcttttggtagggagggggtgtttcgacccctaacccttacattgttcaagagtcaactgcgtatggaggaaattctcattactgcagttccagagcactactatacatcagagagctactgaccattttaaatttacttctgtattgacaaaggacaaaaattataggaattgtaaaaatgtgtcatctaaagctgtctgctctctaaattgcctatgtgcatttccccatgacagtaagtcccctacaatctatacctttacaaaggaagggatgaattctgaaatatattcactgaccactacttactgtatctgtatttgaaattttatagttacatgctaactaaagcaggatgactaaataatctcaagactcaatcacatgtatattcatactcccatttttcaactgaggtggcttatttattgtaattctccattcctatgctttccaagggttgcttgttgataaattctaaaaattatgaagtacatcctttactgctcttgaggtttcatgagtacttataactcttctttctcatgatgccttcctcagatccaaaccctcactcagagcctctttgtctaccacactgattctgcataatgtattttagactaactctgtttggccaacaataatgataactattcagtaaactctctgttttttttgtttttttgtttttttgagacagagtctcgctctgttgcccaggctggagtgcagtggcgctatctcggctcactgcaagctccacctcccgggttcacaccattctcctccctcagcctcctgagtagctgggactacaggcgcctgccaccatgcccggctaattttttgtatttttagtagagacggggtttcaccatgttagccaggatagtctcgatttcctgacctcgtgatccgcctgcctcggcctcccaaggtgctgggattacaggcgtgagccaccgtgcccagccttagtaaactctcttaacatctaaagacagaattagaaaatagctgacactaacaacttattcctacatatagctcaatagccattcagatgtcaaatgttttcctaccttagaaatagaacataaaagccctccatttagtttgcacaactaacttaagctcctcatcttaggttagttctaatcactgttttttagactaacataatcctaaactttgtgggagaagcaacctggatgaactcctggtgacagtccttcatgtcaaatttgaagtttggtcaatttaccaaatacctctctgcttgctgactagcaatggtatacaatgacctgcccaagatgacatagcttacttaacagcagcagtagctgttaggtctattgactcccaatcagaggttggttagtctcaactggcatgaaaaaaaaccctgcaaacatcagaaagttcatcaaaatcatcactgggcttttctttaggagacaaaacatagcagaggaatacattctgaaagaacacggttattataacagatgttcaataccaacaattcacttctctttgaatgtctatgtgtacaatttgtatttttttctgtacacatctttatttttaagatcataaactttcttcccatcgctaaaaaggaatacatgtttcgtacagaaactctggaattttaattaggaattgtgcagataaaatggtaaaaaatggaatcagagaatctttctcctctaataaaacaaaacaaaaaactgttaaacagaaatactttagcagtaactaaacaaagagacaagttaataataaacaagcctagaaaattctacaggagttctccatagttcctaactttaacctcactcttaaaagctatacttgcatcaataaaatctcctaaactctcatcaatgtatcaaatatgaaaagaagaaaactgataaaaactgtaattcaattattaaatttcaagcctaaaaaaaagaattcactgggactcagcctgaaaaacacctacaagggagaaaaaaatgctaaaatatggtgtcataatatctacaaagttctgagagagagaccaagactcatacctagcaaagatgtcactcacatataaaggtaacaggtatagccttatcaaataagaatgaacttatttagtacacagagccaataaagccttgtgtggagtgtgtgtgttgcaggaggatatggggaactcaatgacaaaatccagccaactaaagcataattaaaaacacaattttatacagacacacacacacatacacacacacacacacacacacactagtgacctttgaatccactaaaataaaaaactaaaaccaaaaaaaggtaaataattatagtagcaggtggaaacataagtcgttacacagtgaaaataatcattcaacaaaaaaatgaaaaaaaagtggcatgaatgcatacggttgctaatttcattcttcagagtagaaagaaaatgtctaaacttaaaacatgaagtgtaaaaaaggaacttaaaactattttttttttagacccagggtctcactgtattgcacaagctggatttgaattcctgggctcaagagatccttccgtctcagcctcctaagtagctgggtcaacaccttgagcagcttgaaactttttttaacctaagattgagatctttaaaaaaaaaaaaatctcttgggtttaataaatatctaaagtccagcaattcctataatttttattaggttaaaaatgtggcctgcctacacacacacatactttttcaaccaaaatgggctctatttcataatatttgtcatttaaaagaacaagaactttccatatatagatatatatatgtgtgtgtgtgtgtgtatatatatacacacacacacacacacacaaaaagtaacatattttaaattattttttctacagctaccataaggtaaaaaacaaaaataagaattagtggatcaaattgtttaagaaaaagaaccatgtacctcagctggataatcaaaagtactctagtattatgagcatcttactagtaattacgacgccaggagctgtaacactgtgtacccaaaaaaaagcatttaaggagaaaacaggtgtgaacatgtccgatttatttagtttcaaagttgtccaagcacaggtcaaagaggtaacaacaaacaatttttcctatctttcatataaatggtcagtaaggtggctggtgcaaaataaccctctggaataagaaagtattgtaggctgggcacagtggctcccacctgtaatcccagcactttgggaggccgaggcgggcagatcatgaggtgaggagatcgagaccatcctggctaacatgatgaaaccccatctctactaaaaatacaaaaaattagccaggtgtggtggccggcgcctatagtcccagctacttgggaggcttaggcaggagaatggtgtgaacccgggaggcggagcttgcagtgagccaagatagagccactgcactccagcctgggcaacagagcgagactctgtctcaaaaaaaaaaaaaaaagaaagtattgtaatatgtttacctataaatatctatccaaaaaataagagctaaattaaacttaactaatatttaatatatacattgacaaattttacttggtctctgtatcagcaggtcaagtcatgttactcaacccagacgccctaaggaaagggaagagttcaagatcaataacaagaaggggttccgagtggcaccatcacatattcatttactgtcagctcattaatacacaatgtaggtatatgaatccagtttggagacattactgaatccagctgacttactgaatttttttttttttttgagacagaatctcgctctgtcgccctggtgggagtgcaaggttgcaatcttggctcactgcaacctccgcctcctgggttcaagctattctcctgcctcaggagataggagctgggattacaggcatgtgccaccatgcctggctaatttttgcatttttagtagagatgggggtttcaccatgttggccaggctggtctcgaactcctgacctcaagtgatccacccaccttggcctcagttgggattacaggcctgaatcaccacgcccagcctcacttgctgaatttaaagatgttattatttttaaaatgtaagtgaaataatctcagctgttccaactgcagctttttcctggaatgaaaaatggctgcctgtcaacagcatgctgcttagtaaataaaaaacaaaaagcaaaaaaaaaaaaaagatttacttcatctggaattttaaaataaaagtaggaaagaaactgctttttagaagaaatttgtgttatagggcattttgaaaatgtttccaacactgattttatagccaaaaattaggtgttacctataaaaattctcatatctatacacttaaaacatttataaacataactttttattctattcacaaatatttctgtaaataatgtaagttttatatgtgttgacctaaaaggaaagaagttgaggcaaaattaataacatacatagagagttcatttgagccaagcttgagggttgcaaccaaggagcataaattcaagttgccctgaatatgctcattagcagcagtaacaagtagatttttaaagagaaaaagaaaaataaaaaggcacgctctgagttgttcaccaagaatctacattaaaataacaaactatccattggctacagagtggcagggggtagggagttggggtggagtatgggggcataactgaagtcccatactactcacatctctctgggcctgcatacctcagagctcagactgttctgagcattttttgttttctcatacccatttgttaaaaatataaaaacataccacttttcggctgggcgcagtggctcacacctgttataccagcactttgggagactgaggtgggcagatcacttgaggtcaggagtttgagacgagcctggccaacatggtgaaactccatctctactaaaaatacaaaaattagccaggtgtggtggcacgtgcctgtaatcccagctactcaggagacttgaggcaggagaactgcttgaacccaggaggcggaggttgcagtgagccaagatcgccaacactgcactcccaccagggcaatagggcgagactcatctcaaaaacaacaacaataggaacaacaacaacaagaaacaaaaaccatgcaccactttccaagaacactaatttatatcaagtttttcttagtttggaataagaactaacacatcaagagaagatgaaattggctaacaactcctacaaaaaccttggtaaaattagtggatgagactagaaaatataattcaaaaatacacaaatgatcatgtattattttctctaatacccttactttgaggcaaaaccttacagctccagcagatgggggcattactttgtgaaaagaactcttagtaaattaaaaagatgtttaatactgctttctttccagatggtggcagaagaaaacaccgaaaacaataccactaccccactccctttattagaaaaaagttaaaatacaaattctattactgtttacctaggacctaacttcacacggctgacatttctcaaagataggtaagtatggacaaaatttcagaactttgcctctcttcagttcgataaaatgttcttgatttgctagctaaacagtcaaataacgtaaaatgaaaggtattttaggagaaatttgaaggtggtttccatgttttgttactgtcctttgagatgaaactgaggcaagaaaaatacatttaagctgtttttcagtccatcagaattagttttcattcttttttctcccccagttggattgtttgtacagaggtaaagattaaaatagagttaaaagaatggttgagtgtggggagaaataagggccaatactgatatatattccaagttagaaaataagtaaactctgttagttcttcctaaagagatcagctcaaaaatgctatctatatcaagttggggcacagcctctggtgagatgtttccttgagttctccagagctgaagaataattccacacaaatcaacttttggaccacaggtgaataaaccatggtaattactgacagttttgtaaaatctttttttcctcctcatttgttgccagtgaatattaaaaggacacaatttacttaaggacacattcagattaaatgattccaaggtttgataacctttagttaagtaatatgatgccatgatattttctcattgatattaaaatgaagaaaaatattttataatgtcttggtacttaaactgattaaataattgaaaaggcttgcaattctccagaaaagccatgttctctctaacctctgaatttcagtaatcttcactagtacatggcagtatgtctggaatcatatatacacagacacacacaaccacacatacatatatatacacacatatgaatataaacgtatatacatatatatcttttttttttttttttgagctggactttcactctgtcgcctggctggagtgcagtggcaccatctcagctcactgcaacctccacctccagggttcaagcgattctcctgcctcagcctcctgagtagctgggattacaggcatgcgccaccacgctcggctaatttttgtatttttagtagagatggggtttcaccatattggccaggctggtctcgaactcctgacctggtgatccgcccacctcagcctcccaaagtgctgctgggattacaggcgtgagccactgcaccccatacatatatatcttttaataagtgtacttactttataaagtacctattagagccttgatattcatgaataagccaataaagttgttttcaagaacatgggaggtaaatagttatgaaataaacaacccccagaaggataatcagagagttaatactatgatatgttcagtaaagaaagacatttagaaattactacagttggccgggcatggtggctcacacctgtaatcccagcactttgggaggctgaggcgggtggatcacctgagttcaggagtttgagaccagactagacaacatggtgaaaccccgtctctactaaaaatacaaaattagccaggtgtcgtggtgcgtacctgtaatcccagatactcgggaagctgagacaggagaatcgcttgaaccggggaggcggaggctgcagtaagcggagattgcaccactgcactccaaccagggcaagacagagcaagactccgtctcacaaaatgaaaaaaagacattactacagttgttttgattattaaccatggaatacaccttgtaaatgatacaaagtatcaattctgcagtagtgttgatgaatgaataaaaaagaaatactagttggaggacttctttaaagtatacgtcttaaaatgcatttacttctgaattatataggctaacaaaagaactaacacaaatttgcaacgtatttagaaatcctttagaagctttggaaatgcattatatgatcttactggcactgacataactacatcttaaatattatagtgatcaacagtagtctatgttctctgagcacatggaagtaggctaccttcaggatttaagcttgtgaatccaagctaatgtgtttaattggatggataaatagtataagggcgacagacacttgaatcaacgaaaacttttttttgtttttggtttaagagatggggcttccctctgtcaactagggcagtggcacgataatagctcactgaagtcatgaactcctggcctcaagcaatcctcctgactcagcctcctaaatagctgggattacaagtgtgaggtactgcccctgacaaaaatatcatttttgtgaaggatggttgcattatatgggacacaagatttaagactagggcactaaaattggtgggtgagaaggcacatgtagacaaattttccttgaaaagccccaaactacacataaattacagaactgtactttcttgcaatatcaattacttcagggtatatgttcatttgagaagaataatgaatagaatactgtccactattcaaataaatttttcctttgccacgtttacagacttgagtttacttaaatgtaagtatgatactgctagggctaaggaaatgatactccaaaataaagtcctccaaagcagctctctctgaccatctcctaacttcctgtctctggcctctcattctcctgaggctagccactgaaactaccatccctcgtccccaaggtagtccacagaaaccagaactccctttccccaaagccagccacagaacctaaatatattactctaatgttccctgccctcatctttctgtgtaaaaactaactataaagacatatctgacctattctgtttgattgtaggtcataggatccccattccagaaagggtgctgttccatacccggaaggaaagaatgctgcacagagaggccaagaagaatctatacagacaggcaggccttgctgggtttccccactcagtatatggctgtccagactttgctgaacctaagcataccaatgggcagttttctcctatatctttaggtctttattctgaaggctcccatgtcacgtaacaccaagatcaaataaaatcatatgccctttctcctattaatctgccttttttcagctgattttcaaagaaccttcagaggctgaaagggaagttttttcttggcccctacaatatgctacaactccagtaagttaattagtaaatattaaactatttttggaaggaaaaaaaactgaaaataacattgctttagagataaattatttaagaattgctagaaattaccctagaaattatcctagaaaaatcttaaaattttccctaaaaacttttaggaataatacattgtttctaatgagacccttcagcttatgcaaaaagcacaggagactaaattctagagtcaacgaaacgatattctccaattctgttttgctaatgaatatgttgtccatccccccatcagcatgcttaggtaatcttgcaaggataaatggaaatgtcagttgacatttacaatgaaataggatttttagacagttgtgctttttgggtgggaaaaggagagctaaaaattagggggttgggggcttaaaaaagacagcattatatggcttagaactttggtaccctaccttcatccttttctgcaatcccttttactccccaaagttaaaaggctatcaatgggacaataattgatgatcaactatgaagaaataggctcaaatacactgttttattatatttttatcattctttatataccttttctcatcattctttgtcccaatagtatgctatgattatgcacgtagaaaatcccaaaataacaacaaaatcactggaactaataaactactgtagaaaggttgcaggatacaaggttaatatacaaattgtcaacttccttcctatgtatcagtaatgaacaactgaaattagaaattaaaataataccatatacattagcaacaacaacaaaaaacattcaccaaaaatgtagatataaatctaacaaaatatgtacaagatctctatgaggatcactataaaactctgattcaagaaatcaaagaaagtctaaataaatgagatcattcaagagtagaaaaaaattcgtattgttaaatgtcagttcttccaaccttgatctataaattcaatgcaatcccaatcaaaattctggatagttattttgtggatatgacaaactgattttaaagtatacacagaaagacccaggagaaccaacacgataccgaaggagaacaaagttggaggacaaaacctacccaacttcaagacattataaaactatactaatcaatacagtgtgataatggtgaaagaacagacaaatcaagggaacaaaacagagcccagaaataggcccacataaacatagtcagctggtcttttacgaataagcaaaggcaattcaatggagaaaagaacaatctttgcaacaaatggtaatggaaaaactagacatacacatgccaaaacatgaattgacacagaccttacaagtttcacacacaaaaaatctaaaaatggatcacagacctaaatataaaatgcaaaactataaaactccaaaaatggccgagcacagtggctcacgcctctaatcccagcactctgggacaccaaggcaggtggatcacctgaggtcaggagttcgaaaccagcccgaccaacatggtgaaaccctgtctctactaaaaatacaaaaattagctgggcattgtggcaggctcctgtaatcccagctacttggtgacaggtgaagccagctggacttcctgggtcgagtggggacttggacaacttttctgtctagctagaggactgtaaatgcaccaatcagcactcaataaaaaaacgcaccactcagcgctctgtggattaaaggattgtaaatgcaccaatcagcactctataaaaacgcaccaatcagcgctctgtgtctaaaggactgtaaatgcaccaatcagcactctgtaaaaatgcaccactcagcattctgtgtctagctaaaggattgtaaatgcaccaatcagcactctataaaaacgcaccaatcagcactctgtgtctaaagtattgtaaatgcaccaatcagcactctggtctagctaaaggattgtaaatgcaccaatcagcactgtgtaaaaacgcaccactcagcgctctgtaaaatggaccaatcagcaggatgtgtgtggggccaaataagggaataaaagttggcatggaccaatcagcaggatgtgcgtggggccaaataagggaataaaagctggccacccgagtcagcagtggcaacctgctggggtccccttccacgctgtggaagctttgttctttcgctcttcacaatagatcttgctgctgctcactctttgggtccgcactgcctttatgagctgtaacactcaccaggagggtctgcggcttcattcctcaagtgagcaagacacaaacccactgggaggaacaaacaactccagacgcgccacctttaagagctgtaacactcactgcgaaggtccgctgcttcactcccgaagttagcgagaccacgaacccaatggaaggaagaaactccggacacatctgaacatctgaacaaacaaactccagacacaccatctttaagagctttaacattcactgcgagggtctgcggcttcattcttgaagtcagcgagacgaagaacccaatggaaggaataaattccagacacatcgggaagctgaagcaggagaatcgcttgaacccaggaggcagaggttgcagtgagccgagatcacgccattgcactccagcctgggcgacagagcaagactccatctcaaaaaaaaaaaaaacaaaaaacaggccaggtgcggtggcttacgcctgtaatcccagtgctttgggaggcagaggctggtggaccatgaggtcaagagatccgagaccatcctggccaatgtggtgaaaccccgtctctactaaaaattcaaaaattagctgggcatggtggtgtgtgcctgtagttccagctacttgggaggctgaggcaggagaaccacttgaacccgggaggtggaagttgtagtgagccaagattgtgccactgcactcaagcctggtgacagagtgagactccatctcaaaaaacaaacaaacaaacaaacaaaattccaaaaatgtaacacaaaagaaaatctaggtgaccttggttatggccatgtgtttttagatacaacaccgaaagtacaatccatgaaagaaaataaaaaattgatttagacttcattaaaattaaaaacttctgctctaccaaatggcactactaagaaaattaaaacacaaaatacacatggggataaaatatgtgaaaaacacttattttgttacacaaaatatacaaagaactcaacaaggaaataacccagtttaaaattggcatccaaataaacatctcaccaaataagatacagaggtggcaaataagcatatgaaaagatgctcaacatcatatgtcaatagggaattacataatcaaacaatgagataccattgcacacctattacaatggctaaatccaaaacaatgacaataccaaatactagtgagaaggtagagcaatgggaactctcattcatggctcatggaaaagcaaaatggcacagacactttggaaaacagtttggcagcttcttataaaactaaacatatttgttttacataatctagcaatcatgtaccctggttacacccaaatgagttgaagacaggtccacacaaagacctgtaccttcctgtttacagcagttttatttataattgccaaaacttggaagtaagcaagagtgtccttcaatatgtgaatggataaaccaactgtggtacatccatacaatggaatcttactcagcatgtaaaagaaataaagccatgaaaagacatgaaggaaacttagatgtatactgctaagtgaaagaagccaatctgaagagactacctactgtatgtttccaactatatgatattctggaataggcaaaactacagaaatagatgttttagtgatcttttcactaaaagatcagtggttgtcaagaaaagagaagtatggaacatgagatttttagggcaattaaattattctgaatgatactgtaataatggatcattatatatttatcaaaatccatagaatgtacaaaacaaagaatgaatttattcatatgtttgtcgtttttaaagaaataagacatttcaagaacatttatataccaaagtaagaaaattttttatatcttatctttctttgtcaacaccaatcatcacactattcaagagcataattcctaatggttgagaagagactcttgcaatataaagcaaacaaacatattgttattttgtaagtatttaatataatgaaaacatgttatctatgattatttcttctcaaagtacatgacaaagctctatgatctcatgctgccattaaatgtataaaaacatagcttaaaaagactaatattacacatattagcatcttggaattatttctgggtgcaaaggttataggtaattttcattttttaatcacttttatactgaatgtatattatgtttgtaactttaaaaattttcttgcacatttaaatcaaatcttgtactttacaatttgaatatataaatttctaagtgtaaattatgatgctaaaattctattttaacttttaaacatgttacaaacataaaatgtgttttaacataaaattttaaaaacatgatgctcaccagatattgcagcagtgttggtataacatgctggacataattaaaaaaacaccaaagtctaatggatattagctgaaacccagctttttagggaaaatagttttggtatttactcattataaagtaagttgactgagacataaacaaaccatacaagtggtcatattaagagtgcatttaagactgacatgtctgggttatctgtattagatatttttgtaaacaatacaaaaaagaaacaaaggagaaagtgaaaatgtgcaagtgaaaagccaacagatcagaacttaattcttgaaaaagtctgacctcactttggtcatgctataatttggatttggtttctttatcaccaccaaagctaatgtggaaatttgaaccccagcgtggcaatattgaaaggtgaggcctagagggaggtgtctgggttctacgggtagatgcctcataaatggctcagtgctattctggagttagtgtgttctggctctcatgagactggattagttctctggcgaatggcttagttccttcccacaagagtgggttgttataaggccactatgcactcctcagattttcctctctttgaatgtttctttttctcctttgaccttgtccaccgtgttgtgaagtatgaaagatcttgccagaagccaggtctatgctcttgaacttctcagtctgcagaactgtgagctataaaacctcatatctttataaattacccagtcttaggtattcttttatagcaatacaaaacagactaaggcaggtcaaaatttcacactattctcaattcccctattaatcaaaaaagtagtataggactaagaatttgttatgttttattggaggtgaggagagatatgggagaatataagataaaggttaaaaagagattaggaaaaggtagcaaccccaaagcatgtttaagatcagtgctttgagcaagatcaggaatgaaaagagagaataaaacagaaatgaaaggatgggaacagctgtcaattccaggtttcatctaccttttggtttataatcttcaactcatgtcttatttttctacttatgcatttagtaaaatatacaaagccatccagtctcgtcagctaatactctaaataatataaacatacaacaagttcactaaataactggtcttttaatttgggctagaattcaatgagaaaaccatttctaaaagacttgcagtgctaacatggctcaaattaaacagaagcctctaacccacttcatcagaggccatgaggcttattttctacacagggtaagacagaagaaatctaccctgaggacacaagacacagcagaaggtgagggtatcagacaaaaaggttttgagggggaggagaggattaagagagtgtttatatattgaacgttgaggccccctagctctcttctttcacatagttctcatactactggcaatcagacttataccctaaagcagggtttctcaggataacattttaaacttgattgttcttcgttgttggagctgtcctatgcactgtaggatgtaacaagacccccagattctatgcatcagttttcaggagcaacctatctgtggcaatcaaataagtctctagacactgctaaatttctcttagggggccaaattgtcccacttgagaatcactgacctaaaggcagaagcttggagaactcttcttattagactcttattaaccctagaaaaaaggtttccaaacttaaagataatgacaccaggggtttccacccacaaaatgcccagccatattcacagagctctaaaatagctttctaatgaatctaacataaatttgaacatgcaatcaatgattgctacatagctgaggaaagcctcgattaaaaagatgaaaacatattaacagaaagaataatttggaaaaagtagagaaagcaggaagcaataaatttcaaaaccaaacaataattttaattcataaaaagaaaacataacaggatataataagaaaattatacagagatcaaaaaaggccttggaaattaaaagtatgatagcagaaatcaaagtctcaaaagtttgaaaaaggtaaattttccagaaagtatgaagaaaaaaaaaacataaaaaatgacagaaaaaaaataggtccaggaggtagaatgtttaattagagttccagaaccaaaaacaaaggcaagaaaattaaagaaaaaacatgaggaattttcccagagttgatggacacaaattgtcagactgaaaggacccataaaatgcatggcaaaatgaaagactatagactcataataagtaacatggctgtgacatttcagaactctagatacaacaaagagaaacatttgataagtttcaaaatgagatcgtataatcttccacagaggagacaaaagtgatctgaagagtgatggaagtaagaagggcttctaattttacaacagatgctatgaattccttcaaagctcttaagaacaatttcacctttataatttgaaagccagctaaactaatagttggggtaaaataaagacacttatataaatataataccacagaacacttgcctttcagaaagctactagaaaatggaataaaccaagagaatacacaagccaaaggattacataggatataggaaacagaggaactagcataggatagagactgcaccagcagcaactatatcaagcaatgggctaaaactgcagcacataagaatgctctgggagaaatttcttgatgatggataaactgataaaaatacttgatacctctgaatatatggaaaggctgttttgacaaccagcagatagtttgggtctaaatgactaataaatatttagaactatacaaatgctcaatggtcgtatatgaaaaattaaactatcaatgggaagatggggggaatggatgggatgtttgtggaaaaaggctaaatctacatcacctatagtaagtcaagagataatgcctaaaactgaaaaaacaggaggtagcaatataaaatgttatttagagatacagaagtatataccaaaagaataagccaaaaaaagttttagaagtatttccctctatttggggaaaactggggtagtgacagctaccttgtccaacatcacagccttcctgggattaagcaaataaggcgataaaggcccaatcatttcgttgcaccatggtatcaatctgaaggaaaatattctggagaacctaacctgtgacaaagaagtaagaactgtttttaatcataagctatggagaagcagttaaaaacttaagcatgtgttcttttacctttgcaacagttaaaagaaaaagagaaagagaagaaacaggctgcttaaatatattttctaatttcattaacttggcttcttatactgcagagccgaatgttattttagaaatttaaagcccatcagactaacaacggatctctctgcaggagccctataagccagaagagagtaggggccaatagtcaacattcttaaagaaaagaattttcaacacagaatttcatatccagccaaactaagcttcataagtgaaggataaataaaatcctttatagacaagcaaatgctgacagattttgtcaccaccaggcctgccttacaagagctcctgaaggaagcactaaatatgtaaaggaaaaactggtaacagccactggaaaaacataccaaattgtaaagaccattgacactatgaagaaactacatcaactaacgggcaaaataaccagctagcatcataatgatagtaccaaattcacacataacaatattaaccttaaatgtaaatgggctaactggcccaattaaaagacacagactggcaaattggataaagagtcaagacccatcggtgtgctatattcaagagacccacctcacttgcaaagacacacaaaggttcaaaataaagggatggaggaatatttaccaagcaaatggaaagcaaaaaagagcaggggttgcaatcctagtctctgataaaacagactttaaaccaacaaagataaaaaaagacaaagaaggacattacataatgacaaagttatcaatgcaaaaagaagtgctaactatcctaaatatatatgcacccaataagggagcacccagattcataaagcaagttcttagagacctacaaagagacttagacccccccacaacaatagcagtgggagactttaacaccccactgtcaatattagacagatcaacaagacagaaaattaacaaggacactcaggacttgaactcagctatggaccaagtggacctaatagacatctacagaactctccaccccaaatcaacagaatatacattcttctcagcaccacatcgcacttattctaaaattgaccacataattggaagtaaaacactcctcaacaaaggcaaaagaatgaagtcataacaaacagtctcccagaccatagtgcaatcaaattagaactcaggattaagaaactcactcaaaactgcacaactatgtggaaactgaacaacctgctcctgaatgaatactgggtaaataacaaaattaaggcagaaataaatacattctttaaaaccaatgagaacaaagacacaatgtaccagaatctctgagacacagctaaagcagtgtgtagagggaaatttatagcactaaatgcccacagaagaaagcagaaaagatctaaaaccaacacccttacatcacaattaaaaaaactagagaagcaagagcaaacaaattcaaaagccagcagaagacaagaaataactaagaccagagcagaactgaaggagatagagacacaaaaaccccctcaaaaaaataaatgaatccaggagctgcttttttgaaaactttaacaaaataggtagaccgctagccagactaataaagaaaagagagaagaatcaaatagacacaataaaaaatgataaaggggatatcaccactgatcccacagaaatacaaactaccatcagagaatactataaacacttctacacaaataaactagaaaatctagaagaaatggatgaattcctggacacagacaccatcccaagactaaaccaggaagaagtcgaatccctaaatagaccaatagcaagttctgaaattgaggcagtaattaatagcctaccaaccaaaaaaaagcccaggaccagatggattcacagacaaattctaccagaggtacaaagcggagctggtaccattccttctgaaactattccaaataaaagaaaaagagggactcctctctaactcattttatgagtccagcatcatcctgataccaaaatctggcagagacacaacaaaaaaagaaaattccaggccaatatccctgatgaacatcaatgcaaaaatcctcaataaaatgctggcaaactgaatccagcagcacatcaaaaagtttatccaccatgatcaagttggcttcatccctgggatgcaaggctggttcaacatatgcaaatcaataaatgtaatccatcacataaacagaaccaatgagaaaaaccacgattatctcaatagatgtagaaaacgccttcgacaaaattcaacaccccttcatgctaaaaactctcaataaactaagaatcgatagaacgtatctcaaaataataagagctatttatgacaaacccacggccaatatcacactgaatgggcaaaaacaggaagcattccctttgaaaaccggcacaagaaaaggatgccctctctcaccactcctattcaacatagtattggaagttctggccagggcaatcaggcaagagaaagaaataaaaggtatttgaataggaagagaggaagtcaaattgtctgtttgcagatgacatgattgtatatttagaaaaccctgttgtctcagcccaaaatctccttgagctgataagcaatttcagcaaagtgtcaggatacaaaatcaatgtgcaaaaataacaagcattcctatataccaataatagacaaacagagagccaagtcatgagtgaactcccattcgcaattcctacaaagagaataaaatacataggaatacaacttataagggatgtgaaggaccgcttcaaggagaactacaaaccactgctcaaggaaataagagaggacacaaacaaatggaaaaacattccatgcgcatggataggaaggatcaatatcatgaaaatggccacaccgcccaaagtaatttatagattcaatgctaaacccatcaagctaccactgactttcttcacagaattagaaaaaaaactactttaaatttcatatggaaccaaaaaagagcccgcataagccaagacaatgctaagcaaagagaacaaagctggaggcatcacgctacctgacttcaaactatactataaggctacagtaaccaaagcagcatagtactggtaccaaaacagatatacagaccaatggaacagaacagagtcctcagaaataacaccatacatcaacaacaaccatctgatctttgaaaaacctgatgacaacaagcaattgggaaaggattccctccctatttaataaatggtgttgggaaaactggctagccatatggagaaaactgaaactggcccccccttccttacaccttatacaaaaatggattaaagactaaaacataagacctaaaaccataaaaactctataagaaaacctaggcaatatcattcaggacataggcatgggcaaaaatttcatgactaaaacaccaaaagcaatggcaacaaaaggatacgaacagacacttctcaagagaagacatttatgtggccaacaaacatgtgaaaaaaagcttatcattactggtcatgacagaaaaggaaatcaaaaccacaatgagataccatctcatgccagctggaatggtgatcattaaaaagtcaggaaacaacagatactggagaggatgtggaaaaacaggaacgcttttacactgttggtgggaacataaattagttaaaccattgtggaagacaatgtggcgattcctcaaggatctagaaccagaaataccatttgacccagcaatcccattactgggtatatacccaaaggattataaatcattctactataaagacacatgcatacgtatgtttattgcagcactgttcacaatagcaaagacttggaaccaatccaaatgtccttcaatgatagaccagataaagaaaatgtggcacatatacgccatggaatactatgaagccataaaaaaggatgagttcatgtcctttgcagggacacggatgaagctggaaaccattattctcagcaaactaatacaggaacagaaaaccaaacaacgcatgttcccataagtgggagctgaacaatgagaacacatggacacagggagggcaacatcacacactggggcctgctgggggatgggggggctaagggagggatagcattaggaaaaatacctaatgtagatgacaggttaatgacacgtgtatacctatgtaacaaacctacatgttctgcacatgtatcccagaacttaaattataataaaaaagaaaaatttaaaatagacattgtttttccttgcagaggaggcagaacaagattgctgaagagaatcccccaggaatcatcccgtagcaggaacaccaaactgaacaactatccatgcaaaaaaaaaaaaaaaaaaaaaaaacaaccttcataagaatcagctggcacagtggtacatgcccataatctcagcactttggaaggtcaaggcgagtggatcatttgatctcagttcaagaccagtctgggcaacctgatgaaaccctgtctttacaaaatatgaaaaaattagctgggcatggtggcatgtgcctgtagtgccagctactcgggaggctgaggtgggaggatcacttcagcccaggaggtcaattgaggctggaatgagttgagatcacgccatgcactccagcctgggtgacagagtgagaccctgcctcaaaacaaacaaataaacacactaacaaacaaacaaaaaatccaaaatcaggtgagtaatcacggcacctggttttaacataatatcaaggaaagaagcatcgaagagggtaggaaagacagtcttgcgctgactacaccaaccctcctccaaccccaggcagcacagcactgagatagaatctgtgtgcttgggagagagagcgaaagtaagtatgggactttgcgctggaactcagtgctgctctgtaacagcagaacacaacacagggcattctgctggtgcccacagaaggagcatttagcttagtcctgggccagagagaaatcctccccccaaggagagtaattggttttcatcacattctgactaaagtagtctagggcccggaataaattggagtgacaggccacaaggactgcatcctttggcaagccttggtactgcactggccttggaggtaatggacttaagataaaacccagtgcaataccacccgtggcagctaagggaatccctgaggcacccctccccaactacttcagcttggggtaaggaaaaggaagagtagacagaactttgttttgcaaccggagtattggttcagtcacagtaaaataaagcaaaagacagatttctgaagcttttgatagcaagcttttgctccgggatggcatttatagattgaccctaggcaggaagggaatggctgccatgatgggatggactcagtcttggcagaattcaccacctgctaactaaagtggcctttggccttgaataaccagtggcagtcacgcaggactggccgtggaccttgggtgagccccaatactgtgctggtctgcaatgcttcagaggcaactcagcatagttccaactgtggtggctacaggaatgcctgtatcaccccccaccaacactgggcaggccagtacagagaaagactcctgattgaaggaaagggaaggtagagagcaagagactctgcctggtaacccagggaattctcccaattatcttcccaagtccatcaggactgtgtatgtaggagtctgcaagactcacagcgttcctgtgctttggatgctccttaatgccaaaatggctgcagtgactacaggcttaggtcacaacactcaatctgctttgatttcctggaaagccccctggagagtgacaggaatgaacaaacccaaactgtgaagactagctcttcgatgcctagacatcaatgaatatccacaattatcaagaacatctaggaaaacaggacctcaccaaacagactaatcctggagcaataaagatacgtgaccttttagatgggaaattcaaaatagcggtcttgagaaagctcaatttaattcaagataaaagagataaaaaattcagaattatatcagagaaacttaacaaagagactaaaatgatgaacaagcagaaattctgaagctcgaaaattcaacaagctgaaaatgcatcagtctcaacagcagaagaataaattagtgagcttgaagacaggtttatgaaaatacagtcagaagagaaaaaataataaaacaataatgaagtatgcctacaaaatctggaaaatagcccccaaaagtcataatctaagagttactggccttaaagagggcttacagaaagagattgaggtagaaagtgttttcaaagaaataatagcagagtacttttcaaactgagagaaagatatgaatatacaggtacaagaaggtcaaagaacaccaaatagattcaacccaaataagattaccttaaggcatataataattaaagtctcaaaagtaaaggacaaagaaaggatcctaaaagcggcaaaagaaaagaagtaacttcatatgaaggagttatactacatctggcagcaaacttcagcagaaacgctacaggccagaagagagtaggatgacaaactttagcagaaaccctggcaggccagaagagagtagaatagtattaggttggtgcacaagtaaccacggtttttgtaattacttttaatggcaaaaaccacgttaacttttgcaccaatctaatacatccaccgaaattatccttgaaacagggagacatgaagactctcctagactaataaaagctgagggatttcatcaacaccagactcatctttcagaaaatgctaaagggaagttcttcaatctgaaagaaaaggacattaacaagcaacaagaaatcatctgaaggtataaaactcactggtgaaagtaagtgcacagataaatacagaatactctaaccgctcatatctttagcaggaagattaaaagacaaacctatattgttagaagagttctaaactctaccttatctagagaaccttcttcttttagaaaatcaagcaaaacaactaagccaagacatgttaagaaaagtttgaaaagaaagctgtaaggaaatacaaggggagggattgttagatatgagttctaaatttcttttcaaagaattagtgtgtcagtatgttcaattctttgccttctagttttaaacttaacttcctcgtaaagcaacctttttcgattacctactccaccctgactcattctgatcatctgctccacccaacattccaatcacctgctccaccctaactcattccaattacctgctacctgctctgccctgactcccgccaaagcattcaccctgtcattctctttaaattagccaattggaattagtttagcccgtgcggtctaaccccagccaataggggaacgacagagcagcaggggccacatacgtcagggattagaaccccttcccatcccttgtccaaatgtgcgctcaccattgttccatctgtaagggtgcacccttctatatagaagtagcttgccttgctgaatattaaaaagaaaattttgtattcgagtgctatttcttttgcagcatcgaaactttctatataacactatcaaaaaaaaactactccaaaacttaaaatataaaaatatatagagacaaaaagtcaaaaagtgaagggatggagtagaagtgtacaggtttttagttttttctgtgcgtgtattttttcttttctttgcaatcagagttgtcatcagttgcaaataattggctataaattgttatttgctaacctcatagtaaccacaaaacaaaaacctctaataggtgcacaaaaaaataaaaagcaagaaattaaaacatactaccaaaaaataattatcacaaaggaaaacaaggaaaaaaatgggggaaaagccctagaaaataaccagaacaacaataaaaaggcagtagtaagtccttacctatcaataataatactgaatgtgaatggactaaattcttcactataaaaacatagactaacaacaaaaagacggaaaaagatactgcaccaaacagaaacccaaaaagagcccaagtagctttgtatctatttttagataaaatagatttcaacataaaaactatgaagaaagaaaaaaaggttatcatataatacaaaaggttttaattcagcaagaggacataaaaattataaatacatatctatccaacacagaagcatctagatatatagagtcaagtgtattagagttaaggagacagaacccaatacagtaatgacttgggacttcaacagcccactttcaccattggacagatcatctagacagaaagaaacaatgaatttaatctgcactatagattaaatggacctaatagacatttacagaagctgtcatccaacagccgcagaatacattcttctccttagcacatggaacatttctcaaggatggatcctaaattctccaatcaaaagacacagaagagctgaagggctaaacaaaacaaggccctactacctgctacatataagaaacccacttcatttataaaaacatagatagaccaaaagatggaaagagacattgcatgcaaacagaaatccaaaaagagcaccatcatgttaggccgcaaaacaagtctgataaaaagtatattttctaaccacaatggaataaaagtagaaataaataacaagtggaactttggaaactatacaaacatataagaattaaacaatacgtgcctgaacaaccaatgaagtaattaaggaaattaaaaaatgtcttgaaacaaatgaaaatggaaacacaacctactaaaacttatgagatacagttaaagctaacactaaagggaatgtttatagcaataaatgtgcaaatcaaaaagtagaaaaccaagaaataaacaacctagtaatgcatcttaaagaactagaaaagcaagagcatgccaagccccaaattaagaagagaaataataaagaaaacaagaaaataaataataaaaaacagaaataaaattgagacaaaaaaatagaaaagatcaatgaaatgaaaagggttgtttggaaagacagacaaaatcaatgaacctttacccagactaagaaaagaaaaaaaagaagatccaaataaaatcagagacaaaaaaggagacattacaattgatatcacaaaaattcaaaggatcattggagaccatttgaacaactgcatgccaataaattgtaaaacctagaagaaacgaataaattcctaggcacatacagcctaagaagaatgaaacattaagaaaaccaaaatcgaaatagacccataataagtttcaagatagaaacaataataaaaagtcccccatcacagaaaaggccaggacttcatggcttcactgagttctaccaaacatttaaagaagaactaacatcaatcctactcaaatcattctccaaaatcaaggaggatctccaaattcattttatgaggccagatttattctttttttttttttttttttttttgagacagagtctcactctgttgcccaggtgatctgcaacctccacctactgggttcaagcgattctcctgcctcagcctccagattagctgggattacaggcataagccaccatgcccagctaatttttgtattttttgtagagatggggtttcaccatgtcggccaggctggtctcaaactcctggcttcaagagatctgcctgcctcagcctcccaaagttctgggattactggcgtgagctaccatgcctggccccagatttattctgataccaaaaccagacaacgatacaacaacaacaaaaaagaaactacaggccagtatctctgatgaaaatagatataaaaatcttcaacaaaacacagcaaaccaaattcaacagcacattaaaaagatcatcataatcaagtgggattcatcccagggatgtaaggatggttcaacatatgtaaatcaatcagtgtgatacatggtatcaacagaatgaaggacacaaagtgtattgtcatttcaatagatgccaaaaaaatcttttttgataaaattcaatatcccttcataaaaactctcagcaaactggggacagaaggatcatccctcaacatgataaagccatacacaacaaacccacagttagtatcagactgaatgggggaaaaactgaaagcctttattctaggatctagaagaaggatgggcactttcaccactattactcaagttagtaacagaagtcctagccagagtaaacagacaagagaatgaaataaagggcatttaaattggaaaggagtaagtaaaattatcattgtttgcagctcatgtgatcttatactaacctaaagactccaacaaacgactattagaactaataaattcagtaacattgcagaatacaaaatcaacacacaaaaatccatagaatttctctatgccaacagtgacaacctatctgaaaaagaaatcaagaaggtgatcccatttacaatagctacaaataatattaaatatctagaaataaacttaaccaactacaatgcaaactatcaaacattgatgaaattaattgaagaggacacaaacaaatgaaaagacatcccatgctcatgggttgaaaaaaattgtattgttaaaatgacaatacttcccacagcaatctacagattcaaagccatccctatcaagagcaatgacattcttcacagaaatagaaaaaaaaaatcctaaaattgtatggaagcacaaaagaccccaaatagccaaaacaatcctgaccaaaaagaacagagctggtaactggtagacttaccacactaccaaacctcaaaatatactacaacgctatagtaaccaaaatagcacgatagtggcataaaaacagacatgtagaacaacagaacagagagtccagaaattaatctgtgtatttaaagccaattagttttttactaaggtgccaaaaacactcattgggaaaggacagtctcttcaataaatggtgttgggaaaactggatgcccacattcagaacaacaaaagtagaccccaactcttgccatatacaaaaatcaaagaaaaatgcattaaagacttacatctatgaaactaatcaaggaaaccattaggcaaaaactccaggacattggtctaggcaaagacttcttaaataagacctcaaaaacacaagcaactaaagcaagaaaataaaataaaataacaacaaatgagatctctccaagccaaaaagcttctgcacagcaatgaaaacaataaaatgaagatataacatgtagaatgggagaaaatatttcaaactaatatctgacaaaggattaataaccagaatatataagaatctcaaacgactcaataggaaaaaaaaatctgattttaaaatgggcaaaagatctgaggagacatttctcaaaaagacatacaaatggcaaacaggcatatgaaaaaaatgttccacattattaataatcagagaaatacaaatcaaaactataatgaggtatcaactcactccagttaaaatggcttttatcgaaaaggcagtcaatatcagatgctggtgagaatgtggagaaaggggaacccttgtacactgttggtggaaatgtaaactggcacagtcacaacagagaacagtatggagcttcctaaaaacacaacaaatagaactataatccagcaatcccactactgtgtatatacccaagagaaaggaaatcagtatataaaaggtatctgtactcccatgttaactgcagcactatacacaatagccaggatatggaatcaacctaactgtcaatcaatggatggataaagaaatgtggtacatatacacaatggaatgttattcagccataaaaaaaaaatgaaatcctgtcattttcaacaatatggatgtgactgacattataagggaaataagccaggcatagaaagacaagtatcacatgttctcacccatatgtggaagcttcaaaaaaattgaagtcatagagatagtgagtaaaaagatgttagcagaggctgggaagggtagtgttgagaggagaatcaagaggagatggttaatgggtagaaaaatatagttagatagaaggaataaaatatagtgttcagtagcacaatatagtaattacagctaacaataatttagtgtatgttttagaacaattaaatgagtggaaatgaaatgtccctaacacaaagaaatgacaaatacttgaggtaatggatatcccaattacctgatttgatcattacacattgtatgcttatatcaaatatcacatactccccattttatgtatccatagtaattaaaaattaaaatttttaaatatatgagttaagttaaaaaaattttggctcaaagcataaatatattaaaatcaaatctcagaagtaaaaaagaaagacaattagggttttatttatggtagtggcagacaggaccaacctttctgctgacgccaacaaaaaaactaaataatgaatgaaataaagtaatgtgaaattacttaccaaattccatgtgaaggtaaaccagaaacaaaccatacaccaagtaacttttgttctgaggacattttcctgtctagaagaaaaggctgagaaaaaaggctgagctaatggaagatgtgccggtctatggtaaaaaaatcaaagcacaaggccaggtgtggtggctcatgcctgtaatcctatcctttgacaggccaaggcaggaggatagcttgagcccaggaattcaggatgattgtgtgcaatacagcgagacctcatttaaaataaaaataaacacaaaaaatcaaaatcaaaaataaaaataaaagcacattgcctaacaaagctggggactcagataaactacccaatttatgttcagagtttaaggacaacatcattaggataagaggaaattgaaggaaaatagaattcatgatcttaaagtcttccttaatgtcatgtgtataacagaaggaatcccaactcttgaacatgaatagtgacttgggactgaaagcactcctagagacctttcctagaaaaatgtaccttcttaaaaaagatactattattctaggactcatatattcctataattttttaaatacaactggtactcaaggcacacaagaaaaaaatatcataagctagcagacacagacttagaaaatttagaaactggaattatcttcaacaaacaacaaatgaactatgaatatagtcggcccttcatagccacagattcactcaaccaaggattaaaaatacatgtatatttttaaaaacacgactataaaaaataatagaaatttttaaaaagccatgacagtataacaatatttacatagcatctacattgtattaggtaccataagcaatctagagattatttaaaatacgtgggaggatgtgtgtaggccgtatgcaaacatgatggcatgttatataaggaatttgagctgcctgtggattgtggtatctgcacggggttctgaaaccaatttccagcagatactaaggagcaactatactaggccaataaaagcaagattgtaattttcagcaggtaaccagaaacagtaagaatatcaccaatatctttaaaaagatactgatgcattgatctaataatctcgatgaatacagggcaagataaagaatgccacacgatgattgaacatttcctctacccccacaaccacacttgactaggagaaaaaaaaaaaagaagaaaagaattccacacaaaaagattagagtgaaacagcagaaaaattacaaccaaaaaaagaaacaaacaaaaaaaaattctaaaagagagatttccttcaaagcagcatgaattattaggttggtacaaaattaattgtggtttttgcattgttggaatttgccatttgatattggaatttttttttttttttttttttttttgagatggagtctctctctgttgcccaggctgggctgcagtggcgcgatctcggctcactgcaagctctgcctccagggttcacaccattctcctgcctcagccttctgagtagctgggactacaggcacccgccaccacgcctggctaattttttgtatttttagtagagacagggtctcaccatgttagccaggatggtatcgatctcctgacctcgtgatccgcccacctcagcctcccaaagtgctgggattacaggtgtgagccaccacacccggcctggaatacattcttaaataaatgtggttatgttatatgtcattttaatgggcatttcttgctttttttttttggctaatgacttattacttgctgtttatatttattttggactatggaaatgatgctagacaaaaagcaaagttgagtgattttcttatttaagttcaaagtgggtcgtaaaacagcagagacaacttgcaatatcaacaatgcatttggcccaggaactgctaatgaacgtacagtgcagtggtggttcaagaagttttgcaaaagataccagagccttgaggatgaggagtgtagtggcaggccactggaagttgacaacaaccaattgagagcaatcattgaagcagattgatcctcttacaattacatgagaagttgctgaagaactcaacgtaagaactcaacgtcaaccattccacagttgttcagtatttgaagcaaattgaaaaggtgaaaaagctcgataagtgggtgcctcaccagctgagcaaaaatttaaaaaaacaccgttttgaagtgttgtcttctcttattctccacaacaacgaaccatttctcaatcggactgtgaggtgcaacaaaaactagattttatatgacaagcaatgaccagctcagtggctggaccgcgaagaagctccaaagcacttcccaaagccaaacttgcaccaaaaaaggccatggtaactgtttgctggtctgctgccggtctgatccactacagctttctgaatcctggagaaaccattacatctgagaagtatgctcagcaaatcaatgagatgcacttaaaactgtgatgcctgcagccagcatgggtcaacagaaagggcccaattctccacagtaacacccaaccgcacactgcacaaccaacacttcaaaagttgaacgaactgggctacaaagttttgcctcatctgccatattcacctgacctctcaactgactaccactccttcaagcatctctacaacttttttcagggaaaatgcttccacaaccagcaggatgcaggaaaaagctttccaagagtttgtggaatcctgaagcatggatttttacattacaggaaaaaacaaacttatttcttgtcggcaaaaatgtgttgattgtaatgacctattttaattaataaagatatgttagagcctcgttataatgatttaaaattcgctgtcccaaaccacaatttcttttgtaccaacctaatgcattgacagctgatttctcaaaatcaataatgaaaaccaaaaacagtgaaatgttatcttcaaggtacaagtaaaacaaccacaaatctgtaatatcccccaaaacattcttcaagattgaaggcaaaacaaaaaattaagacaaagcaaaaaaattaagagaactgaccatcagaatgtctgcattatgaaacttctactgagtgtgctaaagtaaaagttaaaagattccaaaagaaaagtcagagacgcaggaagaaattaagacatggtaaacacataggaacatctagctcaaagtactgtccagcagcaatacagtaaaagtgacataagtaatttaaaattttctattgttcacactaaaagaaaacaaggtgaaatcaattataatttcaacatgtaatcataatgaaaagctgaggtattttacattgttttcatactgtctttgaaatatggtgtttatacaacattacaatgcagatgctaaattaaaactgccatataaaatacttgatctatatttttatataatttgcagctaatgccgggtgcagtggctcacgtctgtgatcccatcactttggaagcccaaggtgggtggatcacttgaggtcaggagtttgagaccagcctagccaaaatggtgaaactttgcctctactagaaataaaaacattagccaggtgtggtggcacatgcttgtaatcccagctactagggaggctgaggcaggagaatcacttgaacttgggaggcggaggttgcagtgagccaagatcatgccactggactccagcctgggcaacagagcgagactccatctccaggggggaaaaaatctccaaaaattaaaaaataataatttaataatttgcggttaagaaaggtttatgtatccgagttgttccaaacatacaggttttacagtaactgaatcaagtgtcagtttttaaacttaattgaacactaaataaaactaaaaattcagttcctcagtcatactagccacatttcaagtgctcaaaagccacacgcagctagtagctactgcaatgaatagcacaagcatagaacttgttatctggagtttaaactacgtatacaattcaaagaacaatgacagcctataagacctacatgaagataaaagttgccatcccagaagagagtaatgctccaagcacagagaagatattggccatactgctagaaatccctgagtaaaacagacaacccaattaaaacaaaaaacaaacaaacaaaaaaacctcccaaaaagatttaaaaagacaatgcacaaaagatttaagaattaaaaagacaattctagaaagaggaaattcaaatagccggtaagtttttgaaaaagtgctcaaactctttagtgtcctgggcagaataaattaaaacaacaataagataaagccacattcatcaagttgggaaaaaggaaaaataactcttggtgagacagtaaaagtaaagggatctaccatatactgctgtcggggtatacattggtgtatctactttggaaaaggcataactagtgaagttgaagataaacatacgtactctacaaaaacccatggtaatgtacattaagaatacatgtacaagaacattcataatagcattgttcataactactaaaaacggaacacaatccaaatgtttattaatattagactaaactgtggctcatttccattaagactttttatactatacttattatactatagattactacaatccaatataagaactagagctaaatgtactaatagagttatatcccagctgcatgagagaaaaagatacataatgatatgtaatatataatccacttacatacaattaagaaacaggcaaaacgaacctaaattgcttaggaatgctgacataggtggttaagaaatactaagaaagaaagcagtaaatgattgccataaaaatcagtatagtgttaaccactgaaaagaattgaggaaagggatgatcaggaatagaatggagaggggagcttctcaggtgccacagacgttctagttcttgactgtggcagcgcttacatagagttcacactttatagtttttcattatactatgtatcgatgtttgtatgcttaaatactaaatgtatggaaaaagacacaaaatatttaaaattgtagctaaggcacattaactgccttgctggtatttttttttttcattacaaagtggcagacaattggttacactataaagacagacaattggttacactacaaagaaaattttaaagcacaggagtctagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgggcgcggtggctcacgcctgtaatcccagcactttgggaggccgaggcgggaggatcatttgaggtcaagagatcgagaccagcctgaccaacatggtgaaaccccgtccctactgaaaacacaaaaaaattagccaggcgtggtggcacatgcctgtagtttcagctactcgggagggtgaggcaggagaactgcttgaacccaggagacagaggttgcagtgagccgagatcgcgccactgcactcgtctgggagacagagcgagactccgtctcaaaacaaaaaacaaacaaaaagaacccacccaacagaattaagtaccaacataataaatacgaagaattttagattcttggtttttaaaaaacatacaaagatgatattccttcaaaatatctttacaaaacatattgagactgtgatgctttatattgattgtatgaaaacaatgaaaaagaaccagcactgtttcactataaaagctttactaatgtaaatttataaatcctttcttaaatattttgagttaattctaattttatgatagaaattcattattttcagcaaaaacagctggcatttgggaaaccaaaggctcaaaaactaagaatagtaaccaaagaaacttgacaaaacagtccttttaaaactctcatctacactataaggggaaactttgatcacgtcccttctccttcatcaatcgtagaactcaacattaaggactacacaatcccacatccctctccgagaaaaagcaaaggctttgtgttgtagcaacaacgcaagacatggagggaagctccactcaagacttccctgcctgctccttccccaaagccactccagaataccagggagggttgagaggtaaggcatgaagggcgcaatatccaatatgagcaacgcgtgtgatgcatctggtcaaaatgcatacagaggacttgtctctgtccctagatagaagtcctccgtcctgcagtcatgagggtcaattgctgaggcttcacagttcccttctctcttacactcggaccgtcacgctcctcacctactaccccgatgcagaggtagactcaggatccctgcacttgtcaaggattcctcggcaagctcacggggcgggagtggccacaagacggagctcgcctggtcctggccttcccggcctatacaagcctgcccccttcccaattcccaatctccacagccttccatcctcccactttcgattcaccttgcgccaccgacgcccctggccttcgtttgcagcaagtttacccccaccattacctctcgcataaaagcctgcatttaccaggtcaaagaggggaaccaacgcctgcaggaatcgcttcaccgaatcgcctggccgcgtcctctgctagacttcacctgccgctgcggaccgtacacaaccactcccggcatgccccgcgcacgcac

SEQ ID NO: 2661 - DNA, 90498 bp, Homo sapiens
  source 1..90498: mol_type = genomic DNA
actttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatgatttgcatatgcagtttttctttagctatgtttttttttttttttatactttaagttttagggtacatgtgcacattgtgcaggttagttacataggtatacatgtgccatgctggtgcgctgcacccactaactcgtcatctagcattaggtatatctcctaatgctatccctcccccatccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtgtttccagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggataaaatactggcaaaacgaatccagcagcacatcaaaaagcttatccaccatgatcaagtgggcttcatccctgggatgcaaggctggttcaatatacgcaaatcaatgaatgtaatccagcatataaacagagccaaagacaaaaaacacatgattatctcaatagatgcagaaaaagcctttgacaaaattcaacaacccttcatgctaaaaactctcaataaattagggattgatggggtgtatttcaaaataataagagctatctatgacaaacccacagccaatatcatactgaatgggcaaaaactggaagcattccctttgaaaactggcacaagacagggatgccctctctcaccactcgtattcaacatagtgttggaagttctggccagggcaattaggcaggagaaggaaataaagggtattcaattaggaaaagaggaagtcaaattgtccgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagctactgctcaaggaaataaaagaggatacaaacaaatggaagaacattccatgctcttgggtaggaagaatcaatattgtgaaaatggccatactgcccaaggtaatttacagattcaatgccatccccatcaagctaccaatgactttcttcacagaattggaaaaaactacttaagttcatatggaaccaaaaaagagcccacatcgccaaggcaatcctaagctatgtgttcttaaagaggggagtggtagctttgtaacttacagtgaggcttacaccttgacaactgcaagaatgaggatagtggtgagtgaagggagatttgttaattatggcatttccctctattatcgtctaaacagattatattcccactaaagtatgtgtgttggtcctgccagtattagaaaccagaggcttgttggcattgtgtcacacagtacacaccaatggattctcagattttctagggtaaaggtgaaggatggggcagcacttaggttatggtggtttgaaagaaactgaattgctttctaaaccagatgaggatcagagtgcgaaccatggtgaaatatgcatggaaactacagaaagactgaagtgtttcttacggtgttttctgcaaaacgtgattcattaggacattaacaggtattacgttttcaacatatacagcattatgatacagtaagtttggaccaaacaggtattcattccccagagcctttcacatgcacgagaatcagtcattttaacaagaattccgtttctgctgggccacttggatcccttggattcagatgtaaaaacacactgaaatattcctcctttcacctgcttttcagtttgaggtaatcagattgaaaagcaggagttcatgcattttttggttctatttttcctcctctagtaaatgaagaaaataagctatatgtataagtttacattattcttgaaccgctttttaaactagggtttttcatatttgtttttattgatgacaattaaagcaatttaagagacgaagttagctcaaaactcttgcgaatagattttagcatttttgtatgagggaatatggaaaggccaacaagcagcactgttcctccccacaaaaatgccttgggaatataataggcgtacacttcatttgtgtaacttttcctaatgtatttttttttaatttgctttataacggtttcatgtttacctcaattggtacttagtcttaaaatctttctttatacttggttattgatggatcttctgcagctcttatgtagccaatgagacagatgagggctgtcagcttttaagtgacatcttaagctaataagaaattggaatcctcaagtcatttcatgaggctgttaccctttaagacaaataatactttcctcaaatagttcagaaaatttttaaaaggatcacttagagcataagtgtaaaattcttgcttctagtatataatagtgatgttaccatgtcaagtattttggtgaaatatcccctaaaaatgtgtagactacggcacagattgagtatgcaagccttagcttgaatgagactgctgagaagtaaatgacagggatctgaatacttagcaggcttaactttttgcagggaaggaaaggctatgtatgcaaaagaataggttgtaactactgaagagctactttatgctcagaaaccttttattccactttgtatccaagatttcattaaaacattgttccttagagcatactttaaaaactatttggtaaggaatccactgttgaacttcaggtcttaatagcactggctttggtgctaaactgagttgaattccaagcctgttggccattcccagcattgccactgctgtgttagttttctcatctgtaaataactgcctacatctcacagggcctctaatagttaaatagattgtaagctgcacaagcatagggacagtctgtcttttgtaaacctcccatgcacacaataggaaatcaaatattcttgaacaaatgaagtcactaagtgctcattaaatttcattttaaatatatgcctctgttaattcatggatcttggaacttacttaaaagacaatgctttgacggacatttccacattcctcatagggatttactttttaatacaaacaggttcagttaacattgccatacacatctcattacttttgggagtgcttttccagaaatctctggtagtcacgtcacttcatgatggggctacgttctgagaaatgtgtctttgggtgatttcatcactgtatgaacatcacagagtatacttacacagaccctgatgatatgtatatagcctgttacacacttaggctatacagatagcctagcctattactcttcagctatagcactgtacagaatgttactgtaatcatactgtaggcaactgtaacacaatggtaaaacatttgtatatttagacatagaaaaggtacagtaaaaatatggtataatcttatgagaccaccctttatacaatgtcattgaccaaaatgttacgtggtgccatgactatacttgttaagaaggaaaattccagtccttttgacctatggtaggctcaacaatctgtaattttagaaaatcctacaagggattctgatgtggatggtatgagtaccacattttgagatgtctagaagaaaaatcttcaaactccttggcctttttcttccatggaaccatcttctgactaagctggttagtcttctgaactagaaaacctgggtctgggatagaatccaaaatttgcatgtggacagaaaaaaacactgcagcaaacctgctgtaccaaaggttacttattatacttcagtgcttaccattgttttttttactcctttggtttaaggtttgtaaagacatctagctgttaggttgaagtgagctcttcaaatagaccattatatatataagtgttaaaaaagcacatggtctagtccctaaaacagtcatattttattcttctgaacagctacttacaaagtaatctcaatcagtgaaattataaatcatgtaactgttcatgattaaaaggcaagacacagccaagacagtagatgggcaagtctcacataaatacaagaatgtttatagaatgtttagcatatcatgttaatggacaatagttttccgttctctacagaagtatgaatgaaatgccaaagttgaagtcactggttatattcataaccagcttagtgaggatgttgcccactgcctcacatctgtaggacagttgggatatttctgcagagcattcataatttgagtattatccaaaagcagtttcatcagctggtactctctctgtgaatttcctgaagttctttccatgggctttattaattctaattgctgcaagtgttcaaaagcctgaaagatgaaagaaatagtttaggttgaataggagaggagagtgacaactctcctgttctctcccagagaacagttagcattttggtcagctgcagaacagagtactgggaagcaaaatgtaacaacaatcaataggattaaaaaaactctcacaaccccatgaaaactcatattatcaggtaaaacagtgtcagtgcacacttacttgtccatatattgttgaatgtaaacacggcaaactttaattcaatatatacaatatggttttcttcctagcctcattctctatcatagctcctcctagtactttaataaatagtttccagttctctgtaaaaacctaagaatcagataagactttctgatcaattccctaggctactcagatttgcatttatattttgtctgtctctatttttgctttgctatgtaaaaaggtaacacagctgtaacagagggaggcagaaaaagacccttgagtcaactagacatattcagctgatcctgtaagtaaaggattcagcaggctagtatggacatggaggagaagggacaggctcctgtttcctctaagaagtctgactgagactgtcacaaccttcttccatcttccccatcttaatagggctctttcttgtctacttcctcttatccttaatattcacctattatatcttttctaaccttgagtgttgtgttaggtacgttattaggttatgaaaaaaaaaaccattaaatcatgatatactaaccattaaataatgatacactgaaatagattcctgaggattctattatattcttacaactcactgtaaaaaacatcactggaacatattctctatgtatcacataaattcttctgatagagaaacagctcagataccttcatatctgaacatgagaaaatactggaggctgcaggtgttaagagctgaatagaactgtgcagatttaaaacatttctaaatagcaaaatacttcataattgaaaattcagaaatgagcagctacaaattattgagaatttaaatgcaggctgggcgcagtggctcacgcctgtaatcccagcactttgggaggccgaggtgggcggatcatgaggtcaggagtttgagaccagcctgaccaacatggtgaaacactgtctctactaagaatacaaaaattagatgggcatagtggtgcacgcctgtaatcccagctattcaggaggctgaggcaggagaatcgcttaacttgggaggcagaggttgcagtgagccaagattgcgcccgccactgtactccagcgtaggcgacaggagactccatctcaaaaaaaaaaaaaaaaaaaaaatttaaatacttgggtaacctttccattttcacagctctcacaaaataagactattaggggaaaaaaaccctccagtattgtaaaatacttttcctgtttctttgaagaaatggcaatgctctgtactcatttttgttgctacaagaaatgaaattctggttactagggcctataagggatgccaatggacttggggaatccactgttttaaaagtttctttccttaaaatcttcaagagctgcactgtccacgctaggctactgagcacttcaatgtgtgactcaatttttttttaaacttaaaaatggatatttagttctattagaaaattctgagcatgtttagaacaatttcaaaatgtaaatttactttctcagctatacattttatggaatctaaacagcaagaatttccagtaaacatttaggccattgagatgtgcttaaatataatgtacaccaaatgttaaagacttaattcaaaagaatgtaaaataccttactgttcttctataatgattatagaatgacacatttttgatatgttgcattaaatatataattaaaattaaacctttttatttttcttacaggtactagaaaatttaaaactacattacatggctcacattatctttgtagtggacaatggtaatctacatgaagtcctgaagttgtaaaactcatgactcagcccccaaataacactttctctgtatgccctcacaggccaataagattttgtcttttaagtttcttaatggctctaattttcattgttttctccttttactgctgagattataaaagccaatccttgggttggaaagggaaaggttatatcacacactatactgaatagttgttttcgggatgcaagtgctctgaagagacagcagagggcagtatacctccacaaactaaaacaaccggtcacttcctcagatttttccaaaatatttcatttttagataattttcttgttttgaaaaaaatctctataatacttaatgtttaaaaatgaaagtgcaattttaatacataatcaaattggatgtaaaaaatatacttgtctgtagaaaaatgacagcaaactaaatcttaccttcatgacaacaggtttttcaaaattataaacggaatgtgctttcctttgaacaaacttctgaaactctgagtagaaagcaatgacaacattataccttcaaataagcagtggggaagagtcagaaaaaagctacttaagtctcatctcaccattatagaccatttgaaaattaaatggctcttcctcatagatgtcatttaaatgtttcattgctattataagacagatttccaagactgatagacctacagtaaaagggaaaaaaaactatcagtttaatgacatataagactgaaataactgttctccaaagaatacaatatagtgaaagatctatggttctgaggggtgaagaaggtcaagattcttctagatttcaatgtgtttcaattatctatataaatttaagttacttaacctccctgagcttagtttttttcctatctgcaaaataaggatatttttaaacttttagaaatgtcacaaagattggcgaaatattatcaggcactcaccatatggcccacagtaaacaaaataaacttcaattgttatgtgactttaaatcacacagggcctttgcgtaggatttatctagagacttcctaaactcctggaaattatatccaaatctgtgtattccttttttccccggagaggaaaaggttcattacatttggaaaaggaaataacaaacccaaaatgactgaaacccagagaatgctcttcagtagttcttgatacaatgataacatcagcaacacagtcttacctggatttccaatgtggcaaaagaggcagagcgtcaaatttttttttcactttaaatgggagtgatagtacctttaaaaggactaagttaaaggctatatggatacgaaagtattttataaagcattatgcccacgttaattgtaattttaaaaacattccattatctaaattcaaagttttaaaaaccacaatttaaaaaataaggctgggttctcaccatgtacaatatttgctttcgagtccatgctacacagttggcttgcttccattagatctacggcagtcataaatgggtgcgatgctgttactcgatttaaagcaagcatctagggaaagacagatcagaaaaacaattacgtatttacatgggcattttggagatactgtgcaaaacttctgaatttgtatagttaattcttaagggagagtaaatattaatgcttaggaaggtattctcaaattcagttgtattaaaatacagtatttcaatttgtgtgtcacataactgcagatgtaaagcataaaaaaagttcctgctgctctctctaacccatcccagttgcataacttgtttacttactgcttggaagaacaatgtttaaagaggagtaggtcaaggagaagaaactgaaaataattaagaatacttactaataaaagccccaaacacaagcccaaaaggcagatctacgccttacttgttaactttttcaccacccaatcatccagccaggttagtattaatttagacagaagttagctgttttatgttcaattgtacaaaaaagaaaagaaaatagcacatttatactcaggaataactctccttgaaagcacagtctccttctcttgtgctgcttctctgttcaaaaatgaacagaggtcctggaccagagttgctactcaagtatttgaagatttccttccttccttctttatttgtatttttcatgaaagttaaatttggtcatttagggttacaagatttagcagataaaaatgcatgacctctggttaaatttcaatttcaaataaacaataaatagtttcttagtagtatgtgccatgcaatatttgggatataattatccaagaaactctccttcaccttaacaagggcgcaactgattagctgggcagagagtttggcaatccttgtccttcattctcctactggttgggacctagattgccagtgctccctccctttctctctcctttcctttttcctttagttattaattttttaatttttattttttaacttcatttttccataagttattgtggtatgggtggtatttggttacatgagtaagttctttagtggtgatttgtgagactttggtgaatgcatcacttgagcagtatacactgcatcatatttgtagtcttttatccctcgccccactggaaaacaatgtggagattccttaaagaactaaaagtagaactaccatttgatacagccatcccactacagggcatctacccagaggaaaagaagttattatttgaaaaagaaagaagtcattatttgaaaaagatgcttgcatgtgcatgtttatagcagcaaaactcacaattgcaaaatcgtagaaccaacccaaatgcccatcaatcaacgagtggataaagaaactgtggtatatatatactatggatatggataaagaaactgtggtatatatatactatggatatatggatatatatatatatgtggtatatatatactatggatactacacagtcataaaaaggaatgaactaacagcatttgcagtgacctggatgagactggagactattattctaagtgaagtaactcaggaatggaaaaccaaacatcgtatgttctcactgatatgatatgtgggagctaagctatgaggacacaaaggcataaattttttttaacatatacaaaggcaacagagaataataaatatctatgactactttacctgcttaagaaatatgattttagagttgaagcccatctcctccggattggactctactcttccccacataaaacaaccaagtatgtctatactattaggttggtgcaaaagtaattgccattttgggcactgaaagtaatggtaacttttgcaccaacctaatacttctactacatatacatgtattatacaacagagtaattttcaacttttatataaatatattgtatcttcacaactctcttcactgtgaggttttacccatgttgaggcagtatcaattctggtttattcattttttcattatatttctttgtatatatccacgattattcatttcctaatttcctattgacagacatctttcatttctttttttttcccaattataaacaagactgcaataaacaaccttggacatgtcttcctgtgcattaggtaactagactttctctaattagtatgtttctctagttacctaatttgctaaataaattgctctccaaagcacttacacatatttacattggcagcagcaataaatattaatagtcacagtcatgataccatcaagcataatctttaacacccactagattggcaagaaaaaaaaagtttaattgtagtatttctctggttactggagaggctgaaaatctgtaatctataatgagcttccacagtaagacaatgacaacaaataatgggatgagctaagaatatgagtaagcagccctcaaagtagaatcccatatgacaaaaaacaagccattatttaattcattaccatgaattaaaaatgtaatagaaaaatggcagaacaatggccgttaatattgacaatactgaggcagagatattttcccagatggagatgtgtgtgtatatatatatacatacacacatacacacacacacccctcctctaaaaattactagtccccaaattccttcatgatatgctgaaaatggcagtatgcttttgacaatagaagaaaagtaaatagggataaaaagacttaaattcctcagcagaagcagcaatgaggaaagaaaacttgtatataaacatgggtgaaccatacagccaagtaggacacaaacttgaagccagagagctttggattaagtcctggctttgttatctactagtagtgtgaccttcggcaagttacttagctttaaggagcctcaatttctttaggggtaagaataaaaaataagattattccaatggccagacataatataggtactactagcatcaacagtacttggctcatatgccagtccataaatggtagctactgtcattattattctattattattaaaaatgacctttctatgaaaccaaaactatcttgtctttcaaaggtatttgccataattttctagaaatattagactaaaaccaaatactcttagtgaagaaagttaattttcagaacaattaagtacttcttgtttgatattggtattatgtaagcttaagatataattacttggcaaaacatcataaccaggtaggatttattccaggtatataaggctggttcaacactcaaaaaataacataatcaaatatatcaacaggttaaagagaaacatggtcatgcgaaacgatcgagaataagcatttgacaaaatccaacacccatttataagaaactctcagcaagttacaaacagatgaggattacctcaacctgataatgaacatgtataaaaaacctacagctaacattatacttaatggtaaaagtttgaatcctttcttcctaagactgggaacaagaaaggatgtccactctcactgctctaattcaacataacactggaaattctagccattgcaaaaaagcaagaaaagaaataaaaggcatacagattggaaagaaaaaaaaaaccgtcactatttgtgaaaaatgtaatggtctacatcaaaagtcccaaggaatctattaaaaaacctcttagaataagtgagttcagcatagactataagtcaatcacatttctatatattaatgtgtatatatataatcaatcacatattctatatgtaatgaatatgtgggaaatgtaatgaatatgtgggaaaccaaaatttcaaaacccatttacaattgttctaacaaattaaatattggtatacacattaaataagtacatcatctgtgtagtaagagctataaaatgctgatgaaagtaatcaaacaagaaatcaaataaaaggagatatgaaccctattcagagattggaacactcgatgtagtgttccaatgcatgtcgattctcccaaaatttacctacaggtttaatcaattcccataaaaacttaattatctaatgaaagatagaaaatgataaaagtaggctgggcacagtggttgatgcttgtaatgtcagcacttagggaggcagaggtgggaggatggcttaaggccaggagttcgcaaccagtctgagcaacaaagtgagaccccgtcactattaaaaacaaaaacaaagcaacaagcaataaaacaaaactaatacaaaccaatagcatgtgtaatgaccgcaggtttttgctgatattgaaatgcttctgtagtacttcttgcacacttctatcttctgagagatactaaaaggaaaaaaaaaaaaaaagccaaaattgaggaaagatgtagtttaaaacctaaatataatcctgtgccttactggttggtgtaccttagtaactctatctaatattaattcattattaaatagatgttggtcttatttgtagaacactaaaaccaaaataaagtttccagtctactgattttcttatcctgttctttacgttaattcaataaacacaatgataaaacaatcctggctaaccccaaattcgtacttgaataagggaaactactacacagtcatactagtgaaatgaacaaaatgcagcacaaaaacagaagtgcatgagttactgtacctagggatacaaggtaaagtattacaaagaatgcttaaactggatgagacaagagatttaaaaaagaaggaagaacattccagttacagggaacagcatgagtagcaggaaaattatcacattggcagaaaatgagtagtcacgtactggagtttcaattactggcaaagtgaatgtacaaaaagaaaaggcagaaaaacctaactggaggtagctgtccagacaagaggtaaagtgggtcggaattatctgagtgttatgaagaaaaaagaattaagacgtttataggagtacatctggtagagaattaactggtagcagaagagaaggaagggtttgaaaggtagaagataaaaatcaaacatgatctatgggaaacaaaatggcctgtgaaaagtgaaatgtggtcaaaaaatgaatcttggattattaatatttaagtagtaggtgggaaaagagaaaaactaagaaattaagaaagataccaaagactggaagagaatctaagacagagtagagatctagaaaacaagggaacaaagttttaagagagaagtgaggttcaacaatataaactactttgtaaaaagatatatttgagaagaggctaatggctttagaaattcaaagatcaccacagccctttgagaaagtaccatctaaagaggcaagtgactgcagtaattagggttgaatggaaggtgaggaacactggcattgaagaaaagattagatgaaaaaagagtaaattcagaagtagcagagccaagaaaggcctggaaaagattgtcataatttttcaaaaatcatctgcatggaataaggattcttttaaaaaaaaaaaaaagcccagaaaactaagcatttctgtattttctagagctgtaattatatgtctttactttgtccactctaagaagaccagattcagaagtaagttctagtctactggaataaaattttatactctcaggaaatatattatcttaattatagttcccactcccttgctattgtttctagtcttctctttgtattttaaaggacttctggttactatatctttttctatcacaaacacggtagaatatccttggaagtacacagggtgaacataaaaaaaacaaagtaataccttttggaaattaaaaaaaaatttgtttagcttttccagttttaaaattgcaatatggaagatatgtggctaaatatcacaggcaaactatagtcttggtttctgtaatctgtaagttgtaaaagttgatgtggtaaaatcggagcacttaggaaaactaaagaaaatcacctgggacaaaattgaagaaattttctctgcaagaatcaattatttttaaaacctgcatttgcctctctttgacatgatgcttcaaaggttaatcttctatactccaccttcctactttatctctttattttttagtggtttgactccaattccccctctttctaaaagctatcgccttcttgcttctataattacttattctgctttttaaaatgcctaccttatctacatgagccatttaaacaaaaaaaattgtctaacctcgttcattatatttttaattccatcttgattcaaacactatactctatttgaggataaggctattatcaacaaccacataagctacagtactttgggagatttcatttgaggagaataaggtatgattcttttaaatgttcttttcaaaggatccctcttatactgccatgctaagatagagtctactttgcttatttgactcatttgaagtagggctaaaacaaaccttcaaattaggcaggatatcaaggttcaatcttatcctgaagatatttcttggatgagattccatgtgtgacctgttatctgtatcactgctattggcttaatcctgccattcaaaatagcttcctggataatcggcactaagagaaagaatagctcccttaatgcagctaccaccctactccacaaggcagggactctgaccatggtgctgacagatttttcaagtgaagctcattttattcacataccaaagacaggcacaagatgatcaggataggggaagaaaatattagaactcagagacacaaacaccagtgatgctggttctacttaatgaaactgactattaagactatcaaaatgatgacaagacagtgctcacatgcaggggatttaaggtctgcaacaaaagtccagaaagtagattagttatgctactaacacatggttatcattttctaagtcacgcagttatacttcttcaccagtaactcccagcatcctctttatttatagactcaatttgagatgctcagaatgcaacacagttgggaaggaaagtggatgaaaaatggcacagtgcaacctagaccatgtagttaccttaagaagattaagtgtgagcaggtatggaaaaaaaaaagcccatggaaagtacagacatttaaatactatgaaagactacatttgaatctctaaaacagccagaaaaacatactggtggaataagacaatcagttcaggagttgtagaagatgaaagtctgtgaggcactgaaaagtagatctaaaagctgaagatccagaggtctggttcacaccagaccccagtaaaaggggacaatgtgggagtaccaactacaaagaaggtgctcctatagatggaatcctataattagaaatagtatcaaagacacttggtcaggtaattgaaatacccgagtctcaggaaagattgagtggaagggaggatccatacctaattatatcaaggcataatatctgaattttaaagataatgtcagctatttttacatacaattatgtatagttgtattaagaaaaagaacagggaattattaatcataacaatgggaaaaaagtaatataaaaatatgtaggctttgagtcctttatgtaaaaacaacatatttagcatgtatataaactctgcaatgttgtagaccaagtaattattccatagtagaagaaaggagaattgatatagtcttaagggaaacttccactgtttatcatgtattcttttgcactaattacattttgttcaataaacttttatgatattttaaaaaaatgaaatgtgtcaaaatactgcttacatgagcagactatattttataatcaaacaataatcatttaaagaacaaactaaatgcaaaacgcttccaatttagtattagtatttaaaaattcacggtaaaaatacaatctaccactattgctttaaaataaaatgatcctttttatagagtcagtgaatatagactgtgtaattctattcaaagatctaattatccttaccggtattttaacattataaatcagtttttcccaattccttcagagccagggactctatattattttccactctcacgaggccaatattttttgagattctagcataagggacttattcattaatgatgtttttcaattatattattaaatacacacacatatgcatacttcctcctttctctttgccaactgaaactttttgacagcgtaagattaaaatgctagtgtgttgagaatattttaagcacaggtaaatttatagtctcaaaggtgtggcaaatctttaaaacaacatatgaacctgcctttgtatctaagactctcaagtctccagggactgtgagatgtgatcacctattagataatataactggaggtgccacagtctgtactgcctcttaaggcccaacaaaataaaagctgaagttgctaatgaaaactggaagaaaaaaaatatccacacataataggtatgagtcattaacatttatttatcattatttactatttattattattgctaaatatgtaaaatatataaaataaaattatctaaaatataaaccacatacagataaaactaaagcctcattaaagtttacttcaaactaataacataaatcctaaagcttaactgtgatgttcttttgagatagaatttaggagaaatgacatttcaactgtctaagaagaaaatttttaaaaagtatataatttgtattactgcagcattatccttcagcaatattagaaactttgtgttaatttactaatttctaaaatttgtgttttaattgctttaaatcatatagcaaggaacatttagctttattgccttttaagatacctgaacattttcattccacttctcagcaaaaaccttgtctggaaactctgcaggtagagataactgttctttaaatattttaacatactgtggaaaaccaaatgaattcattaagtgtatctgccggtgagaaaatcttgacttcactcttttttctaagagttccaaaatatccttaaaaacaaacagaaatctctataaggaagatgaatgtttttaaaaaaacaaaaacactgtaccaatgttagaggtataagtaaactatcacctataattagtaatgtttagtctacaatacataattaaacatttaaaacattttatgcaaactaaataatccacctccaggcatttgctggcttggtgatgtcatgcctttttcccaccatgttactctcagctaatctgtaacattccaagacccaacatgactgtttaaaaaaactgacaatattgaatagctatatgtcacaataacaccaagagtgtcaataaggaattctgtacattctatgaagaactgagattaaaaaattaatagcatgataggcagcaggaaccaactttaggagaggaaagtggcagaaatgcaacatggcattcgtaagttatcttccggcttttttttttttatagtaatgcttttagactctatttgtatttgtgctatttttccttaaaaagaaatcaggaatcaaatttactgtcaaagaacactaaaaaccaaaggataactaatatgtactgcttgtaaggacatacgaagtgttcttaaatgaagaaaatacttccacaaaactgataggcattcaaactatccaagacatcaaaagcacaataggtaagctgtcttcctaagtcacatatattgcaggaactgtcattcctaaatctctttttaataatgaacttgagcaatttttcaaaatatattatagtacacagcatattatatataatatatataatttatattatatatgtatatatacatctatatatatacagtatagtataatatatatttattacttaagttacactccaaggtatacaaccaagacaaatgaaaccagataaccacaaaaaaagtgtatgtgaatgtttgcagcagtattatttttaatagcttaagaaatataaacaacccaaatgtccatcaactgatgaatggataaacaaagtgtggtatatctacacaacagaatattatttggtaataaaaaggaataaagggctgatatatgctgtaacacagatcaactctgaaaacatgttaaagaagccagtcacacaaaactatacgttgtatgattcaaaaattactaaacagtcagaaagtggattagcagattagtggttgcatagggctggggagggaacaggggatttggggtgatcactaaaaggtacgtggctcttaaactgtggtgataaatgcacaactctatgaataaacaaaaaccctgttaattgtataatttaaatgagtgagttgtatggtataaattacatctcaataaagctgttttaaaaacagtgacatgatatttgatgactttaaggaattacagctaatataacaattatattagggaaatatatttttaaagagctcttatctcctaaaaatacattctaaaatacttactgataaaatgatataatacctagtttttgcctcaaaataatacaggaatgaaaggagatgttgaggataaataaaattagtctgtagtaattgaatcttggcaatgagtggagaagggaattcagggctcattatttattctttcctatgtatattgttgaaatgttataaagatttttaaaaggggagtagtttaagcccagaaatatacatctccacatctagccagatgactctcataatacctacgtgaagaaatcatgatatagaggaaagaattcaagtgatcaaaatgggatcatggttagtttgggaaggtggacaggaaagactaatagcctgaggtaggaggtgggagggtgaataaaaaattttgaatgtttttatgaggtcaaagaaaagtatagtgccagcatgagaactaaaagacaagaaaggttatattcagagattcagatattgtacatttattttctattaagaaagagttctaggtcacccatataggtagacagtggaagtaataatctatacaagcaacaattcagaccctaaatttgggaatgaaaagagatggaagtaaatactgtctttgtagtaggcagtaatgacagaagttggcaatgtgggcatacaggaactagtaaaaacaaaacaaaaccaaaaaacaaaaatggaattactcccaatggggaagaagatgcttgctggcaaagtcactactccctctatacttttgttctctccctataaacgtggatacacagataaaattatacttgaggccaggcgcagtggctcacgcctgtaatcccagcactttgggaggccaaggggggtagatcacgaggtcaggagttcgagagcagcctgggcaacatggtgaaaccccatctctactaaacatacaaaaattagccaggcatggcggtgtgtggctgtaatcccagctactcgggaggctaaggcaggagaattgcttgaaccccgaaggtggaggttgcagtgagccgagattatgccattgtactccagcctgggcgacagagcaagactccatctcaaaaaaaaaaaaaaagaaaaagaaaaaaaattacacttgaaagaactacacagttggagaattatatatatacaataaaaaagaacatctgataacactgctaagaagttactggcattttatttggtccgttattgggtcaacaacactcaccacagccacttccacccaaaggaagatttttttttttttggcaagaaggaggatgcttctttgatccttgtcatcgcctgctgcttttggcaaggaggaataaagatatgtggagcaccagccagtgatgtatgagggatgtttatactaaagccatgtatcataagctctagagcacaggaaaggaggggcaaatgacagtcactctatagagaaacagcactggaaggaggactgttgaaatatgaattagaaaaaagtttcacttttctgaaaaagaaaaagggttgtaggaaaggagatgtgaacatgtaaatgtgcctgacacatctgccgagaatggagggggaagaggattgcaagaaagctatggaggcatggcagtcatagcatgagaaaagagacaactttgctatggtttggatatggtttgtccccaccaaatctcatgttgaaatttaattgccagtgcaacagtgggaagtcactggagtggaccctcataaatagatttaatgccttcttactggagtgagttcttgttctcatggggatagattagttcttgagacagtgagttgttataaattgaggttccaactcctatctggttcgtttttgcacatttcggttccccatttgaccttccaccatgtcatgcagcatgaaaacccttgcaacaaagccagtgccatgcgcttgaatttttcagcctgcagaactgtgagataaataaacttcttttctttaaaaattaccaagtctcaggtattatgttatagcaacacaaaatgggccaaggcactcttcaataccagttttatctgaattcagtaagttaatactacatgcgtgtaagaaggtaaacacaaaaaggcctgtactgctgtccaaaggtacacatggttcaatatgtacagagccttcacaaggcaaagtgatagtgatattgagactatagttaaaatcattctaaaatatcccatggaatgaagaagccactatctactgtcagtgcttggtagaatcttttccatttctggagatgtgtactttgaaagttggaatagtattacttagagttgatttcaagccttttcaaaatatggaaaaaaatcttaaaataaaaactattaccaagttttctcaaatattggtgagatttaaccgcctcattacttgataatgtagaaattatatttattagcataatctgatttcatacttttttcttcagtaatttcactgggaggagggaggtattcattaatgggctaaggtaactactaaactgttttcctcaatttgagttgaaagcaggataaatacaccaggcactgctgaaacaaaatttttaaaatgacctaaataagtgaaaaaaactagcagtgtcagcaattaagcttgaattttaaaatattataatcaatttttttaatgaacagaaagacttaccaatctacatgtaagaccaataactgctattggggtctgtgcagactgagaaatgtcaaaaagattatagagaagtgtttggtttttatgatgagcaaaaagatcaaattcatctaatatgaagatcactgggcaactgctagttcggtcacctaagataaaataagagcattacattaataagaaattatatccacctttcctaaatttccaaaccatttactatatttcagtttttaaaactcaattctgtaaacattctgatagcctactttgggtaggggatttactgatgcatatacgttcattcaacagaaaaaaattattcaaaggacaaacacagccccgactgctctcaagaagttcagtctaggctgggcgtggtggctcatgcctgtaatcccagcactttgggaggctgaggtgggtggatcacctgaggtcgggagttcgagaccagcctgacaaacatggagaaatcccatctctactaaaaatacaaaattagtcaggtgtggtggcgcatgcctgtaatcccagctactcgggaggctgaggcaggagaattgcttgaacccaggaggcagaggttgtggtgagccaagatcgtgccactgcactccagcctgggcaacgagagtgaaactccatctcaaaaaaaaaaagttcagtctaggccgggcatggtgactcacgcttgtaatcccagcactttgggaggccgaggtaggtggatcacctaaggtcaggggtttgagaccagcctggccaacatggtaaaaccccatctctgctattaaaaaaaaaaaaaaaaattagctacttgggaggctgaggcaggagaatctcttgaactgcggaggcagaggttgcagtgagctgagatcacaccattgtattctagcctgggcaacaagagtgaaactccatctccaaaaaataaaaagtgcagtctagttcctagactctagtagagtttgttgttgaaaaatgtcaaaaatcatttaaatgactaaagactattatttttataattacgtaaatataattcttatttaatgattataaaattgacagagttttctatacctacacagaaccaaaacactttaagattaaaatataaggggagtcactaattaatgaacaaaactaatgctttaaaagagagttgtttatttagtagaaatacaaggtacatttcttgtagaaatactttttataaacaaacttgtagattataaagttcaactaaagccacttaaactcccttgaagcacaacttttagcatttcaactacaatgcttttcatggggaaagttccacatcaccctctggttacatttttctcacttcaataatggaaacaactttagtaaaagaatcccttttaccttaggcttaacgcctttatatttgtgttaaaaagtgaaacaaatatctgataaaagaaagacttatttcaacaaataacaaatacagtagcctaaatgacttaatactggtacaaaaccaaagggattactcaaaagtctagaaagagacttatgtactaatatagaattttagtatttgataaaatattgcattatacatcagtggggaaaattagtctattcaaagtcagatccctactttacaggtaaaatcagaataaattccaaacaaattataaattacaaatatatatatatattaaataaaaagatggatcaatgaatgtttttataatctgaaggagagaaaaaactttctagataaacttaactatgtggaaaacataaaactttagatcagcagaaaagtccaaaccaaacttaagggaagagaaaaataaaacacaaaaattccgataaataagcataacataaacattaccacaataggtcaaagacccaacaggaaatacagtcgtgtgtcccttaatgacagagatacgttctgagaaatgtattgttaggtgactgcatcgttgtacaagcatcctaacagtgtacttacccaagcctagatggtatagcctactagacacctaggctatatggcatagcctattgctcctaggctatgaacctatgagcatgtgatagtgtagacaactgtaacacaatgcgaagtatttgtgtatctaaacatatctaaacacaggaaaggtacagtaaaaatatggttttataatctaataggaccactgtcacatatgtggtctatcattgaattaaaggttgttatgtggcacatgactgtacataaaccaggaaatttcaaaggtcaataaaaatatgaaatgacaagcatcaccactatcagaattatgcaaattaagtaaccagaattatgcaaattaaagaacaaaattattcaaattaaactaagagctgaaagtttttctattatatgggcaaacataaaaataataattgtttttgaggttgtgaagaaaaaggtattatcaaatatttttacaaattaaacctttagggtagtttttaaatgttaaagatggtgccttttaacccagaattctacccacagaaatttatcccaggaaatatctggatgatcatcaaagtatctcttcttaattataaaaaattagaaacaaaagcccataattggtgattaataaatagcaccttataaaacaagaaccataaaaatgatgatgcagatcaaaatcttattacaaaataggtaaaataattttattgttgtaaaaaatcacatttatctctatcaataatatactgatataaagatcagtatatcattgaataaagataagaaaccaaatgctaattgagataatcactgttatagtggtgggaatacagtgaacattgtattctttttaatgtttctgtattttatgagagcttttttttttggcaaaagcttgtattacctttataatcagggaaaaaataaagttaaaacagatcttctgaaacggctgaatatgttaatatttacctttttttaaagcttccagaagaaatgaaaggttttcagcaaagcttccctgaacaacaaaatgagataaaatgattaaaagtttagtgaaataaagaacaaaagatggctgtctgattctcaaattttatataaacactgtatatcttctagttattagagtcattgcccagactctgctgagtgtctctatacttcctatctaaaacttaaatacttaagcaaagatggcacatcactgaaaatggcaattacaatgtcatctttgaaattttatattttagaacttgaggataaaacggtcaaagaagaaaaagaaaagtaagaaattttatattttccggaaaaaatctgaaagaatgttaaatttatttgaaggtagttttgtagaattgccatattctaaatatagtttgagacctagaaatggattctactttgtgtcttcaaacacaatggggtcttgcaagtctctaatttgtactggtaaagaaataaccatgaatttaaatgagaaacaaaaagaaaaggcttttttgaaacattagatactataacagtgtttgtctattcaagagtatactgaagaatttatgtatatcatatcatgtttggctatgtttacttggaatatagccaaaacatttttggatactattaaatattcttgatgaaacttagtgtagtagatgcattatccaggtgctccagattgtgggtagaagccccattaaaatatttgtttcattaaaattattaacttttacttcattcagagttcataactaaaagaaacagccaactttaaatttgaggagatataaaggagaaaagaaacacacttattcactctccagttgagagatctaacataaaaatagcataaaggttttaaaactttcacatattgtgatgttgttatgctatttccaaggcaggcagaccaagaggtgttatccataatttaccgtaatataacaaatcctcaaagagacaatctgttgggaaatcagtggtcagttactcaaaggtagcttgtctttcaggctttttgcttaaaagattattacatctgatactaagtatatgcttctataaatacgtatttgtgcatgtataatatacatatatatgtctgtttatatcaaaccagaaaagctgtgggttgaattaagtgacttaggttcttataatgtccaggctctgccattttatgaccttcggcaacctaattatgctctctgagcagaagccaaatttatataatgaaggaattaaactattaatttctatagcagtatttctctattcaagagtacattgaagaatttatgtatatcgtatcatgtttggctatgcttactcggaacacagccaaaacatttttgggtacaacttaaactaataatctctatatatgataataatagcgaagattagaacagaatgataaaaaattgtcatttttattatttcacataaaaccaatatgaatatgtaacatttaaaaatgtcagaaacacctacccagatcaactgggaaccaaaagccaaactgagcatacttaacaagaactgtctttggctcagtataggccactagcttcaacatcacattctaaacaggaggtagaatattagatttatagatggggcattttgaaactgcacttcaaagacctacagactttggaagggacaaatttactcaaccttttagattagattaacattttatattaatatttttatagattaatatattatattaataatttagattataatctataattacatataataaactataattatatataatctattagataattatatagatataacctattatagaattacatagattatataattatataattatataattaataattttatagagtatataattatataattaataattttatagattgattattaaagaaagaaactcataaatgctaggagtcttacacaactatggcggtgtcattgcagcacaaagcacacagttcagaaattagagcgatgccaccgcatggtcaccagtaaccagaaaatgaagttggaatgtgtataatccactccaactgcataagcagtatgaggctaggtaatttcatcatgaaaattcaggtaggtgcaaaattaaattatcatgttttccttaggccctatatattaggtgaaaggtaaaagtttaatacaagtttcaaaacatttcaagtcagtttcttttactgatgttgttcactgccctgagactataagatgatatgataatgaagtatgaataaatttctgaaaacagaataactgacatttgtacagcacattaccatccagcaaattattttttaagttaaatgatgtgtaatgttttctttcttcttcaaaataatcctgtgaagtatggataataaaataacgcccaattaacatgtaaagaatctgaattcagagatacttgttagctcaggattatcaggcagtcaaagggttgtaaggcatgactgaaacccacctattgcagcctcaaatttagcacattttctactatacacaggctactcaagtctcaaaaaagtagaaataggctgctggagcatggtatttttaaaaatgtgttaatctatctccagagatacagaatcaaagtattcaccttacagaaaatgaaataaactcagaatatctacataaacttgggtttcttagctattttacagctactataacctactatggaaaaatccaagtattgtagacttaatgactaaatgtatcctatacattacacatttttatgaaagaatctcatatatttcaattaagaatttctgaacctctccctacccttccagaaatataaaaatatacatggtataaagacattaccttaaaagtctatttaataaaataactgaaatgatacttacaaaaactttatctccaactacattttccagatttaactgccttgtgatttcctttagggcgattttgtcattgatctgcagcagtcctaaaataaagtccatttaaaagtatttaattaaaattaaacatgtatttgatacagcaggttgttttccagttaagtaaatcttcccagtcaaagcctgtgagttcatatcactttcttcttaaaacttagcaataaagacattcggtagaatcaaaaaacaatcctccttgggattagaatgattaaaaaaaaaaaaaccaaaaaacccacaaaaaccagagtccttctgcgactccttcattattattattttaatttctaaaaatactgcatatggtgtgctaagtaaaacatggatctagttttcaaaatctaactattaaaatggatttgaaatatacaagtcatataaaaaccccacaaagtttacataatctccaatggcaaaataatggcatacttaccatttaagtgaacttgtaatacattttcactcacttcttctatttccatgagttctttcaaagcatgatttattaactaaatatgaaaagtttatgaaataataataggtaaaagataaaaataagtccatattcgtttttaaactacaagcagtaagaacagaatataaataaattgacctctttaacaagtaagttttcaaattctttacagataaaaggtttaactagaacatctcatatctgactctttttaagaaacaagagccaggactgatacaatattctctcaatcacctacccgaacttttaatacaaatttagaaacaaccaagttttaaaataaatatttctctacatgtcacattaaacatgtgacatggcccttataaacttcatgtctcagttagtacattacacatctctctgacaattactctactaaatatcattgtaatcagttaaaagcccattgaattaaaggtttctatgaagcatacttttttaaataacattgtattgctcttgtactgtgatatcatacatatctcttcatattaccaatgcattcttttttttaaagaatttgaaaatgaatgtaattaagaaaagccaaaaacctatttaaagagtaaagatggactgttccttccaatattaaaatataggtactatcataaataagtgaactgggaaaagcagttgtatacacaaaatattaatagagatggcatcaaaacttaggacaaaaagtattactcaacgaaggcactgggacaactggtaaactattttccaaaacaaaatactgtttgtatttgcaatatgctacttatttgtcattgcaacaccttatctaaaaagaaaaaagcaaatatgatcctcattttaaattacatatgtttcataacaagacaacaaaaataaaaaaaatttcctgttatacctgcatggtttttaaagcatagggaattccaggtcctctgaaaaggagacaatctcaagatatcacctgtcatactaccagtaatagcccaactgagaagtgacatttaatgagaagtgacatttaatgagaagtaacattaaaggactgcatagaggtacttcttcacctctggatcaggtcagacactataataagagtacatccctagatgatacagagttggtctctcaaaacagtgctttcagcaaaaattttttattttttattttttttgcaatccatggtattttctttcttccatctcttgatattttgcttaatatattttttcctaggttatgattttgttttaattcatacaatgttttatgttttgatgaattattcaaaaccatttcaaatcctttgctaaaaggaatggggattttaataataccttccattttatatatgcataaggagagttgtaacagatttatagctttctttccactcaacttactttaaacaccaacttatgctttgcttggatcagcccactaatattttatgggttgtgtgtatggtctgaaatgataaatatattagcaagtgagtcttcaaataatgttagttctaatctgggtattgctaaaatttattgtttatgcaatcaaccatttaagttagcttttttcttgaatatgttatcatttcaaatatttaaactacattatacactaaaaatatttagttggttattaatatcacactgaccaacataaccaaatttggtcatctcctttccacattctttgtgcctaaaatttaattttacaaacatactaagataattttcttagacctcccaacatccagtaatttttatgctcaccaacttatactattcccaaatattataataaacacaggtttcaccaatatgcaactaggagaaatatcctatttaaccatctagcaaatttgtctacagtaaattgcatgtgtaagagcattttctaagggtcggtacagtgggtcacacctgtaatctgagtgctttgagaggcagaggcaggaggactgcctgagcccaggaggttgaggctttagtgagctatgattgagccgctgggcgccagcatgggtgacagagagcctgtctcttaaaacaaaaaaaggtattttctaggggtcaatctgtcacttgaagccatatcaattttttttttaaataaaatgcttgtaatattataagccacactattgcctttttcaattaactatagagttagcatttttgtatttcagacagtttggccaagtatagtgttttaaatatactataatcttagggttaggattaggggttaaaacaaacaaacataagactacagtcttatgttttaaaatttgaatttatataattatactaatgaggctaggcacagtggctcatgcctgtaatcccagcactttggaaggccaaggtgggtggatcacttgagcacagcagttccagacaaacctggtaaacatggtgaaaccccatctctactaaacataaaaaacttagctgggtgtggtggcacatgcctgtcccagctactcgggaggcaaatgtgggaggattgcttgagcccgcgaggcagaggttgcagtgagtctagatcgtgccactgcactccagcctgggcaacagagtgagactctgtcaaagaaaaaaaaaaaaagaaaagaaaaagaaaaaaattatactatcgagagttattgtctaaaaataaattatatctgacaatttattcaatctatattttctctcaggatactcccacacatacaacaaattacaaaagtagcacaagtcaaacaatgctcatctcttcaacctgccagcatcagagtacatcaggaatatatgaaactatatcaaaatggaatgccatgcaagggactcttccagattccactatagtgaaaataaatgactgcaaggcaccacaatagggctctggtttaaaaagcaaaaagtagataaactgtcagtgtggccaagaataactgatccattttattaactgataaatactatgatttaatgcttttgcctttaaatttcagtacattgattaaacctataggggtttatgaaaaggtgctataacgtggaagggaacaacaagcagattaaaaagattaagttcagatttaaaatattaagcaagatggctgattagagactcctggtgctcgtactcccaacaagaaaggaccacagcaatgaatgaacagctaagatttgactggcgtgttgaagggagagtactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggaaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttccagtactaggggtccatcttcattccaccaagcccacataggtggctgaacacacaactctagctgcacagagactgagcctataattggttatgactctggtcctacacagcaaggaaaccaaccccttgctgccacacttccagccagagaaccaatctggcagtcccacccagggcaaactctcacttgaggtgaccaaaccagggtggggctctctcccaagaaggagaggcccccgagcatccaagcagctgatacaccccttgcactggcagagcggctatgcacccacactcagaacctgagaaacagccccacaataccgtgcacccctccctcccgcagacatacccctagcttgcccagtggtcctgtgcccacaatcagagcctgaaaaatagcccagaaggttacccctggcaggcatgcccccagcccagccgagcagccatgagccatgacctgtacctgagaaacagccctatgggccacccatggtgaatacacctcccacagggtggccaagcatccctgtgaacacatactaggcctgagaagtagcccttcaggccattcttgagcctgccaagcagtcttgtgctcacctcccaaacctgacaaacagcacagcctccctataactccatcagacatgccccaggaccagccaagcaatcatgtgcccacgtcgctaacctgagaagtacacttgccaactgcccctaacagacacattaccctagctggctgagcagcattacaccttaggcctacaaatcagccctgagggttgcctctggcagacactcttttgggccagtcgagcaaccctgctcctacttcccaggtctacaaaatggtccagtgggccatctgctgcagaaaagttcccaggccagccaagcagcagtgtcacaggcctgagaaacagcctcacaggacgcctctagtgggcatgcccataagccagctgaatagccttgtgcctgcatcctaaacctgagaaacaatcctgtggaacccctcagcagatacggccctaagccagtcgaggaactgtatccctacacctctgttgggatcaagcagccttgcacctggatcccaggcatctcctgggcctgagaaacaaaccagtgagttgttcctggcaaacattcaccaagactggctaagcaaccacatgactatgctcctggccacattaatagccccatctgccagtgtgtcagatcccaaggtgattgacccaccatatgcatgcatatgcccccaaactgagaaccagcccagcaaacccaccccttgcaaagctgtacaactgccaccacaaacaactctcagcctaggccactgagacacttgtaaatgacactagtgtggattacagctgaaaaaactacacaaagaccacactactgtatccaactagaaccaaggccaatgaaccacatcaaactgacacctcgagacacattgacacaaatcagtacttccttacgagatcaattctgtaagattggaaaagacaattttacttttctacctgaggcgtatcaatcaacatagggacacattaaacataaaaaagcaagaaaacatgacacttccaaaggaaaacaataattcctctagtaacagacaagaatcataaagaaatacagaaaatgccagaagaatttaaaataataatcttgacaacactcagtgaaattcaaaagaatacagatagaaaattgaacaaaatcagaaaaacaacttgtgattcgaataagaaattaacagagataccataaaaaaacaaacagaaatcctacagctgaagaagttaatgaatgaaatagaaaatacaactgagaccttcaataacagactacatcaagcataagcatttcttaaattgaagacaaattgtttgaaataacacaggcagacaagaaaaaaaatagaatgaagaaagtctacaggatttataagacttcaataagtgaacaaatatttgtattattgtactttcaggaggagaaaagaaggaaaaggtgagaaaaacatatttaataaaaccatagttgaaaacttcccagttcttgagagaggaatggacatccaaaggaagctcaaaactccaaacagactcaacacaaacagaaggtcttctctgaggcatattatagtcaaattgttaaaagtcacagacaaataattaaagcagcaaaagtaaagtgtcaagtcactataagggaatccctattatactaacagtagatttcttcttctttatagcagatttcttttttttaattaaaaattttaaactatcatttttttaaatgatattttaaaacatctttcatccttcttgtttacattttagctgattgtcagaatatacaacagcagatttcttaagagaaacctgacaggacagaggggaatgggatgatacaatcaaagctcagaatgaaagaactgtcagctaagaatataatacccagcagcttcagaaataaaggagaaataaaatctttcacagacaagcaaaaactaaagcaatccgtcatcactagaccagacctataagaaatgttcaagggagtctaacatccacaaatgcaaagatgatgaccaccatcatgaaaacagggaaaactataaaactcactggtactgcggatacataaaggagaaagagaaaggatcaagccttatcactacagagaggcacccaactggaaaaataaatgagaggaagtaagaaacaaaggatatatgaaacaaccagaaaacaatcactaaaatgacagggtaagtcctcacttatcaataataatcttgaatataaaccaattaagtttcccatttaaaaaatacagaacagataaaaaaaaaaactcaattatatgctgctacaagaaactcacctcacctgtatagacacacagacttaaaggtatgaaaaagatatcctatgaaaatggaaaataaaagtgataagaaagttgtaaaaacaaagaacattatataataataaaaggatcaattcaacaacagaatataacagttgtacatataaatgtacccaacactgaaacactcagatgtataaagcaagtattattagatctaaagagagataaattgcaataaaataataggaacttcaacaccctattctcagcattggacagataatttagacagaaaatcaacaaagagacattgaatttgaacttcaccatagaccaaatggacctaaaatacatctatagaacatttcacccaacaactgcagaatgtacattcttctcatcagcacacagaagattctccaagactgacctcatgttaggacacaacagaagtcttaaaacatttttttaaaaaaagcaaaatcctatcaagtatctgatctggccacaatggaataaaactagatatcgataataaaaacaactggctaggtgtggtagctcacacctgtaaccccaacactttgagacgccaaggtgggaggatcccttgagcccaggagtttgagaccagcctgggcaaaatagggagacctggtctatattttttttaaaaagtaataataatgacaggaacattaaaaactatacaaaaatatggaaattagacaacatgcccatgaacaatgggcaaaagaaattaagaatattacagattcctagaaacaaaagaaaatagaaacacaacttactaaaacttaaggaacacacagcaaaagcagaattaagaggcaagtttatatcaatatatgcctacatcaaaaaactagaaaaatttcaaataaagaatctaacaatgcaatccaaaaaattagaaaaattttaaattaaaaaatctaacaatgtattccaaagagctagaaaagaacaaaccaaaccccaaattagtcaaaggaaataaatatcagagaaggaataaacaaaattgagactaaaacaatactacaaaaaatcactgaaacaaaagttgcttagctagactaagaaagaccaaaataaataaatgagaaaagaaaaaggagacatcaaactgaatatcacagaaataaaaaggatcattagggactactatgaagaactatacatcaataaattacaaaacctaaaggaaatggttaagttcctggacacatacaacctttcaatattgaagcaagaagacacagaaaacctggagagaccaataacaaataatgaggtagaatcaggaataaaaagtcttccaacaaaggaaaatccagtactggatggctttgctgctgaattctactaaacccttaaggaattaatgccaattcttctaaaactattccaaaaaattcaagcagagaaaattcttcctaattcgttctatgaggccagcataaccctgacatcaaaactagacaaggacaaaacagcaacaaaaactacaggtcaacatctctgatgaatatagatgcaaaagtcttcaataaagtattagtaagctgaatgcaaaaagatcattcaccatgatcaagtgggatttatcccagggatgcaaggatggtttaatatacgcaaatcaataaacatcatacaccacatcaatagaatggaggccagaaactatatcatctcaatggatgcagaaaaaaacacgtgataaaattcaacatcccttcatgatagaaactgtcaaaaaggtatagaaaaaaaacaccacaacacagtaaaggccatatatgacaaacccaaaaccaacatcacaccaaatggggaaaaactaaaagtttctcctgtaagaactggaacaatacaaggatgttcactctccccattcttattcaatatagtactagatgttcaagccaaagcaatgggaaaggaagaagtcaattcattcctttttgcagatgacataatcttatatatagaaaaacctagagactctaccaaaaaactcttagaatttcagtaaagttgaaggctacaaaatcaatatacaataaccagtactgtttgtatatactaacaacaaactacccgaaaaaaaaaaatcaagaaggcaatcccatttataagagctaccaaaaaaacgtaattactgaggaataaattcaattaaggaggtgaaaggtacagttttgtacaaggaaaactacaaagcactgaagaaagaaattgaggaggatacacacaaatgaaaagacacccatactcacatgatagaaagaatgaatattgttaaaattactatattaccagaagcaatctacagtttcaatgatattcctatcataacactaatgatattcttcacagagatagaaaaaaaatcctaaaattcatatgaaacaacaaaagatgccaaatcgctaaagcaatcttgagcacaaggaataaggctggagtcaacatactgccttacttcaaatatactacaaagctgtagtaaccaaaacagcatggtactggcataaaaacagacatgtagaccaatagaacagaatagagaacccagaaattaatctgcttatcaacagccaactgatttttacaaaggccaagaacactcactcatcagggaaagggcaatttcttcaataaatggtgctgagaaaactggatatgcagaagaattaaactagattcccatctctcatcctgtacaaaaatcatttcataatagatcaaagacctcaatgttaagacctgaaactataaaactactagaagaaaacataggggtaatacttcaggacactagtctaggaaaatatcttatgaataaaaactgcaaatcacagacaacataaaaaaatagacaaatctgctaacatcaaactcaaaagcttctgcatagcaagggaaacaatcaacagcatgaaaagacaatctacagaataaatgaaaatatctgcaaagtattcatctcatagggattcatatccagattacacaaggaactccagtatctcaaaagcaaaaaaccaatttgcttaaaaaacaggcaaattatctgaacagacatttctgaaaggacatacatatagccaacgaatacatgaagaaatgcttaacatcatcaatcatcagggaaatgcaaatagaaaccacagtgaggtatcatctcactccagttaggatgtctattttcagaaaaacaaaaaataataaatgctggtgaagatgcaaaaaaaaggaacttttatacaccattggtgggaatgtaaactagccaatattgaaaacagtacaaaggttccccaaaaaccactacaaatagaactaccatatggtccagcaatcacactactgagaatttatataaaggaacggaaatcattacatcagagagacatctgcagcccgtatttattgttgtactattcacaatagccatgatatggatcaacctagttgtccaacaacagatgaatggataaagaatatgtgtatatacacacaatggaatactgttcagccattaaaaaaagaaatgaaattctgtcattcacagcaacatagatggaactggaagaagttatattaaatgaaataagccaggaaaagaaagttaaacaccatgcgttttcactcatctatggaagccaagaaaagtaggtcttacagaagtcaaaagtagaagagaggatagggtaggaagggtaggaggaaaggagggatagtgagagattcaataatgaacacaaaattacagcaagataggaggagtaagtaacagtgttgtactatcatttttctgtaactataggatgactataattaacaataatattttccaatagctagaagaaggatactggatgttccccacataaataaatgataaatgtttgagatgattgatatgctaattattctgatttgatcactatacactatatgcatcaaaacatcactatatatcccatgaaagtgtataattattatgagtcaatttaaaaataaagtataaaaaggttaattactacctaaaatgactattttatgaaataaatgttttgagctatttaagccagacttagacaagaagaaaagattcttagaaaactgaaatgcaatatcagattagaagaagcaaatgacagcactggcagtaaagaaaatcacattggccatatgacagaatgctgagagagggggaaaaaacatgaaaaagatggtagacatggaaaaatgaaaacaaagatttaagaactgaatattctaatattggatattcattttttctaatcataagaaaaaatgaaagaatattcaaaaataaaagaatattattctttagtgaacaataccctctaaatttatactaaatcagtatgcagagtattagtgaattttatgattaactgttagacatagtctatgaataactaatgcaataaaagaagaaaaggaatagaagtatggagatagggaaggaataattaaaactgtctttgttgacagataacataactgtctaagtaaaaaaatctcaaagaactgacaaaaaaactaatggaattgagaagcaattatagcaaggttgcagaatacaagcaaatatagaaaagccaagtgtttagctatctactagcaatgaagacttagaaaaggaaataaaaaacacagtactattcgcactagaaccaaaaaaatgaaaaattaggtataaatctaacgaaacatgtgtaagatctttattaagaaaactacaaaaactgacaaaagtcttaaataaatagatactccaagaacgggaagactaaatatagttaagatgtccattcttcctattgtgatgtataaatttaactcaaaatctagcaattcacaaagattcccagaattttctggatatgtacaaagtgattctaaagttaatatgaaaaggcaaagtatgcagacagccaacacaatactgcagaagaacgaggtcagaagactgacagtacttaccttaaagactcactaaaaatctacagtaatcaaaacaatgtgatattggcaaaagacagacaaagcaagggaatagaaagagaacctaaaaacagaaccacataaacatagtcaactgatctttgacaaagaagcaaaggcaattcaatggataaaagatagtctttctccaattgggcattcatttgcaaaaaaaaaaaagaaaaaaaaacgaatctaaacacagaccttacatctttcacaaaaattaactcaaaatgaatcacagacctatatataaaatgcaaaactataaagcttgtagaagatacataggaaaaaatctacatgactttcggtttggtgatgaagcttcagatacaataccaaaatcataatacatgatagaaaaaactgacaaattagattattaagatcaaagacttcagttgggcacagtggctcatgtctgtaatcccagcactttggaaagctaaggcaggattgcttgagctcagggttcaggaccagcctgggaaacatggggagacctcgtctctacacaaaattaaaaaaaaaaaattagccaggtgtgatggtgcatgcttgcagtcccatgtactcaggaggctgaggtgggaggactgcttgagcacaagaggccaaggctacagtgagctgtgatcatgccactgcactccggcctgggtgaaagagcaagaccctattcttgtaagtaagtaagtaaaataaataaataaaaactactctaccaaagatacagttaatagtatgaaaagacatagcaacatcccatctcaaaaataaataaataaataaatgaaatcttctgctctgccaaagacaatgttattattaatagtatgaaaagaataatattcttttaatattatgaaataatattaatagtatgaaaagaaaagccacagactgtaagaaaatacttgcaaaacaaaactgaaaatcagaaatataaaggactcctaaaacctatcaataagaaaacaaataacccaaattaaaaatgggcataagacacctcaccaaacatatatagatgaaaaagaagtgtatgaaaagatgctcaacagcatatgtcattagagaattacaagtacaaacaatgagacaccaatatatacctattagaatggttaaaataaaaagtttcttaaatttaaaaatttaaaaatttgaaatttaaaaacatttcacatagccctcttgtgaaaactacccaaaataacagtgaattcaaatgcaaagaaaaaccataataaaaaactcaagaatgaagaaatagtgattatagaagctgagtatgaggactaaaacaaattaaacatagatttgaaactaaaaaattactgcaaatatgattatatataaatgtgacaatttgtgaaatattgaaagaaattacctagatctaaattctcaatttatattaaacaatacttcagatgtgataacagtaaaatcctaacgtactcatcttaataatgtaatttcaatatacattgcttaaatgttaaaaaaaattttgcttctcatccatttttttaaagtacattggtcaaaaattgaaatttattgtatataatacatgagaacagattttacacagactacttagcattgaaattaattgctttcaaaagttaacacccataatttgtctcctatattgcataaaggatatcaaagaaaagagtaaagggaaataagtaagaatatctttttgaggtaactaagcaaatatgataaagagcaaaaggagacaagaatgatataagatgtgagcatgcactgaaaaactgtgtaagttagggttaaacaaatagtaatgatgtaggaaaaataaaaagaatgcatgatatgatagttccctaacctataacaaagggaaaaaccctaccgtgcagtgttgatgtaaagaataaatgagagaacacaataaaaagacacatagtacatgctcaatacatgctattttctttttccactggaaatctctacttctttaaggacaaaagaccatgttggaacaaacatcaattgacaatttttcactaggaggacaaataagggggaaaaaggtctgctacactcaaatataccaccctaagtttataaagttttacatgtcttctgtgattaaaaaagaaaaaaacaaaaaagtaaaacattacaaaataatgaaaagtattttcagtattacataaaataagatttatatatgaatttatttattcttatataaaataagaatcatcacatgccaacaaacaccagaaatcaacagcttttaccatagtttttcctgatcctcggggtccgataataaggacagagttactctctccatggagagcagttcttttcagcagctcacttaagtgtctaaaatgatataaataggacaaaattttaaaaatgaagctggaatactttgttatgttgtagtttttaaaaggcatatttgaatatgcacagaaatttcctctcttctctccctctgggtacttggcctagcttctgaatggtcctaaatagaaaaatacaaaagaaatagtagggcagtattgattctctgaaatcttcaggtgaaaacgtagtcagattggaatatattgatttatacgatagtaggggacaagggacaatagtggcaactctcgggacccttggattcaaatctcttttcctactaatactctggacttttactccatagctggctgctgggtattaagggcaagatggctagaattctctccacagtatcagataacagaaacaaaacaaaattgaaagttaaagtgctattgcattatggaaatatttgtatctgctcctgcttcatgctatgtggtgtttctattcacaaagcaaaattttttatttctataaaagtgtttgttagctttatttaatatcaaatttgtacaataatttttgcaaaacctggaaggcatctgtaagtaggtccataacagtcaagaggacagctagacttacttgtattgtacttgcactccaaataggttactatgtggactctgacgacaaaatctttcacgtaaaattctttgtacctgatgaaaataaagtgaataaatataaataaaaatattacacatgatataaaaaataaataagaaagcacatttacaatagtcagaattaggtattaatgaatcaattcaaccctccctaaattcttatcctctagagttctggcaccattttcatatgttaaaaaattaatggatttcttacctatctcaagtcccataggaagaatgagaatttagttgtgaaggtttcaacaagagggagaatcactgactttagctatattagcaacttaagggccattgtaatgcatgtgaacgagttaagaaaagaattcttgtaagcagctatattttgaggtcatcttagaactaaggccttagacttagtcatgaaaaattatgtcagataatctaccatactctttaaaaagatggaccattaaagtcgttccttttttggatctgcagctaatacagaggtctttcaaggacaacaacctgagggtgctatctcagatttggccccatgaactggaataaaaaggctccaagaatatttgcttctcctagactgacagcatggaactaatccttcatgtaccaaagaagtaaatctgagttcttgttccatgtacagaggcaaagcaaagaaaatgattcattagggacaaaacaatacatacttgttcattatcgaggaagttaaagagtaaggacattggctccagaagagtctattatatgaattttaaaaggttaagtctgttctaaattttaatttctgtatctataaaatagggacaataacatcttatggcaggcctgtttgaaagattaaaaaagggggctggccgctgtggctcacgtctgtaatcccaacactttgggaggtcgagatgggcagatcgcttgaggttaggagttcaagaccagcctggccaacatggttgaaatcccttctctaataaaaattcaaaaattagccagacgtggtggtggatgcctgtaataccagctacttgggaggctgaggcaggagaattgcttgaacccaggaggcagaggttgcagtgagccaagactgcaccactgcactccagctggggcaacagagcaagacttggtctcaaaaaaaaaaaaaggtttaaaaaaggcaattatttgtaacacaaataggctttgtacaggtaatagctaatatctgtaaaaatacataaaagaacatatatatgcctcaactaatcataatgtgtattcctctacctagatgagatcaaaagaaaaaactcaatcttttccttaaaaaaaaaaaaaaaaaaacccagaaaacctcattaaaatatcttagaggcagtaacggggtataaaatataagctagataaagctacagtgactagtcagaaggttcacaaatctcaaagtgatctggcatagaagttaaataggtatacacatgtattgatattaagtcagctgtacatggaggattcgtgcactttacatacaaaggtatgtaaagcatatttcagttaaaaatttttttagaaagagagttaaactacttccttcaaaaagaaagccaagtcgtataaaagaataccagtaacacttaatttttatttaaaaactacatggagttcaggtcaagctagataaatacaaatgccagggtagaaataccatgctcatttccctactaatctataagcttcttaaggaagagacatacagatagatgctcagcacttggaatacaatatacacttcttataacattcattataaaaacactcaacagatgaggaaacgtaacggaacttcctcaacttaataaagggcatctacaaaaaaatcctacagttaacatcatatataacagtgacagactgaatgctgctgtttctctaagatgaaaacatagacaagaatgtccattcttcccaatcctattcaacattttaaagaaagttcaagccagggcaattaggcaagaaaagggaaaaaaaaaaaaaggcatctagattggaaagaaaaaagtaaaagctagaattctgactacccagacttaataaggataaaattaaattacagtataaaacactaatattaaaaaaaatatatgaactgacaaaaagggcagagaacaatcataacaacaaaatctgttggtccacatttaattttgacagagtttggaaaattttgcttccagatgattgttcttacgaccttgtgctggcatctcgttaaggtctcgtactgatatctccctaaggttagaaagagtgattcttcctaaatgctaaagggaaaattcaggttaagaagataactatttctctgaacagctttacagggtaaaatatcttgagattaatgaaaatacatactaacctgtgaaaggcactctgtgtgaattaagctgttactctttgatttacgactgctcatttcaacaaattcaaatcctttaaaaaaattggcataaatattataaacgtagtgacttaaagagattacttaagaatttactgttctagaattaaaataaatacaagtttttaaaagtaaaaaatgctcaaaccctaagaccttcaaaatcttcgatggcttcattttgtctaagtacaggctgattcaacactctcataccacactttaggcacactttgttttactgtgctttgcagatggtgcattttttttttaaagtaaactgaaggtttgtagcaactctgtgtccaacaagtcgataggcaccatttttcaaacaccatgtccccattttgtgtctgtcagcattttttagcaataaggtattttcaaattaaggtatgtacattttttagacatgctactactgcacacttagtagactagtatactgtaaatataaattttatatgcactgagaaaagttttgggtgattcactttattgtgatatttgcttcactgcaatggtctggaactgaacctacaatacctccaggcctgtatgtggttcttacagctactcctccctttcgattaaatcttctattcaccttccctttcttcctttttctttttttaacttacatgcttcctttatgattctcccacccatccatcccacaggatcatcccttatagaaaaccttccctttcttgctccactcaccaacaatacacaaataatcattacagactaggttaaatgcctcttccttaaacactcataagtgcctgtattttgctttattattgaattattttaaacaaaattgtctgtttaattgctactgtttccaaattgagattttttatattctaagcattgtagcataatgcccaaaacaaagttggcaatgaataactggaatgaaaaaaaaattaatgaaaaaattatattttttgtaaaattctcctcaagtgtaccatactcatagacaaatgactaaaagacctttgactaaaagacctaattttcttagcactgatttcctataggaataaattttaacagatagacagtaacagcttaagcagtgtttaggtatcaggaattgttacaaatgctttgcatttatcaactcatttaatcctcaaaactatcatgtggaataactactattataatcctcttttaaggttagaagacacagataggctaggtatgttgaccaaaatcaaacagtatataaatggaagagccaggatttggatccaaccaagttaaccacttttttaaaaaagtgtattctggtctcatctaatctccagaaggaacacagctttgctaacaccctgaatttagctcagtgaaagacattttggaacttttttactgccagaactcataaaactcaaaaaaagctgacttatcatcaaatcaccaatgattaacattataataatgcgagaatgacagcagcaagatgaaataggaggcccttcagcttgtgtccccaaatagcaacaataatttcacagccacccacggacaaaatggtctttgtgttagcgttgagattcaggcaggcgtctgtgaaaccccagtggggcccaagacctggaaaagtcaattggagggcagatcttcattcacgtgacagattccccaactgtggtccaggcttcagacttggaaagggccctgtcctcccgataggaccttgttaccaggggctgtagcaggatatgaaccctatctggtcccttggcggactggactttttctaggacctcggtctgtacagtggatgaagatatgcagagaaaagacctgttaccaggtgtgtggatggtttggctttctctgggaacctgggagggctcctactggatcactgagtagattccttaacaggcagtactgccctagtccacagctgagtggggctggaactaagctacagggttgcttcagggcctacagtcaagacttaggtcttcaggcctaaggtgtcacaaacctgcatgtctcccttcaggtccttaagttagcgggcctgctgtattgagaggggctggagccacttttcaggggtgtttcagggactgatgagggacctaggtcaggtggcctgtttgcagggctatggacagccccatctccctccaggatgctgggtaggcagaactgctctctgaccacagctgagaggggcttatgccaagattcagggttgtttcaggacctgctgtgggactgaaatctgcctgcctgtcctgaggacacagaaggatgtatctcctgactacaggaggatttctgtgcaggatttctgtaagactgtggctgagtggagctgaatccccgattcagagctttttcagcatatgctatgggacagagattggcaagtctgtactgatggcacagacaggtgagtctcctagcagttccttgtgcaggcagggttgctctcaggctgcaaccaacagtggcaggagctgagcttcagggctgtttcagtatttaatgcaggaccaagttcagaaagcttgacccagggattcagacagttttgtcttcttgtgggtccttgaactgatctcagaccatagccaagttaaagtgtcttatcagggtccgcagttgggactgaggacagtggacttattttctgaggtaccagtgtgcatgaattttcccaggcctcttggtgaacagtttcggtagcaggccaatatccttgatgaatataggtgcaaaaatcctcaacaaatactggcaaatctaattcaacagtacattagatcaattaccatgatcaagtgggatttatctttggaatgcaaagacggttcaacatatgtaaatctataaatgtgatataatgcattaacagaatgaaggacaaaaatcacatgactgactcaacagatacagaaaaagcttctaacagaattcaatattccttcaggtttaaaaactgtcaatatattaggtataaaaggaatatacttcaacacaataaaggccatatataacaaactcacagctaacatcacaccccaaaggtaaaaagttggaagctttccctctaagatcaagaacatgacaagaatgcccactttggccatttatattcaatatagtactgcaagtcctagccagaggaattaggtaagaaaaaataaataaaaggcatccaaatcaaaaaagagaaagttaaatggtctgtttgcagataacataattttatatagagaaaatccttaagactctaccaaaaaactgttagtactaatacatacagtaaagtggcaggatacaaaatcaacataaaaaaatcaataagatttctccacactaataactatttgataaaattaaaaaccagtcctaattacaatagcatcaaaaacaaattagaaagaaatgtaacaaaagaggtgaaaggtctgtcactgaaaactatacaatattgatgaaagaaagtgaagacacaaataaatggaaatatactccatgttcatggactgaaagaatcaatgttattaaaatgtccctactactggaagtgaaggttcaaagtaatccatatcaaaattctaatgacatttttcatagaaatagaaaaaaatcctaaaattcatatggacccacagagacatttaatagctaagacaatcatgagctaaagaacaatgctggaggtatcagactacctgatttcaatacctagtgcaaaactaagataattcaaaacaacatggttctggcataaaaacaaacatacagaccccagaatacagagtcgagaaataaatccatacttttacagttgacttatgttcaacaaaagtgccaagaacacacaacggagtaaggacagtctcttcaagaaatggtgttaggaaaactggatatccacaggcagaagaatgaaattgaacccttattgcacaccatatacaaagatcaactaaaaatggattaaagacaaacataagacctgaaacataggggaagaaaacacagggggaaagctttttgacactggactcggcaaagatttttttgggatatgactccaaaagcagaagcaagaataatgaaaacagacataaaactaaaaagcttcaatcaacagagtgaagagacaaccttcagaataagtgaaactatttgcaaatcttacatctgctaacaggttaaaatccaaaatatgtagtcgctcctcatcagcagattcaaccaacttaagagagagaaaatttagaggggaaaaaaaatgcaacaataaaaattaatataaattttaaaaacaatacattataatagctatttacaaagcacttacattgtattagaaattataagtaatctagtgatgatttaaagaatatgggatatgtgtaggttatacgctaataccatgccaatttatagaaaggacttgagcatctacagattttggtatctcaggggagtcctggaaccagtttcccgtggatacagagggatgactgtataaggaactaaaaaaaacaaaaacaaaaacaacaacaaaaaaaacttaatagcaaggaaacaacccaatttaaaaaatggtcaaaaagatttctcacaggacataaaaatgtcaaataggtatttgagaaaattctcagtgttactaattgtcagggattttcagggaagtacaaacaaaaccacaatgagataacatttcacacctgctaggaaggctattgtcaaaaaaaggcaaaagatgatgagtgttgttgaggattatgaagaaaggaaactcttgtacactgttggtaaaaatgtaaattagtataatcattatggaaaacagtatggaggttcttgaaaaaattagaagtcaaattacatgaccggtaatcccactcctgaatatccatcaatatatacaaaggaaatgaaatcaatatgtcaaagatatatcctcactcccatatacactccagcattattcacagccaaaatacggaatcaacctaagtgtccatcaatggatgaaaagataaagaagatgtggtatatatacacaatagaacactaactcagccttaaacaaaaaagaaatcctgtcatttgcagcaacatagatgcatttgggagatattctgttagctgaaataagccaggcacagaaagacaaacaccacataatctaatttatacagtagtctctccttatccatgggagatgaattccaaggcgcccctcgcatgtctgaaatcatggatagtacccaactctctctatatactatgttcttttaatctgataacctagatggctactgagtgattatgggacacatgcaatacacagcatggatacgctggacgaagaaattatgtatgtcccaggcaagacagagcaggacactgcaagatttcatcacattactcagagtggcatgcaatttaaaactcatgaattatttatttctggagttttccatttaatattttggaacttcagctgaccaaaagtaactgaaacaatggaaagtgaaactgaggataagggagggactacaataggtggaacctctaacaggggaactcatagaatgaaagcagattttaaattttcttactacaaaaaaatggtatgtgaggtaacagatatattaataggcttaattttgtcattccacaatgtatacctatattaaaacattatgctgtataccataaatggataagatttttattcatcaattagaaaaaaaacatataaaatatacatcaaaaagcaagtaagtgcagagccaggatttgaatgatttgaacccaaataagttgtactcttatgaaattgttacgtatttagcaaacttttttgaaaaaagaagtacaaacacatttcaataacctgaaggaagatcagccaatatattttacattcacatttattaatttcatatagtgacaattagaaagcaaaccatggtaatgctgttttcttctctagaaatgttaacaggtccttagctgagccaggccttgacagacagacagcaagcaaatctgtgtcctccttaatgtgtaagccaggtagctaaggcctcagccaccaaaagtcctctggctccaggcttcctaattgaaaattaaataacagagtactcaattattgtcttgacccttaagcatcttctttcttagaagaaaagtggtcttctcagctgtcttaggataccttctagcagtcttttatatctaaagttttatcttattctattttttatttttcctaatcagtgttatgagagggaaaaacctttttagctaataaaatatcctcaactctggtttatgatgctcttgactatcagccaaaatctaaaatcacaaagaactatgtaataattgtctcctagattataagactaattaaaatgtaaaaaggagaaagggcttttgcagtatgttttattttgtagaactacattagctatcttacagtattgttagaattaaaagatattttttacccacttcatgaattaagaaagaattactcaaaaaagctaaataaatgtccacagttccaaggcaggtatctaatctgcccctttgcatcatatataaatcaggtaagctattaagataattcattttttcttcatgtggggccagcattcataaaagaaacaacaaacatgccactatggtatctaccttataacctacataaattttgactgtaaataaagttttagtccaaaggttattttgacatcttcccccttcatgtaatggtcaaatatctactatataataaagaatatttcaaagacaattctaatagtacagatgagacaagcttcagactgggagaaaatacctgcaaaccacatatctgacaaaagatctgtatctaaagaaccctcaacactcaataataaaaaaggaatcccattagaaaataggcaaaatacataagtagacatttcaccaaagatatgcaggtggcaaataagcatatgcaaagatgtttaatatcattatccgctaggaaaatgcaaagtaaaaccatagtaagataccaccacacactgattaaggcagctaaaataacacaaagatggtgaggatgtaaagaaaatgaatctttcatttaaccactggtgggaatgtataatggcatggctactctgaaaagtttcttgacagcagtttcttagaaaactacaaatactcttaccaagccacatagcaattgcactcttgggtacttacctgacagaaaaacttatgttcacacaaaaacctgtaacacgtatgttcatgataaatttattcgtaatagtcaaaacactggaaccgattcactcaatgagccaatggggttaatgaattagttccactgatgctttgtcactgaagtcaggaagtacccagacagtaagggactgccttttgaagttcttctgatattggacaatgcccctggctacccagaatcccatgagttcaacaccgaaggcttttgtccaagtggtccactggtccccaaacacaaactctctaattcagcctgtagatcagggggtcatagggacctttaaggttcattacacacagaactctatggaaacgaatgtcaacactatggaaaaacctccacagacagaacatgatgaaagtctgggaggattatcccattgaagatgccctgttgtcatagaaaaagccatgaaagccaacaagactgaaacaaatttctgctgaagaaatctatgtccagatgttgtgcatgacttcacaggatttactacaaagccaatcaagaaaatcatgaaagagattgtagacacggcaaaaagggtggggagtgatgtgtttcaacatatgggtcttagagaaattcaagagctaacagataccacaccagaggaattaacagaagacaaggtggagatagatgcttctgaaccactgccagacagtgagaaagatgcagaacagtgccagaaaacaaactgacattagacaatctggcagaacggttctgaatatacaagactactcttgacttcttttacgacatggacccttctatgatacaggtactggaatcaaagcaaatggttgaggaagggttgatactgtatagaaacattttaaaagaaattagaaaccaaaagagatagacagaaattacctgtttagttacacccagtgtgcctaacctgtcttgtctccccttctacctcctccacctcttctacccctaggcaacaagatcaacccctcctcttcctcctcagcctactcaacaggaagacaagtaggatgcagacctttacaatgagccacttcaacttaatgaatagtaaatatattttctatatatagtagatatattttctaaatatcttttctttaccttactttattataataatacaatatataatacatacataaaatatatattaattgactatgttaccagcaaggcttccagtcaagtaggctattaacagttaagtttttggggaggcaaaagttatatgcagattttcaactgcttttggtagggagggggtgtttcgacccctaacccttacattgttcaagagtcaactgcgtatggaggaaattctcattactgcagttccagagcactactatacatcagagagctactgaccattttaaatttacttctgtattgacaaaggacaaaaattataggaattgtaaaaatgtgtcatctaaagctgtctgctctctaaattgcctatgtgcatttccccatgacagtaagtcccctacaatctatacctttacaaaggaagggatgaattctgaaatatattcactgaccactacttactgtatctgtatttgaaattttatagttacatgctaactaaagcaggatgactaaataatctcaagactcaatcacatgtatattcatactcccatttttcaactgaggtggcttatttattgtaattctccattcctatgctttccaagggttgcttgttgataaattctaaaaattatgaagtacatcctttactgctcttgaggtttcatgagtacttataactcttctttctcatgatgccttcctcagatccaaaccctcactcagagcctctttgtctaccacactgattctgcataatgtattttagactaactctgtttggccaacaataatgataactattcagtaaactctctgttttttttgtttttttgtttttttgagacagagtctcgctctgttgcccaggctggagtgcagtggcgctatctcggctcactgcaagctccacctcccgggttcacaccattctcctccctcagcctcctgagtagctgggactacaggcgcctgccaccatgcccggctaattttttgtatttttagtagagacggggtttcaccatgttagccaggatagtctcgatttcctgacctcgtgatccgcctgcctcggcctcccaaggtgctgggattacaggcgtgagccaccgtgcccagccttagtaaactctcttaacatctaaagacagaattagaaaatagctgacactaacaacttattcctacatatagctcaatagccattcagatgtcaaatgttttcctaccttagaaatagaacataaaagccctccatttagtttgcacaactaacttaagctcctcatcttaggttagttctaatcactgttttttagactaacataatcctaaactttgtgggagaagcaacctggatgaactcctggtgacagtccttcatgtcaaatttgaagtttggtcaatttaccaaatacctctctgcttgctgactagcaatggtatacaatgacctgcccaagatgacatagcttacttaacagcagcagtagctgttaggtctattgactcccaatcagaggttggttagtctcaactggcatgaaaaaaaaccctgcaaacatcagaaagttcatcaaaatcatcactgggcttttctttaggagacaaaacatagcagaggaatacattctgaaagaacacggttattataacagatgttcaataccaacaattcacttctctttgaatgtctatgtgtacaatttgtatttttttctgtacacatctttatttttaagatcataaactttcttcccatcgctaaaaaggaatacatgtttcgtacagaaactctggaattttaattaggaattgtgcagataaaatggtaaaaaatggaatcagagaatctttctcctctaataaaacaaaacaaaaaactgttaaacagaaatactttagcagtaactaaacaaagagacaagttaataataaacaagcctagaaaattctacaggagttctccatagttcctaactttaacctcactcttaaaagctatacttgcatcaataaaatctcctaaactctcatcaatgtatcaaatatgaaaagaagaaaactgataaaaactgtaattcaattattaaatttcaagcctaaaaaaaagaattcactgggactcagcctgaaaaacacctacaagggagaaaaaaatgctaaaatatggtgtcataatatctacaaagttctgagagagagaccaagactcatacctagcaaagatgtcactcacatataaaggtaacaggtatagccttatcaaataagaatgaacttatttagtacacagagccaataaagccttgtgtggagtgtgtgtgttgcaggaggatatggggaactcaatgacaaaatccagccaactaaagcataattaaaaacacaattttatacagacacacacacacatacacacacacacacacacacacactagtgacctttgaatccactaaaataaaaaactaaaaccaaaaaaaggtaaataattatagtagcaggtggaaacataagtcgttacacagtgaaaataatcattcaacaaaaaaatgaaaaaaaagtggcatgaatgcatacggttgctaatttcattcttcagagtagaaagaaaatgtctaaacttaaaacatgaagtgtaaaaaaggaacttaaaactattttttttttagacccagggtctcactgtattgcacaagctggatttgaattcctgggctcaagagatccttccgtctcagcctcctaagtagctgggtcaacaccttgagcagcttgaaactttttttaacctaagattgagatctttaaaaaaaaaaaaatctcttgggtttaataaatatctaaagtccagcaattcctataatttttattaggttaaaaatgtggcctgcctacacacacacatactttttcaaccaaaatgggctctatttcataatatttgtcatttaaaagaacaagaactttccatatatagatatatatatgtgtgtgtgtgtgtgtatatatatacacacacacacacacacacaaaaagtaacatattttaaattattttttctacagctaccataaggtaaaaaacaaaaataagaattagtggatcaaattgtttaagaaaaagaaccatgtacctcagctggataatcaaaagtactctagtattatgagcatcttactagtaattacgacgccaggagctgtaacactgtgtacccaaaaaaaagcatttaaggagaaaacaggtgtgaacatgtccgatttatttagtttcaaagttgtccaagcacaggtcaaagaggtaacaacaaacaatttttcctatctttcatataaatggtcagtaaggtggctggtgcaaaataaccctctggaataagaaagtattgtaggctgggcacagtggctcccacctgtaatcccagcactttgggaggccgaggcgggcagatcatgaggtgaggagatcgagaccatcctggctaacatgatgaaaccccatctctactaaaaatacaaaaaattagccaggtgtggtggccggcgcctatagtcccagctacttgggaggcttaggcaggagaatggtgtgaacccgggaggcggagcttgcagtgagccaagatagagccactgcactccagcctgggcaacagagcgagactctgtctcaaaaaaaaaaaaaaaagaaagtattgtaatatgtttacctataaatatctatccaaaaaataagagctaaattaaacttaactaatatttaatatatacattgacaaattttacttggtctctgtatcagcaggtcaagtcatgttactcaacccagacgccctaaggaaagggaagagttcaagatcaataacaagaaggggttccgagtggcaccatcacatattcatttactgtcagctcattaatacacaatgtaggtatatgaatccagtttggagacattactgaatccagctgacttactgaatttttttttttttttgagacagaatctcgctctgtcgccctggtgggagtgcaaggttgcaatcttggctcactgcaacctccgcctcctgggttcaagctattctcctgcctcaggagataggagctgggattacaggcatgtgccaccatgcctggctaatttttgcatttttagtagagatgggggtttcaccatgttggccaggctggtctcgaactcctgacctcaagtgatccacccaccttggcctcagttgggattacaggcctgaatcaccacgcccagcctcacttgctgaatttaaagatgttattatttttaaaatgtaagtgaaataatctcagctgttccaactgcagctttttcctggaatgaaaaatggctgcctgtcaacagcatgctgcttagtaaataaaaaacaaaaagcaaaaaaaaaaaaaagatttacttcatctggaattttaaaataaaagtaggaaagaaactgctttttagaagaaatttgtgttatagggcattttgaaaatgtttccaacactgattttatagccaaaaattaggtgttacctataaaaattctcatatctatacacttaaaacatttataaacataactttttattctattcacaaatatttctgtaaataatgtaagttttatatgtgttgacctaaaaggaaagaagttgaggcaaaattaataacatacatagagagttcatttgagccaagcttgagggttgcaaccaaggagcataaattcaagttgccctgaatatgctcattagcagcagtaacaagtagatttttaaagagaaaaagaaaaataaaaaggcacgctctgagttgttcaccaagaatctacattaaaataacaaactatccattggctacagagtggcagggggtagggagttggggtggagtatgggggcataactgaagtcccatactactcacatctctctgggcctgcatacctcagagctcagactgttctgagcattttttgttttctcatacccatttgttaaaaatataaaaacataccacttttcggctgggcgcagtggctcacacctgttataccagcactttgggagactgaggtgggcagatcacttgaggtcaggagtttgagacgagcctggccaacatggtgaaactccatctctactaaaaatacaaaaattagccaggtgtggtggcacgtgcctgtaatcccagctactcaggagacttgaggcaggagaactgcttgaacccaggaggcggaggttgcagtgagccaagatcgccaacactgcactcccaccagggcaatagggcgagactcatctcaaaaacaacaacaataggaacaacaacaacaagaaacaaaaaccatgcaccactttccaagaacactaatttatatcaagtttttcttagtttggaataagaactaacacatcaagagaagatgaaattggctaacaactcctacaaaaaccttggtaaaattagtggatgagactagaaaatataattcaaaaatacacaaatgatcatgtattattttctctaatacccttactttgaggcaaaaccttacagctccagcagatgggggcattactttgtgaaaagaactcttagtaaattaaaaagatgtttaatactgctttctttccagatggtggcagaagaaaacaccgaaaacaataccactaccccactccctttattagaaaaaagttaaaatacaaattctattactgtttacctaggacctaacttcacacggctgacatttctcaaagataggtaagtatggacaaaatttcagaactttgcctctcttcagttcgataaaatgttcttgatttgctagctaaacagtcaaataacgtaaaatgaaaggtattttaggagaaatttgaaggtggtttccatgttttgttactgtcctttgagatgaaactgaggcaagaaaaatacatttaagctgtttttcagtccatcagaattagttttcattcttttttctcccccagttggattgtttgtacagaggtaaagattaaaatagagttaaaagaatggttgagtgtggggagaaataagggccaatactgatatatattccaagttagaaaataagtaaactctgttagttcttcctaaagagatcagctcaaaaatgctatctatatcaagttggggcacagcctctggtgagatgtttccttgagttctccagagctgaagaataattccacacaaatcaacttttggaccacaggtgaataaaccatggtaattactgacagttttgtaaaatctttttttcctcctcatttgttgccagtgaatattaaaaggacacaatttacttaaggacacattcagattaaatgattccaaggtttgataacctttagttaagtaatatgatgccatgatattttctcattgatattaaaatgaagaaaaatattttataatgtcttggtacttaaactgattaaataattgaaaaggcttgcaattctccagaaaagccatgttctctctaacctctgaatttcagtaatcttcactagtacatggcagtatgtctggaatcatatatacacagacacacacaaccacacatacatatatatacacacatatgaatataaacgtatatacatatatatcttttttttttttttttgagctggactttcactctgtcgcctggctggagtgcagtggcaccatctcagctcactgcaacctccacctccagggttcaagcgattctcctgcctcagcctcctgagtagctgggattacaggcatgcgccaccacgctcggctaatttttgtatttttagtagagatggggtttcaccatattggccaggctggtctcgaactcctgacctggtgatccgcccacctcagcctcccaaagtgctgctgggattacaggcgtgagccactgcaccccatacatatatatcttttaataagtgtacttactttataaagtacctattagagccttgatattcatgaataagccaataaagttgttttcaagaacatgggaggtaaatagttatgaaataaacaacccccagaaggataatcagagagttaatactatgatatgttcagtaaagaaagacatttagaaattactacagttggccgggcatggtggctcacacctgtaatcccagcactttgggaggctgaggcgggtggatcacctgagttcaggagtttgagaccagactagacaacatggtgaaaccccgtctctactaaaaatacaaaattagccaggtgtcgtggtgcgtacctgtaatcccagatactcgggaagctgagacaggagaatcgcttgaaccggggaggcggaggctgcagtaagcggagattgcaccactgcactccaaccagggcaagacagagcaagactccgtctcacaaaatgaaaaaaagacattactacagttgttttgattattaaccatggaatacaccttgtaaatgatacaaagtatcaattctgcagtagtgttgatgaatgaataaaaaagaaatactagttggaggacttctttaaagtatacgtcttaaaatgcatttacttctgaattatataggctaacaaaagaactaacacaaatttgcaacgtatttagaaatcctttagaagctttggaaatgcattatatgatcttactggcactgacataactacatcttaaatattatagtgatcaacagtagtctatgttctctgagcacatggaagtaggctaccttcaggatttaagcttgtgaatccaagctaatgtgtttaattggatggataaatagtataagggcgacagacacttgaatcaacgaaaacttttttttgtttttggtttaagagatggggcttccctctgtcaactagggcagtggcacgataatagctcactgaagtcatgaactcctggcctcaagcaatcctcctgactcagcctcctaaatagctgggattacaagtgtgaggtactgcccctgacaaaaatatcatttttgtgaaggatggttgcattatatgggacacaagatttaagactagggcactaaaattggtgggtgagaaggcacatgtagacaaattttccttgaaaagccccaaactacacataaattacagaactgtactttcttgcaatatcaattacttcagggtatatgttcatttgagaagaataatgaatagaatactgtccactattcaaataaatttttcctttgccacgtttacagacttgagtttacttaaatgtaagtatgatactgctagggctaaggaaatgatactccaaaataaagtcctccaaagcagctctctctgaccatctcctaacttcctgtctctggcctctcattctcctgaggctagccactgaaactaccatccctcgtccccaaggtagtccacagaaaccagaactccctttccccaaagccagccacagaacctaaatatattactctaatgttccctgccctcatctttctgtgtaaaaactaactataaagacatatctgacctattctgtttgattgtaggtcataggatccccattccagaaagggtgctgttccatacccggaaggaaagaatgctgcacagagaggccaagaagaatctatacagacaggcaggccttgctgggtttccccactcagtatatggctgtccagactttgctgaacctaagcataccaatgggcagttttctcctatatctttaggtctttattctgaaggctcccatgtcacgtaacaccaagatcaaataaaatcatatgccctttctcctattaatctgccttttttcagctgattttcaaagaaccttcagaggctgaaagggaagttttttcttggcccctacaatatgctacaactccagtaagttaattagtaaatattaaactatttttggaaggaaaaaaaactgaaaataacattgctttagagataaattatttaagaattgctagaaattaccctagaaattatcctagaaaaatcttaaaattttccctaaaaacttttaggaataatacattgtttctaatgagacccttcagcttatgcaaaaagcacaggagactaaattctagagtcaacgaaacgatattctccaattctgttttgctaatgaatatgttgtccatccccccatcagcatgcttaggtaatcttgcaaggataaatggaaatgtcagttgacatttacaatgaaataggatttttagacagttgtgctttttgggtgggaaaaggagagctaaaaattagggggttgggggcttaaaaaagacagcattatatggcttagaactttggtaccctaccttcatccttttctgcaatcccttttactccccaaagttaaaaggctatcaatgggacaataattgatgatcaactatgaagaaataggctcaaatacactgttttattatatttttatcattctttatataccttttctcatcattctttgtcccaatagtatgctatgattatgcacgtagaaaatcccaaaataacaacaaaatcactggaactaataaactactgtagaaaggttgcaggatacaaggttaatatacaaattgtcaacttccttcctatgtatcagtaatgaacaactgaaattagaaattaaaataataccatatacattagcaacaacaacaaaaaacattcaccaaaaatgtagatataaatctaacaaaatatgtacaagatctctatgaggatcactataaaactctgattcaagaaatcaaagaaagtctaaataaatgagatcattcaagagtagaaaaaaattcgtattgttaaatgtcagttcttccaaccttgatctataaattcaatgcaatcccaatcaaaattctggatagttattttgtggatatgacaaactgattttaaagtatacacagaaagacccaggagaaccaacacgataccgaaggagaacaaagttggaggacaaaacctacccaacttcaagacattataaaactatactaatcaatacagtgtgataatggtgaaagaacagacaaatcaagggaacaaaacagagcccagaaataggcccacataaacatagtcagctggtcttttacgaataagcaaaggcaattcaatggagaaaagaacaatctttgcaacaaatggtaatggaaaaactagacatacacatgccaaaacatgaattgacacagaccttacaagtttcacacacaaaaaatctaaaaatggatcacagacctaaatataaaatgcaaaactataaaactccaaaaatggccgagcacagtggctcacgcctctaatcccagcactctgggacaccaaggcaggtggatcacctgaggtcaggagttcgaaaccagcccgaccaacatggtgaaaccctgtctctactaaaaatacaaaaattagctgggcattgtggcaggctcctgtaatcccagctacttggtgacaggtgaagccagctggacttcctgggtcgagtggggacttggacaacttttctgtctagctagaggactgtaaatgcaccaatcagcactcaataaaaaaacgcaccactcagcgctctgtggattaaaggattgtaaatgcaccaatcagcactctataaaaacgcaccaatcagcgctctgtgtctaaaggactgtaaatgcaccaatcagcactctgtaaaaatgcaccactcagcattctgtgtctagctaaaggattgtaaatgcaccaatcagcactctataaaaacgcaccaatcagcactctgtgtctaaagtattgtaaatgcaccaatcagcactctggtctagctaaaggattgtaaatgcaccaatcagcactgtgtaaaaacgcaccactcagcgctctgtaaaatggaccaatcagcaggatgtgtgtggggccaaataagggaataaaagttggcatggaccaatcagcaggatgtgcgtggggccaaataagggaataaaagctggccacccgagtcagcagtggcaacctgctggggtccccttccacgctgtggaagctttgttctttcgctcttcacaatagatcttgctgctgctcactctttgggtccgcactgcctttatgagctgtaacactcaccaggagggtctgcggcttcattcctcaagtgagcaagacacaaacccactgggaggaacaaacaactccagacgcgccacctttaagagctgtaacactcactgcgaaggtccgctgcttcactcccgaagttagcgagaccacgaacccaatggaaggaagaaactccggacacatctgaacatctgaacaaacaaactccagacacaccatctttaagagctttaacattcactgcgagggtctgcggcttcattcttgaagtcagcgagacgaagaacccaatggaaggaataaattccagacacatcgggaagctgaagcaggagaatcgcttgaacccaggaggcagaggttgcagtgagccgagatcacgccattgcactccagcctgggcgacagagcaagactccatctcaaaaaaaaaaaaaacaaaaaacaggccaggtgcggtggcttacgcctgtaatcccagtgctttgggaggcagaggctggtggaccatgaggtcaagagatccgagaccatcctggccaatgtggtgaaaccccgtctctactaaaaattcaaaaattagctgggcatggtggtgtgtgcctgtagttccagctacttgggaggctgaggcaggagaaccacttgaacccgggaggtggaagttgtagtgagccaagattgtgccactgcactcaagcctggtgacagagtgagactccatctcaaaaaacaaacaaacaaacaaacaaaattccaaaaatgtaacacaaaagaaaatctaggtgaccttggttatggccatgtgtttttagatacaacaccgaaagtacaatccatgaaagaaaataaaaaattgatttagacttcattaaaattaaaaacttctgctctaccaaatggcactactaagaaaattaaaacacaaaatacacatggggataaaatatgtgaaaaacacttattttgttacacaaaatatacaaagaactcaacaaggaaataacccagtttaaaattggcatccaaataaacatctcaccaaataagatacagaggtggcaaataagcatatgaaaagatgctcaacatcatatgtcaatagggaattacataatcaaacaatgagataccattgcacacctattacaatggctaaatccaaaacaatgacaataccaaatactagtgagaaggtagagcaatgggaactctcattcatggctcatggaaaagcaaaatggcacagacactttggaaaacagtttggcagcttcttataaaactaaacatatttgttttacataatctagcaatcatgtaccctggttacacccaaatgagttgaagacaggtccacacaaagacctgtaccttcctgtttacagcagttttatttataattgccaaaacttggaagtaagcaagagtgtccttcaatatgtgaatggataaaccaactgtggtacatccatacaatggaatcttactcagcatgtaaaagaaataaagccatgaaaagacatgaaggaaacttagatgtatactgctaagtgaaagaagccaatctgaagagactacctactgtatgtttccaactatatgatattctggaataggcaaaactacagaaatagatgttttagtgatcttttcactaaaagatcagtggttgtcaagaaaagagaagtatggaacatgagatttttagggcaattaaattattctgaatgatactgtaataatggatcattatatatttatcaaaatccatagaatgtacaaaacaaagaatgaatttattcatatgtttgtcgtttttaaagaaataagacatttcaagaacatttatataccaaagtaagaaaattttttatatcttatctttctttgtcaacaccaatcatcacactattcaagagcataattcctaatggttgagaagagactcttgcaatataaagcaaacaaacatattgttattttgtaagtatttaatataatgaaaacatgttatctatgattatttcttctcaaagtacatgacaaagctctatgatctcatgctgccattaaatgtataaaaacatagcttaaaaagactaatattacacatattagcatcttggaattatttctgggtgcaaaggttataggtaattttcattttttaatcacttttatactgaatgtatattatgtttgtaactttaaaaattttcttgcacatttaaatcaaatcttgtactttacaatttgaatatataaatttctaagtgtaaattatgatgctaaaattctattttaacttttaaacatgttacaaacataaaatgtgttttaacataaaattttaaaaacatgatgctcaccagatattgcagcagtgttggtataacatgctggacataattaaaaaaacaccaaagtctaatggatattagctgaaacccagctttttagggaaaatagttttggtatttactcattataaagtaagttgactgagacataaacaaaccatacaagtggtcatattaagagtgcatttaagactgacatgtctgggttatctgtattagatatttttgtaaacaatacaaaaaagaaacaaaggagaaagtgaaaatgtgcaagtgaaaagccaacagatcagaacttaattcttgaaaaagtctgacctcactttggtcatgctataatttggatttggtttctttatcaccaccaaagctaatgtggaaatttgaaccccagcgtggcaatattgaaaggtgaggcctagagggaggtgtctgggttctacgggtagatgcctcataaatggctcagtgctattctggagttagtgtgttctggctctcatgagactggattagttctctggcgaatggcttagttccttcccacaagagtgggttgttataaggccactatgcactcctcagattttcctctctttgaatgtttctttttctcctttgaccttgtccaccgtgttgtgaagtatgaaagatcttgccagaagccaggtctatgctcttgaacttctcagtctgcagaactgtgagctataaaacctcatatctttataaattacccagtcttaggtattcttttatagcaatacaaaacagactaaggcaggtcaaaatttcacactattctcaattcccctattaatcaaaaaagtagtataggactaagaatttgttatgttttattggaggtgaggagagatatgggagaatataagataaaggttaaaaagagattaggaaaaggtagcaaccccaaagcatgtttaagatcagtgctttgagcaagatcaggaatgaaaagagagaataaaacagaaatgaaaggatgggaacagctgtcaattccaggtttcatctaccttttggtttataatcttcaactcatgtcttatttttctacttatgcatttagtaaaatatacaaagccatccagtctcgtcagctaatactctaaataatataaacatacaacaagttcactaaataactggtcttttaatttgggctagaattcaatgagaaaaccatttctaaaagacttgcagtgctaacatggctcaaattaaacagaagcctctaacccacttcatcagaggccatgaggcttattttctacacagggtaagacagaagaaatctaccctgaggacacaagacacagcagaaggtgagggtatcagacaaaaaggttttgagggggaggagaggattaagagagtgtttatatattgaacgttgaggccccctagctctcttctttcacatagttctcatactactggcaatcagacttataccctaaagcagggtttctcaggataacattttaaacttgattgttcttcgttgttggagctgtcctatgcactgtaggatgtaacaagacccccagattctatgcatcagttttcaggagcaacctatctgtggcaatcaaataagtctctagacactgctaaatttctcttagggggccaaattgtcccacttgagaatcactgacctaaaggcagaagcttggagaactcttcttattagactcttattaaccctagaaaaaaggtttccaaacttaaagataatgacaccaggggtttccacccacaaaatgcccagccatattcacagagctctaaaatagctttctaatgaatctaacataaatttgaacatgcaatcaatgattgctacatagctgaggaaagcctcgattaaaaagatgaaaacatattaacagaaagaataatttggaaaaagtagagaaagcaggaagcaataaatttcaaaaccaaacaataattttaattcataaaaagaaaacataacaggatataataagaaaattatacagagatcaaaaaaggccttggaaattaaaagtatgatagcagaaatcaaagtctcaaaagtttgaaaaaggtaaattttccagaaagtatgaagaaaaaaaaaacataaaaaatgacagaaaaaaaataggtccaggaggtagaatgtttaattagagttccagaaccaaaaacaaaggcaagaaaattaaagaaaaaacatgaggaattttcccagagttgatggacacaaattgtcagactgaaaggacccataaaatgcatggcaaaatgaaagactatagactcataataagtaacatggctgtgacatttcagaactctagatacaacaaagagaaacatttgataagtttcaaaatgagatcgtataatcttccacagaggagacaaaagtgatctgaagagtgatggaagtaagaagggcttctaattttacaacagatgctatgaattccttcaaagctcttaagaacaatttcacctttataatttgaaagccagctaaactaatagttggggtaaaataaagacacttatataaatataataccacagaacacttgcctttcagaaagctactagaaaatggaataaaccaagagaatacacaagccaaaggattacataggatataggaaacagaggaactagcataggatagagactgcaccagcagcaactatatcaagcaatgggctaaaactgcagcacataagaatgctctgggagaaatttcttgatgatggataaactgataaaaatacttgatacctctgaatatatggaaaggctgttttgacaaccagcagatagtttgggtctaaatgactaataaatatttagaactatacaaatgctcaatggtcgtatatgaaaaattaaactatcaatgggaagatggggggaatggatgggatgtttgtggaaaaaggctaaatctacatcacctatagtaagtcaagagataatgcctaaaactgaaaaaacaggaggtagcaatataaaatgttatttagagatacagaagtatataccaaaagaataagccaaaaaaagttttagaagtatttccctctatttggggaaaactggggtagtgacagctaccttgtccaacatcacagccttcctgggattaagcaaataaggcgataaaggcccaatcatttcgttgcaccatggtatcaatctgaaggaaaatattctggagaacctaacctgtgacaaagaagtaagaactgtttttaatcataagctatggagaagcagttaaaaacttaagcatgtgttcttttacctttgcaacagttaaaagaaaaagagaaagagaagaaacaggctgcttaaatatattttctaatttcattaacttggcttcttatactgcagagccgaatgttattttagaaatttaaagcccatcagactaacaacggatctctctgcaggagccctataagccagaagagagtaggggccaatagtcaacattcttaaagaaaagaattttcaacacagaatttcatatccagccaaactaagcttcataagtgaaggataaataaaatcctttatagacaagcaaatgctgacagattttgtcaccaccaggcctgccttacaagagctcctgaaggaagcactaaatatgtaaaggaaaaactggtaacagccactggaaaaacataccaaattgtaaagaccattgacactatgaagaaactacatcaactaacgggcaaaataaccagctagcatcataatgatagtaccaaattcacacataacaatattaaccttaaatgtaaatgggctaactggcccaattaaaagacacagactggcaaattggataaagagtcaagacccatcggtgtgctatattcaagagacccacctcacttgcaaagacacacaaaggttcaaaataaagggatggaggaatatttaccaagcaaatggaaagcaaaaaagagcaggggttgcaatcctagtctctgataaaacagactttaaaccaacaaagataaaaaaagacaaagaaggacattacataatgacaaagttatcaatgcaaaaagaagtgctaactatcctaaatatatatgcacccaataagggagcacccagattcataaagcaagttcttagagacctacaaagagacttagacccccccacaacaatagcagtgggagactttaacaccccactgtcaatattagacagatcaacaagacagaaaattaacaaggacactcaggacttgaactcagctatggaccaagtggacctaatagacatctacagaactctccaccccaaatcaacagaatatacattcttctcagcaccacatcgcacttattctaaaattgaccacataattggaagtaaaacactcctcaacaaaggcaaaagaatgaagtcataacaaacagtctcccagaccatagtgcaatcaaattagaactcaggattaagaaactcactcaaaactgcacaactatgtggaaactgaacaacctgctcctgaatgaatactgggtaaataacaaaattaaggcagaaataaatacattctttaaaaccaatgagaacaaagacacaatgtaccagaatctctgagacacagctaaagcagtgtgtagagggaaatttatagcactaaatgcccacagaagaaagcagaaaagatctaaaaccaacacccttacatcacaattaaaaaaactagagaagcaagagcaaacaaattcaaaagccagcagaagacaagaaataactaagaccagagcagaactgaaggagatagagacacaaaaaccccctcaaaaaaataaatgaatccaggagctgcttttttgaaaactttaacaaaataggtagaccgctagccagactaataaagaaaagagagaagaatcaaatagacacaataaaaaatgataaaggggatatcaccactgatcccacagaaatacaaactaccatcagagaatactataaacacttctacacaaataaactagaaaatctagaagaaatggatgaattcctggacacagacaccatcccaagactaaaccaggaagaagtcgaatccctaaatagaccaatagcaagttctgaaattgaggcagtaattaatagcctaccaaccaaaaaaaagcccaggaccagatggattcacagacaaattctaccagaggtacaaagcggagctggtaccattccttctgaaactattccaaataaaagaaaaagagggactcctctctaactcattttatgagtccagcatcatcctgataccaaaatctggcagagacacaacaaaaaaagaaaattccaggccaatatccctgatgaacatcaatgcaaaaatcctcaataaaatgctggcaaactgaatccagcagcacatcaaaaagtttatccaccatgatcaagttggcttcatccctgggatgcaaggctggttcaacatatgcaaatcaataaatgtaatccatcacataaacagaaccaatgagaaaaaccacgattatctcaatagatgtagaaaacgccttcgacaaaattcaacaccccttcatgctaaaaactctcaataaactaagaatcgatagaacgtatctcaaaataataagagctatttatgacaaacccacggccaatatcacactgaatgggcaaaaacaggaagcattccctttgaaaaccggcacaagaaaaggatgccctctctcaccactcctattcaacatagtattggaagttctggccagggcaatcaggcaagagaaagaaataaaaggtatttgaataggaagagaggaagtcaaattgtctgtttgcagatgacatgattgtatatttagaaaaccctgttgtctcagcccaaaatctccttgagctgataagcaatttcagcaaagtgtcaggatacaaaatcaatgtgcaaaaataacaagcattcctatataccaataatagacaaacagagagccaagtcatgagtgaactcccattcgcaattcctacaaagagaataaaatacataggaatacaacttataagggatgtgaaggaccgcttcaaggagaactacaaaccactgctcaaggaaataagagaggacacaaacaaatggaaaaacattccatgcgcatggataggaaggatcaatatcatgaaaatggccacaccgcccaaagtaatttatagattcaatgctaaacccatcaagctaccactgactttcttcacagaattagaaaaaaaactactttaaatttcatatggaaccaaaaaagagcccgcataagccaagacaatgctaagcaaagagaacaaagctggaggcatcacgctacctgacttcaaactatactataaggctacagtaaccaaagcagcatagtactggtaccaaaacagatatacagaccaatggaacagaacagagtcctcagaaataacaccatacatcaacaacaaccatctgatctttgaaaaacctgatgacaacaagcaattgggaaaggattccctccctatttaataaatggtgttgggaaaactggctagccatatggagaaaactgaaactggcccccccttccttacaccttatacaaaaatggattaaagactaaaacataagacctaaaaccataaaaactctataagaaaacctaggcaatatcattcaggacataggcatgggcaaaaatttcatgactaaaacaccaaaagcaatggcaacaaaaggatacgaacagacacttctcaagagaagacatttatgtggccaacaaacatgtgaaaaaaagcttatcattactggtcatgacagaaaaggaaatcaaaaccacaatgagataccatctcatgccagctggaatggtgatcattaaaaagtcaggaaacaacagatactggagaggatgtggaaaaacaggaacgcttttacactgttggtgggaacataaattagttaaaccattgtggaagacaatgtggcgattcctcaaggatctagaaccagaaataccatttgacccagcaatcccattactgggtatatacccaaaggattataaatcattctactataaagacacatgcatacgtatgtttattgcagcactgttcacaatagcaaagacttggaaccaatccaaatgtccttcaatgatagaccagataaagaaaatgtggcacatatacgccatggaatactatgaagccataaaaaaggatgagttcatgtcctttgcagggacacggatgaagctggaaaccattattctcagcaaactaatacaggaacagaaaaccaaacaacgcatgttcccataagtgggagctgaacaatgagaacacatggacacagggagggcaacatcacacactggggcctgctgggggatgggggggctaagggagggatagcattaggaaaaatacctaatgtagatgacaggttaatgacacgtgtatacctatgtaacaaacctacatgttctgcacatgtatcccagaacttaaattataataaaaaagaaaaatttaaaatagacattgtttttccttgcagaggaggcagaacaagattgctgaagagaatcccccaggaatcatcccgtagcaggaacaccaaactgaacaactatccatgcaaaaaaaaaaaaaaaaaaaaaaaacaaccttcataagaatcagctggcacagtggtacatgcccataatctcagcactttggaaggtcaaggcgagtggatcatttgatctcagttcaagaccagtctgggcaacctgatgaaaccctgtctttacaaaatatgaaaaaattagctgggcatggtggcatgtgcctgtagtgccagctactcgggaggctgaggtgggaggatcacttcagcccaggaggtcaattgaggctggaatgagttgagatcacgccatgcactccagcctgggtgacagagtgagaccctgcctcaaaacaaacaaataaacacactaacaaacaaacaaaaaatccaaaatcaggtgagtaatcacggcacctggttttaacataatatcaaggaaagaagcatcgaagagggtaggaaagacagtcttgcgctgactacaccaaccctcctccaaccccaggcagcacagcactgagatagaatctgtgtgcttgggagagagagcgaaagtaagtatgggactttgcgctggaactcagtgctgctctgtaacagcagaacacaacacagggcattctgctggtgcccacagaaggagcatttagcttagtcctgggccagagagaaatcctccccccaaggagagtaattggttttcatcacattctgactaaagtagtctagggcccggaataaattggagtgacaggccacaaggactgcatcctttggcaagccttggtactgcactggccttggaggtaatggacttaagataaaacccagtgcaataccacccgtggcagctaagggaatccctgaggcacccctccccaactacttcagcttggggtaaggaaaaggaagagtagacagaactttgttttgcaaccggagtattggttcagtcacagtaaaataaagcaaaagacagatttctgaagcttttgatagcaagcttttgctccgggatggcatttatagattgaccctaggcaggaagggaatggctgccatgatgggatggactcagtcttggcagaattcaccacctgctaactaaagtggcctttggccttgaataaccagtggcagtcacgcaggactggccgtggaccttgggtgagccccaatactgtgctggtctgcaatgcttcagaggcaactcagcatagttccaactgtggtggctacaggaatgcctgtatcaccccccaccaacactgggcaggccagtacagagaaagactcctgattgaaggaaagggaaggtagagagcaagagactctgcctggtaacccagggaattctcccaattatcttcccaagtccatcaggactgtgtatgtaggagtctgcaagactcacagcgttcctgtgctttggatgctccttaatgccaaaatggctgcagtgactacaggcttaggtcacaacactcaatctgctttgatttcctggaaagccccctggagagtgacaggaatgaacaaacccaaactgtgaagactagctcttcgatgcctagacatcaatgaatatccacaattatcaagaacatctaggaaaacaggacctcaccaaacagactaatcctggagcaataaagatacgtgaccttttagatgggaaattcaaaatagcggtcttgagaaagctcaatttaattcaagataaaagagataaaaaattcagaattatatcagagaaacttaacaaagagactaaaatgatgaacaagcagaaattctgaagctcgaaaattcaacaagctgaaaatgcatcagtctcaacagcagaagaataaattagtgagcttgaagacaggtttatgaaaatacagtcagaagagaaaaaataataaaacaataatgaagtatgcctacaaaatctggaaaatagcccccaaaagtcataatctaagagttactggccttaaagagggcttacagaaagagattgaggtagaaagtgttttcaaagaaataatagcagagtacttttcaaactgagagaaagatatgaatatacaggtacaagaaggtcaaagaacaccaaatagattcaacccaaataagattaccttaaggcatataataattaaagtctcaaaagtaaaggacaaagaaaggatcctaaaagcggcaaaagaaaagaagtaacttcatatgaaggagttatactacatctggcagcaaacttcagcagaaacgctacaggccagaagagagtaggatgacaaactttagcagaaaccctggcaggccagaagagagtagaatagtattaggttggtgcacaagtaaccacggtttttgtaattacttttaatggcaaaaaccacgttaacttttgcaccaatctaatacatccaccgaaattatccttgaaacagggagacatgaagactctcctagactaataaaagctgagggatttcatcaacaccagactcatctttcagaaaatgctaaagggaagttcttcaatctgaaagaaaaggacattaacaagcaacaagaaatcatctgaaggtataaaactcactggtgaaagtaagtgcacagataaatacagaatactctaaccgctcatatctttagcaggaagattaaaagacaaacctatattgttagaagagttctaaactctaccttatctagagaaccttcttcttttagaaaatcaagcaaaacaactaagccaagacatgttaagaaaagtttgaaaagaaagctgtaaggaaatacaaggggagggattgttagatatgagttctaaatttcttttcaaagaattagtgtgtcagtatgttcaattctttgccttctagttttaaacttaacttcctcgtaaagcaacctttttcgattacctactccaccctgactcattctgatcatctgctccacccaacattccaatcacctgctccaccctaactcattccaattacctgctacctgctctgccctgactcccgccaaagcattcaccctgtcattctctttaaattagccaattggaattagtttagcccgtgcggtctaaccccagccaataggggaacgacagagcagcaggggccacatacgtcagggattagaaccccttcccatcccttgtccaaatgtgcgctcaccattgttccatctgtaagggtgcacccttctatatagaagtagcttgccttgctgaatattaaaaagaaaattttgtattcgagtgctatttcttttgcagcatcgaaactttctatataacactatcaaaaaaaaactactccaaaacttaaaatataaaaatatatagagacaaaaagtcaaaaagtgaagggatggagtagaagtgtacaggtttttagttttttctgtgcgtgtattttttcttttctttgcaatcagagttgtcatcagttgcaaataattggctataaattgttatttgctaacctcatagtaaccacaaaacaaaaacctctaataggtgcacaaaaaaataaaaagcaagaaattaaaacatactaccaaaaaataattatcacaaaggaaaacaaggaaaaaaatgggggaaaagccctagaaaataaccagaacaacaataaaaaggcagtagtaagtccttacctatcaataataatactgaatgtgaatggactaaattcttcactataaaaacatagactaacaacaaaaagacggaaaaagatactgcaccaaacagaaacccaaaaagagcccaagtagctttgtatctatttttagataaaatagatttcaacataaaaactatgaagaaagaaaaaaaggttatcatataatacaaaaggttttaattcagcaagaggacataaaaattataaatacatatctatccaacacagaagcatctagatatatagagtcaagtgtattagagttaaggagacagaacccaatacagtaatgacttgggacttcaacagcccactttcaccattggacagatcatctagacagaaagaaacaatgaatttaatctgcactatagattaaatggacctaatagacatttacagaagctgtcatccaacagccgcagaatacattcttctccttagcacatggaacatttctcaaggatggatcctaaattctccaatcaaaagacacagaagagctgaagggctaaacaaaacaaggccctactacctgctacatataagaaacccacttcatttataaaaacatagatagaccaaaagatggaaagagacattgcatgcaaacagaaatccaaaaagagcaccatcatgttaggccgcaaaacaagtctgataaaaagtatattttctaaccacaatggaataaaagtagaaataaataacaagtggaactttggaaactatacaaacatataagaattaaacaatacgtgcctgaacaaccaatgaagtaattaaggaaattaaaaaatgtcttgaaacaaatgaaaatggaaacacaacctactaaaacttatgagatacagttaaagctaacactaaagggaatgtttatagcaataaatgtgcaaatcaaaaagtagaaaaccaagaaataaacaacctagtaatgcatcttaaagaactagaaaagcaagagcatgccaagccccaaattaagaagagaaataataaagaaaacaagaaaataaataataaaaaacagaaataaaattgagacaaaaaaatagaaaagatcaatgaaatgaaaagggttgtttggaaagacagacaaaatcaatgaacctttacccagactaagaaaagaaaaaaaagaagatccaaataaaatcagagacaaaaaaggagacattacaattgatatcacaaaaattcaaaggatcattggagaccatttgaacaactgcatgccaataaattgtaaaacctagaagaaacgaataaattcctaggcacatacagcctaagaagaatgaaacattaagaaaaccaaaatcgaaatagacccataataagtttcaagatagaaacaataataaaaagtcccccatcacagaaaaggccaggacttcatggcttcactgagttctaccaaacatttaaagaagaactaacatcaatcctactcaaatcattctccaaaatcaaggaggatctccaaattcattttatgaggccagatttattctttttttttttttttttttttttgagacagagtctcactctgttgcccaggtgatctgcaacctccacctactgggttcaagcgattctcctgcctcagcctccagattagctgggattacaggcataagccaccatgcccagctaatttttgtattttttgtagagatggggtttcaccatgtcggccaggctggtctcaaactcctggcttcaagagatctgcctgcctcagcctcccaaagttctgggattactggcgtgagctaccatgcctggccccagatttattctgataccaaaaccagacaacgatacaacaacaacaaaaaagaaactacaggccagtatctctgatgaaaatagatataaaaatcttcaacaaaacacagcaaaccaaattcaacagcacattaaaaagatcatcataatcaagtgggattcatcccagggatgtaaggatggttcaacatatgtaaatcaatcagtgtgatacatggtatcaacagaatgaaggacacaaagtgtattgtcatttcaatagatgccaaaaaaatcttttttgataaaattcaatatcccttcataaaaactctcagcaaactggggacagaaggatcatccctcaacatgataaagccatacacaacaaacccacagttagtatcagactgaatgggggaaaaactgaaagcctttattctaggatctagaagaaggatgggcactttcaccactattactcaagttagtaacagaagtcctagccagagtaaacagacaagagaatgaaataaagggcatttaaattggaaaggagtaagtaaaattatcattgtttgcagctcatgtgatcttatactaacctaaagactccaacaaacgactattagaactaataaattcagtaacattgcagaatacaaaatcaacacacaaaaatccatagaatttctctatgccaacagtgacaacctatctgaaaaagaaatcaagaaggtgatcccatttacaatagctacaaataatattaaatatctagaaataaacttaaccaactacaatgcaaactatcaaacattgatgaaattaattgaagaggacacaaacaaatgaaaagacatcccatgctcatgggttgaaaaaaattgtattgttaaaatgacaatacttcccacagcaatctacagattcaaagccatccctatcaagagcaatgacattcttcacagaaatagaaaaaaaaaatcctaaaattgtatggaagcacaaaagaccccaaatagccaaaacaatcctgaccaaaaagaacagagctggtaactggtagacttaccacactaccaaacctcaaaatatactacaacgctatagtaaccaaaatagcacgatagtggcataaaaacagacatgtagaacaacagaacagagagtccagaaattaatctgtgtatttaaagccaattagttttttactaaggtgccaaaaacactcattgggaaaggacagtctcttcaataaatggtgttgggaaaactggatgcccacattcagaacaacaaaagtagaccccaactcttgccatatacaaaaatcaaagaaaaatgcattaaagacttacatctatgaaactaatcaaggaaaccattaggcaaaaactccaggacattggtctaggcaaagacttcttaaataagacctcaaaaacacaagcaactaaagcaagaaaataaaataaaataacaacaaatgagatctctccaagccaaaaagcttctgcacagcaatgaaaacaataaaatgaagatataacatgtagaatgggagaaaatatttcaaactaatatctgacaaaggattaataaccagaatatataagaatctcaaacgactcaataggaaaaaaaaatctgattttaaaatgggcaaaagatctgaggagacatttctcaaaaagacatacaaatggcaaacaggcatatgaaaaaaatgttccacattattaataatcagagaaatacaaatcaaaactataatgaggtatcaactcactccagttaaaatggcttttatcgaaaaggcagtcaatatcagatgctggtgagaatgtggagaaaggggaacccttgtacactgttggtggaaatgtaaactggcacagtcacaacagagaacagtatggagcttcctaaaaacacaacaaatagaactataatccagcaatcccactactgtgtatatacccaagagaaaggaaatcagtatataaaaggtatctgtactcccatgttaactgcagcactatacacaatagccaggatatggaatcaacctaactgtcaatcaatggatggataaagaaatgtggtacatatacacaatggaatgttattcagccataaaaaaaaaatgaaatcctgtcattttcaacaatatggatgtgactgacattataagggaaataagccaggcatagaaagacaagtatcacatgttctcacccatatgtggaagcttcaaaaaaattgaagtcatagagatagtgagtaaaaagatgttagcagaggctgggaagggtagtgttgagaggagaatcaagaggagatggttaatgggtagaaaaatatagttagatagaaggaataaaatatagtgttcagtagcacaatatagtaattacagctaacaataatttagtgtatgttttagaacaattaaatgagtggaaatgaaatgtccctaacacaaagaaatgacaaatacttgaggtaatggatatcccaattacctgatttgatcattacacattgtatgcttatatcaaatatcacatactccccattttatgtatccatagtaattaaaaattaaaatttttaaatatatgagttaagttaaaaaaattttggctcaaagcataaatatattaaaatcaaatctcagaagtaaaaaagaaagacaattagggttttatttatggtagtggcagacaggaccaacctttctgctgacgccaacaaaaaaactaaataatgaatgaaataaagtaatgtgaaattacttaccaaattccatgtgaaggtaaaccagaaacaaaccatacaccaagtaacttttgttctgaggacattttcctgtctagaagaaaaggctgagaaaaaaggctgagctaatggaagatgtgccggtctatggtaaaaaaatcaaagcacaaggccaggtgtggtggctcatgcctgtaatcctatcctttgacaggccaaggcaggaggatagcttgagcccaggaattcaggatgattgtgtgcaatacagcgagacctcatttaaaataaaaataaacacaaaaaatcaaaatcaaaaataaaaataaaagcacattgcctaacaaagctggggactcagataaactacccaatttatgttcagagtttaaggacaacatcattaggataagaggaaattgaaggaaaatagaattcatgatcttaaagtcttccttaatgtcatgtgtataacagaaggaatcccaactcttgaacatgaatagtgacttgggactgaaagcactcctagagacctttcctagaaaaatgtaccttcttaaaaaagatactattattctaggactcatatattcctataattttttaaatacaactggtactcaaggcacacaagaaaaaaatatcataagctagcagacacagacttagaaaatttagaaactggaattatcttcaacaaacaacaaatgaactatgaatatagtcggcccttcatagccacagattcactcaaccaaggattaaaaatacatgtatatttttaaaaacacgactataaaaaataatagaaatttttaaaaagccatgacagtataacaatatttacatagcatctacattgtattaggtaccataagcaatctagagattatttaaaatacgtgggaggatgtgtgtaggccgtatgcaaacatgatggcatgttatataaggaatttgagctgcctgtggattgtggtatctgcacggggttctgaaaccaatttccagcagatactaaggagcaactatactaggccaataaaagcaagattgtaattttcagcaggtaaccagaaacagtaagaatatcaccaatatctttaaaaagatactgatgcattgatctaataatctcgatgaatacagggcaagataaagaatgccacacgatgattgaacatttcctctacccccacaaccacacttgactaggagaaaaaaaaaaaagaagaaaagaattccacacaaaaagattagagtgaaacagcagaaaaattacaaccaaaaaaagaaacaaacaaaaaaaaattctaaaagagagatttccttcaaagcagcatgaattattaggttggtacaaaattaattgtggtttttgcattgttggaatttgccatttgatattggaatttttttttttttttttttttttttgagatggagtctctctctgttgcccaggctgggctgcagtggcgcgatctcggctcactgcaagctctgcctccagggttcacaccattctcctgcctcagccttctgagtagctgggactacaggcacccgccaccacgcctggctaattttttgtatttttagtagagacagggtctcaccatgttagccaggatggtatcgatctcctgacctcgtgatccgcccacctcagcctcccaaagtgctgggattacaggtgtgagccaccacacccggcctggaatacattcttaaataaatgtggttatgttatatgtcattttaatgggcatttcttgctttttttttttggctaatgacttattacttgctgtttatatttattttggactatggaaatgatgctagacaaaaagcaaagttgagtgattttcttatttaagttcaaagtgggtcgtaaaacagcagagacaacttgcaatatcaacaatgcatttggcccaggaactgctaatgaacgtacagtgcagtggtggttcaagaagttttgcaaaagataccagagccttgaggatgaggagtgtagtggcaggccactggaagttgacaacaaccaattgagagcaatcattgaagcagattgatcctcttacaattacatgagaagttgctgaagaactcaacgtaagaactcaacgtcaaccattccacagttgttcagtatttgaagcaaattgaaaaggtgaaaaagctcgataagtgggtgcctcaccagctgagcaaaaatttaaaaaaacaccgttttgaagtgttgtcttctcttattctccacaacaacgaaccatttctcaatcggactgtgaggtgcaacaaaaactagattttatatgacaagcaatgaccagctcagtggctggaccgcgaagaagctccaaagcacttcccaaagccaaacttgcaccaaaaaaggccatggtaactgtttgctggtctgctgccggtctgatccactacagctttctgaatcctggagaaaccattacatctgagaagtatgctcagcaaatcaatgagatgcacttaaaactgtgatgcctgcagccagcatgggtcaacagaaagggcccaattctccacagtaacacccaaccgcacactgcacaaccaacacttcaaaagttgaacgaactgggctacaaagttttgcctcatctgccatattcacctgacctctcaactgactaccactccttcaagcatctctacaacttttttcagggaaaatgcttccacaaccagcaggatgcaggaaaaagctttccaagagtttgtggaatcctgaagcatggatttttacattacaggaaaaaacaaacttatttcttgtcggcaaaaatgtgttgattgtaatgacctattttaattaataaagatatgttagagcctcgttataatgatttaaaattcgctgtcccaaaccacaatttcttttgtaccaacctaatgcattgacagctgatttctcaaaatcaataatgaaaaccaaaaacagtgaaatgttatcttcaaggtacaagtaaaacaaccacaaatctgtaatatcccccaaaacattcttcaagattgaaggcaaaacaaaaaattaagacaaagcaaaaaaattaagagaactgaccatcagaatgtctgcattatgaaacttctactgagtgtgctaaagtaaaagttaaaagattccaaaagaaaagtcagagacgcaggaagaaattaagacatggtaaacacataggaacatctagctcaaagtactgtccagcagcaatacagtaaaagtgacataagtaatttaaaattttctattgttcacactaaaagaaaacaaggtgaaatcaattataatttcaacatgtaatcataatgaaaagctgaggtattttacattgttttcatactgtctttgaaatatggtgtttatacaacattacaatgcagatgctaaattaaaactgccatataaaatacttgatctatatttttatataatttgcagctaatgccgggtgcagtggctcacgtctgtgatcccatcactttggaagcccaaggtgggtggatcacttgaggtcaggagtttgagaccagcctagccaaaatggtgaaactttgcctctactagaaataaaaacattagccaggtgtggtggcacatgcttgtaatcccagctactagggaggctgaggcaggagaatcacttgaacttgggaggcggaggttgcagtgagccaagatcatgccactggactccagcctgggcaacagagcgagactccatctccaggggggaaaaaatctccaaaaattaaaaaataataatttaataatttgcggttaagaaaggtttatgtatccgagttgttccaaacatacaggttttacagtaactgaatcaagtgtcagtttttaaacttaattgaacactaaataaaactaaaaattcagttcctcagtcatactagccacatttcaagtgctcaaaagccacacgcagctagtagctactgcaatgaatagcacaagcatagaacttgttatctggagtttaaactacgtatacaattcaaagaacaatgacagcctataagacctacatgaagataaaagttgccatcccagaagagagtaatgctccaagcacagagaagatattggccatactgctagaaatccctgagtaaaacagacaacccaattaaaacaaaaaacaaacaaacaaaaaaacctcccaaaaagatttaaaaagacaatgcacaaaagatttaagaattaaaaagacaattctagaaagaggaaattcaaatagccggtaagtttttgaaaaagtgctcaaactctttagtgtcctgggcagaataaattaaaacaacaataagataaagccacattcatcaagttgggaaaaaggaaaaataactcttggtgagacagtaaaagtaaagggatctaccatatactgctgtcggggtatacattggtgtatctactttggaaaaggcataactagtgaagttgaagataaacatacgtactctacaaaaacccatggtaatgtacattaagaatacatgtacaagaacattcataatagcattgttcataactactaaaaacggaacacaatccaaatgtttattaatattagactaaactgtggctcatttccattaagactttttatactatacttattatactatagattactacaatccaatataagaactagagctaaatgtactaatagagttatatcccagctgcatgagagaaaaagatacataatgatatgtaatatataatccacttacatacaattaagaaacaggcaaaacgaacctaaattgcttaggaatgctgacataggtggttaagaaatactaagaaagaaagcagtaaatgattgccataaaaatcagtatagtgttaaccactgaaaagaattgaggaaagggatgatcaggaatagaatggagaggggagcttctcaggtgccacagacgttctagttcttgactgtggcagcgcttacatagagttcacactttatagtttttcattatactatgtatcgatgtttgtatgcttaaatactaaatgtatggaaaaagacacaaaatatttaaaattgtagctaaggcacattaactgccttgctggtatttttttttttcattacaaagtggcagacaattggttacactataaagacagacaattggttacactacaaagaaaattttaaagcacaggagtctagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgggcgcggtggctcacgcctgtaatcccagcactttgggaggccgaggcgggaggatcatttgaggtcaagagatcgagaccagcctgaccaacatggtgaaaccccgtccctactgaaaacacaaaaaaattagccaggcgtggtggcacatgcctgtagtttcagctactcgggagggtgaggcaggagaactgcttgaacccaggagacagaggttgcagtgagccgagatcgcgccactgcactcgtctgggagacagagcgagactccgtctcaaaacaaaaaacaaacaaaaagaacccacccaacagaattaagtaccaacataataaatacgaagaattttagattcttggtttttaaaaaacatacaaagatgatattccttcaaaatatctttacaaaacatattgagactgtgatgctttatattgattgtatgaaaacaatgaaaaagaaccagcactgtttcactataaaagctttactaatgtaaatttataaatcctttcttaaatattttgagttaattctaattttatgatagaaattcattattttcagcaaaaacagctggcatttgggaaaccaaaggctcaaaaactaagaatagtaaccaaagaaacttgacaaaacagtccttttaaaactctcatctacactataaggggaaactttgatcacgtcccttctccttcatcaatcgtagaactcaacattaaggactacacaatcccacatccctctccgagaaaaagcaaaggctttgtgttgtagcaacaacgcaagacatggagggaagctccactcaagacttccctgcctgctccttccccaaagccactccagaataccagggagggttgagaggtaaggcatgaagggcgcaatatccaatatgagcaacgcgtgtgatgcatctggtcaaaatgcatacagaggacttgtctctgtccctagatagaagtcctccgtcctgcagtcatgagggtcaattgctgaggcttcacagttcccttctctcttacactcggaccgtcacgctcctcacctactaccccgatgcagaggtagactcaggatccctgcacttgtcaaggattcctcggcaagctcacggggcgggagtggccacaagacggagctcgcctggtcctggccttcccggcctatacaagcctgcccccttcccaattcccaatctccacagccttccatcctcccactttcgattcaccttgcgccaccgacgcccctggccttcgtttgcagcaagtttacccccaccattacctctcgcataaaagcctgcatttaccaggtcaaagaggggaaccaacgcctgcaggaatcgcttcaccgaatcgcctggccgcgtcctctgctagacttcacctgccgctgcggaccgtacacaaccactcccggcatgccccgcgcacgcactacctctcccaccccgcccctctcccgcccaaacacgtgacctcctttcgtctccgtccacgcccacttccgttcctccactttcccttaggaaggaggagggagctgggggtgttaaaagcgtagcgacttcc

SEQ ID NO: 2662 - DNA, 91208 bp, Homo sapiens
  source 1..91208: mol_type = genomic DNA
actttccagtttctcttttatacttttttgaaagattactttttaggaacatttggtatgatatgcataaaattatttatccatttatgggcaaaatgatacaagtagcatcttgattgaacatcatttacctcagatattcaaccagcagtacgttttttatgcagtctcaacccatatcccatttgttacctctcagaatattggtaagcagttattttcgctttactctgtatttcttgtgttttgggcacaggttattgtactactgtcaaatcgtacttgctattttttctgcaagtatttaacagaaagcttaaaatccccataaaaccccaccttggataagtgattgttaaatattgtacaaataaaatgtatgctatccccattccatccccaagttaaataaaaaaatgaatacggtatgatttgcatatgcagtttttctttagctatgtttttttttttttttatactttaagttttagggtacatgtgcacattgtgcaggttagttacataggtatacatgtgccatgctggtgcgctgcacccactaactcgtcatctagcattaggtatatctcctaatgctatccctcccccatccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtgtttccagttctagatccctgaggaatcgccacactgacttccacaatggttgaactagtttacagtcccaccaacagtgtgaaagtgttcctatttctccacatcctctccagcacctgttgtttcctgactttttaatgattgccattctaactggataaaatactggcaaaacgaatccagcagcacatcaaaaagcttatccaccatgatcaagtgggcttcatccctgggatgcaaggctggttcaatatacgcaaatcaatgaatgtaatccagcatataaacagagccaaagacaaaaaacacatgattatctcaatagatgcagaaaaagcctttgacaaaattcaacaacccttcatgctaaaaactctcaataaattagggattgatggggtgtatttcaaaataataagagctatctatgacaaacccacagccaatatcatactgaatgggcaaaaactggaagcattccctttgaaaactggcacaagacagggatgccctctctcaccactcgtattcaacatagtgttggaagttctggccagggcaattaggcaggagaaggaaataaagggtattcaattaggaaaagaggaagtcaaattgtccgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaagctactgctcaaggaaataaaagaggatacaaacaaatggaagaacattccatgctcttgggtaggaagaatcaatattgtgaaaatggccatactgcccaaggtaatttacagattcaatgccatccccatcaagctaccaatgactttcttcacagaattggaaaaaactacttaagttcatatggaaccaaaaaagagcccacatcgccaaggcaatcctaagctatgtgttcttaaagaggggagtggtagctttgtaacttacagtgaggcttacaccttgacaactgcaagaatgaggatagtggtgagtgaagggagatttgttaattatggcatttccctctattatcgtctaaacagattatattcccactaaagtatgtgtgttggtcctgccagtattagaaaccagaggcttgttggcattgtgtcacacagtacacaccaatggattctcagattttctagggtaaaggtgaaggatggggcagcacttaggttatggtggtttgaaagaaactgaattgctttctaaaccagatgaggatcagagtgcgaaccatggtgaaatatgcatggaaactacagaaagactgaagtgtttcttacggtgttttctgcaaaacgtgattcattaggacattaacaggtattacgttttcaacatatacagcattatgatacagtaagtttggaccaaacaggtattcattccccagagcctttcacatgcacgagaatcagtcattttaacaagaattccgtttctgctgggccacttggatcccttggattcagatgtaaaaacacactgaaatattcctcctttcacctgcttttcagtttgaggtaatcagattgaaaagcaggagttcatgcattttttggttctatttttcctcctctagtaaatgaagaaaataagctatatgtataagtttacattattcttgaaccgctttttaaactagggtttttcatatttgtttttattgatgacaattaaagcaatttaagagacgaagttagctcaaaactcttgcgaatagattttagcatttttgtatgagggaatatggaaaggccaacaagcagcactgttcctccccacaaaaatgccttgggaatataataggcgtacacttcatttgtgtaacttttcctaatgtatttttttttaatttgctttataacggtttcatgtttacctcaattggtacttagtcttaaaatctttctttatacttggttattgatggatcttctgcagctcttatgtagccaatgagacagatgagggctgtcagcttttaagtgacatcttaagctaataagaaattggaatcctcaagtcatttcatgaggctgttaccctttaagacaaataatactttcctcaaatagttcagaaaatttttaaaaggatcacttagagcataagtgtaaaattcttgcttctagtatataatagtgatgttaccatgtcaagtattttggtgaaatatcccctaaaaatgtgtagactacggcacagattgagtatgcaagccttagcttgaatgagactgctgagaagtaaatgacagggatctgaatacttagcaggcttaactttttgcagggaaggaaaggctatgtatgcaaaagaataggttgtaactactgaagagctactttatgctcagaaaccttttattccactttgtatccaagatttcattaaaacattgttccttagagcatactttaaaaactatttggtaaggaatccactgttgaacttcaggtcttaatagcactggctttggtgctaaactgagttgaattccaagcctgttggccattcccagcattgccactgctgtgttagttttctcatctgtaaataactgcctacatctcacagggcctctaatagttaaatagattgtaagctgcacaagcatagggacagtctgtcttttgtaaacctcccatgcacacaataggaaatcaaatattcttgaacaaatgaagtcactaagtgctcattaaatttcattttaaatatatgcctctgttaattcatggatcttggaacttacttaaaagacaatgctttgacggacatttccacattcctcatagggatttactttttaatacaaacaggttcagttaacattgccatacacatctcattacttttgggagtgcttttccagaaatctctggtagtcacgtcacttcatgatggggctacgttctgagaaatgtgtctttgggtgatttcatcactgtatgaacatcacagagtatacttacacagaccctgatgatatgtatatagcctgttacacacttaggctatacagatagcctagcctattactcttcagctatagcactgtacagaatgttactgtaatcatactgtaggcaactgtaacacaatggtaaaacatttgtatatttagacatagaaaaggtacagtaaaaatatggtataatcttatgagaccaccctttatacaatgtcattgaccaaaatgttacgtggtgccatgactatacttgttaagaaggaaaattccagtccttttgacctatggtaggctcaacaatctgtaattttagaaaatcctacaagggattctgatgtggatggtatgagtaccacattttgagatgtctagaagaaaaatcttcaaactccttggcctttttcttccatggaaccatcttctgactaagctggttagtcttctgaactagaaaacctgggtctgggatagaatccaaaatttgcatgtggacagaaaaaaacactgcagcaaacctgctgtaccaaaggttacttattatacttcagtgcttaccattgttttttttactcctttggtttaaggtttgtaaagacatctagctgttaggttgaagtgagctcttcaaatagaccattatatatataagtgttaaaaaagcacatggtctagtccctaaaacagtcatattttattcttctgaacagctacttacaaagtaatctcaatcagtgaaattataaatcatgtaactgttcatgattaaaaggcaagacacagccaagacagtagatgggcaagtctcacataaatacaagaatgtttatagaatgtttagcatatcatgttaatggacaatagttttccgttctctacagaagtatgaatgaaatgccaaagttgaagtcactggttatattcataaccagcttagtgaggatgttgcccactgcctcacatctgtaggacagttgggatatttctgcagagcattcataatttgagtattatccaaaagcagtttcatcagctggtactctctctgtgaatttcctgaagttctttccatgggctttattaattctaattgctgcaagtgttcaaaagcctgaaagatgaaagaaatagtttaggttgaataggagaggagagtgacaactctcctgttctctcccagagaacagttagcattttggtcagctgcagaacagagtactgggaagcaaaatgtaacaacaatcaataggattaaaaaaactctcacaaccccatgaaaactcatattatcaggtaaaacagtgtcagtgcacacttacttgtccatatattgttgaatgtaaacacggcaaactttaattcaatatatacaatatggttttcttcctagcctcattctctatcatagctcctcctagtactttaataaatagtttccagttctctgtaaaaacctaagaatcagataagactttctgatcaattccctaggctactcagatttgcatttatattttgtctgtctctatttttgctttgctatgtaaaaaggtaacacagctgtaacagagggaggcagaaaaagacccttgagtcaactagacatattcagctgatcctgtaagtaaaggattcagcaggctagtatggacatggaggagaagggacaggctcctgtttcctctaagaagtctgactgagactgtcacaaccttcttccatcttccccatcttaatagggctctttcttgtctacttcctcttatccttaatattcacctattatatcttttctaaccttgagtgttgtgttaggtacgttattaggttatgaaaaaaaaaaccattaaatcatgatatactaaccattaaataatgatacactgaaatagattcctgaggattctattatattcttacaactcactgtaaaaaacatcactggaacatattctctatgtatcacataaattcttctgatagagaaacagctcagataccttcatatctgaacatgagaaaatactggaggctgcaggtgttaagagctgaatagaactgtgcagatttaaaacatttctaaatagcaaaatacttcataattgaaaattcagaaatgagcagctacaaattattgagaatttaaatgcaggctgggcgcagtggctcacgcctgtaatcccagcactttgggaggccgaggtgggcggatcatgaggtcaggagtttgagaccagcctgaccaacatggtgaaacactgtctctactaagaatacaaaaattagatgggcatagtggtgcacgcctgtaatcccagctattcaggaggctgaggcaggagaatcgcttaacttgggaggcagaggttgcagtgagccaagattgcgcccgccactgtactccagcgtaggcgacaggagactccatctcaaaaaaaaaaaaaaaaaaaaaatttaaatacttgggtaacctttccattttcacagctctcacaaaataagactattaggggaaaaaaaccctccagtattgtaaaatacttttcctgtttctttgaagaaatggcaatgctctgtactcatttttgttgctacaagaaatgaaattctggttactagggcctataagggatgccaatggacttggggaatccactgttttaaaagtttctttccttaaaatcttcaagagctgcactgtccacgctaggctactgagcacttcaatgtgtgactcaatttttttttaaacttaaaaatggatatttagttctattagaaaattctgagcatgtttagaacaatttcaaaatgtaaatttactttctcagctatacattttatggaatctaaacagcaagaatttccagtaaacatttaggccattgagatgtgcttaaatataatgtacaccaaatgttaaagacttaattcaaaagaatgtaaaataccttactgttcttctataatgattatagaatgacacatttttgatatgttgcattaaatatataattaaaattaaacctttttatttttcttacaggtactagaaaatttaaaactacattacatggctcacattatctttgtagtggacaatggtaatctacatgaagtcctgaagttgtaaaactcatgactcagcccccaaataacactttctctgtatgccctcacaggccaataagattttgtcttttaagtttcttaatggctctaattttcattgttttctccttttactgctgagattataaaagccaatccttgggttggaaagggaaaggttatatcacacactatactgaatagttgttttcgggatgcaagtgctctgaagagacagcagagggcagtatacctccacaaactaaaacaaccggtcacttcctcagatttttccaaaatatttcatttttagataattttcttgttttgaaaaaaatctctataatacttaatgtttaaaaatgaaagtgcaattttaatacataatcaaattggatgtaaaaaatatacttgtctgtagaaaaatgacagcaaactaaatcttaccttcatgacaacaggtttttcaaaattataaacggaatgtgctttcctttgaacaaacttctgaaactctgagtagaaagcaatgacaacattataccttcaaataagcagtggggaagagtcagaaaaaagctacttaagtctcatctcaccattatagaccatttgaaaattaaatggctcttcctcatagatgtcatttaaatgtttcattgctattataagacagatttccaagactgatagacctacagtaaaagggaaaaaaaactatcagtttaatgacatataagactgaaataactgttctccaaagaatacaatatagtgaaagatctatggttctgaggggtgaagaaggtcaagattcttctagatttcaatgtgtttcaattatctatataaatttaagttacttaacctccctgagcttagtttttttcctatctgcaaaataaggatatttttaaacttttagaaatgtcacaaagattggcgaaatattatcaggcactcaccatatggcccacagtaaacaaaataaacttcaattgttatgtgactttaaatcacacagggcctttgcgtaggatttatctagagacttcctaaactcctggaaattatatccaaatctgtgtattccttttttccccggagaggaaaaggttcattacatttggaaaaggaaataacaaacccaaaatgactgaaacccagagaatgctcttcagtagttcttgatacaatgataacatcagcaacacagtcttacctggatttccaatgtggcaaaagaggcagagcgtcaaatttttttttcactttaaatgggagtgatagtacctttaaaaggactaagttaaaggctatatggatacgaaagtattttataaagcattatgcccacgttaattgtaattttaaaaacattccattatctaaattcaaagttttaaaaaccacaatttaaaaaataaggctgggttctcaccatgtacaatatttgctttcgagtccatgctacacagttggcttgcttccattagatctacggcagtcataaatgggtgcgatgctgttactcgatttaaagcaagcatctagggaaagacagatcagaaaaacaattacgtatttacatgggcattttggagatactgtgcaaaacttctgaatttgtatagttaattcttaagggagagtaaatattaatgcttaggaaggtattctcaaattcagttgtattaaaatacagtatttcaatttgtgtgtcacataactgcagatgtaaagcataaaaaaagttcctgctgctctctctaacccatcccagttgcataacttgtttacttactgcttggaagaacaatgtttaaagaggagtaggtcaaggagaagaaactgaaaataattaagaatacttactaataaaagccccaaacacaagcccaaaaggcagatctacgccttacttgttaactttttcaccacccaatcatccagccaggttagtattaatttagacagaagttagctgttttatgttcaattgtacaaaaaagaaaagaaaatagcacatttatactcaggaataactctccttgaaagcacagtctccttctcttgtgctgcttctctgttcaaaaatgaacagaggtcctggaccagagttgctactcaagtatttgaagatttccttccttccttctttatttgtatttttcatgaaagttaaatttggtcatttagggttacaagatttagcagataaaaatgcatgacctctggttaaatttcaatttcaaataaacaataaatagtttcttagtagtatgtgccatgcaatatttgggatataattatccaagaaactctccttcaccttaacaagggcgcaactgattagctgggcagagagtttggcaatccttgtccttcattctcctactggttgggacctagattgccagtgctccctccctttctctctcctttcctttttcctttagttattaattttttaatttttattttttaacttcatttttccataagttattgtggtatgggtggtatttggttacatgagtaagttctttagtggtgatttgtgagactttggtgaatgcatcacttgagcagtatacactgcatcatatttgtagtcttttatccctcgccccactggaaaacaatgtggagattccttaaagaactaaaagtagaactaccatttgatacagccatcccactacagggcatctacccagaggaaaagaagttattatttgaaaaagaaagaagtcattatttgaaaaagatgcttgcatgtgcatgtttatagcagcaaaactcacaattgcaaaatcgtagaaccaacccaaatgcccatcaatcaacgagtggataaagaaactgtggtatatatatactatggatatggataaagaaactgtggtatatatatactatggatatatggatatatatatatatgtggtatatatatactatggatactacacagtcataaaaaggaatgaactaacagcatttgcagtgacctggatgagactggagactattattctaagtgaagtaactcaggaatggaaaaccaaacatcgtatgttctcactgatatgatatgtgggagctaagctatgaggacacaaaggcataaattttttttaacatatacaaaggcaacagagaataataaatatctatgactactttacctgcttaagaaatatgattttagagttgaagcccatctcctccggattggactctactcttccccacataaaacaaccaagtatgtctatactattaggttggtgcaaaagtaattgccattttgggcactgaaagtaatggtaacttttgcaccaacctaatacttctactacatatacatgtattatacaacagagtaattttcaacttttatataaatatattgtatcttcacaactctcttcactgtgaggttttacccatgttgaggcagtatcaattctggtttattcattttttcattatatttctttgtatatatccacgattattcatttcctaatttcctattgacagacatctttcatttctttttttttcccaattataaacaagactgcaataaacaaccttggacatgtcttcctgtgcattaggtaactagactttctctaattagtatgtttctctagttacctaatttgctaaataaattgctctccaaagcacttacacatatttacattggcagcagcaataaatattaatagtcacagtcatgataccatcaagcataatctttaacacccactagattggcaagaaaaaaaaagtttaattgtagtatttctctggttactggagaggctgaaaatctgtaatctataatgagcttccacagtaagacaatgacaacaaataatgggatgagctaagaatatgagtaagcagccctcaaagtagaatcccatatgacaaaaaacaagccattatttaattcattaccatgaattaaaaatgtaatagaaaaatggcagaacaatggccgttaatattgacaatactgaggcagagatattttcccagatggagatgtgtgtgtatatatatatacatacacacatacacacacacacccctcctctaaaaattactagtccccaaattccttcatgatatgctgaaaatggcagtatgcttttgacaatagaagaaaagtaaatagggataaaaagacttaaattcctcagcagaagcagcaatgaggaaagaaaacttgtatataaacatgggtgaaccatacagccaagtaggacacaaacttgaagccagagagctttggattaagtcctggctttgttatctactagtagtgtgaccttcggcaagttacttagctttaaggagcctcaatttctttaggggtaagaataaaaaataagattattccaatggccagacataatataggtactactagcatcaacagtacttggctcatatgccagtccataaatggtagctactgtcattattattctattattattaaaaatgacctttctatgaaaccaaaactatcttgtctttcaaaggtatttgccataattttctagaaatattagactaaaaccaaatactcttagtgaagaaagttaattttcagaacaattaagtacttcttgtttgatattggtattatgtaagcttaagatataattacttggcaaaacatcataaccaggtaggatttattccaggtatataaggctggttcaacactcaaaaaataacataatcaaatatatcaacaggttaaagagaaacatggtcatgcgaaacgatcgagaataagcatttgacaaaatccaacacccatttataagaaactctcagcaagttacaaacagatgaggattacctcaacctgataatgaacatgtataaaaaacctacagctaacattatacttaatggtaaaagtttgaatcctttcttcctaagactgggaacaagaaaggatgtccactctcactgctctaattcaacataacactggaaattctagccattgcaaaaaagcaagaaaagaaataaaaggcatacagattggaaagaaaaaaaaaaccgtcactatttgtgaaaaatgtaatggtctacatcaaaagtcccaaggaatctattaaaaaacctcttagaataagtgagttcagcatagactataagtcaatcacatttctatatattaatgtgtatatatataatcaatcacatattctatatgtaatgaatatgtgggaaatgtaatgaatatgtgggaaaccaaaatttcaaaacccatttacaattgttctaacaaattaaatattggtatacacattaaataagtacatcatctgtgtagtaagagctataaaatgctgatgaaagtaatcaaacaagaaatcaaataaaaggagatatgaaccctattcagagattggaacactcgatgtagtgttccaatgcatgtcgattctcccaaaatttacctacaggtttaatcaattcccataaaaacttaattatctaatgaaagatagaaaatgataaaagtaggctgggcacagtggttgatgcttgtaatgtcagcacttagggaggcagaggtgggaggatggcttaaggccaggagttcgcaaccagtctgagcaacaaagtgagaccccgtcactattaaaaacaaaaacaaagcaacaagcaataaaacaaaactaatacaaaccaatagcatgtgtaatgaccgcaggtttttgctgatattgaaatgcttctgtagtacttcttgcacacttctatcttctgagagatactaaaaggaaaaaaaaaaaaaaagccaaaattgaggaaagatgtagtttaaaacctaaatataatcctgtgccttactggttggtgtaccttagtaactctatctaatattaattcattattaaatagatgttggtcttatttgtagaacactaaaaccaaaataaagtttccagtctactgattttcttatcctgttctttacgttaattcaataaacacaatgataaaacaatcctggctaaccccaaattcgtacttgaataagggaaactactacacagtcatactagtgaaatgaacaaaatgcagcacaaaaacagaagtgcatgagttactgtacctagggatacaaggtaaagtattacaaagaatgcttaaactggatgagacaagagatttaaaaaagaaggaagaacattccagttacagggaacagcatgagtagcaggaaaattatcacattggcagaaaatgagtagtcacgtactggagtttcaattactggcaaagtgaatgtacaaaaagaaaaggcagaaaaacctaactggaggtagctgtccagacaagaggtaaagtgggtcggaattatctgagtgttatgaagaaaaaagaattaagacgtttataggagtacatctggtagagaattaactggtagcagaagagaaggaagggtttgaaaggtagaagataaaaatcaaacatgatctatgggaaacaaaatggcctgtgaaaagtgaaatgtggtcaaaaaatgaatcttggattattaatatttaagtagtaggtgggaaaagagaaaaactaagaaattaagaaagataccaaagactggaagagaatctaagacagagtagagatctagaaaacaagggaacaaagttttaagagagaagtgaggttcaacaatataaactactttgtaaaaagatatatttgagaagaggctaatggctttagaaattcaaagatcaccacagccctttgagaaagtaccatctaaagaggcaagtgactgcagtaattagggttgaatggaaggtgaggaacactggcattgaagaaaagattagatgaaaaaagagtaaattcagaagtagcagagccaagaaaggcctggaaaagattgtcataatttttcaaaaatcatctgcatggaataaggattcttttaaaaaaaaaaaaaagcccagaaaactaagcatttctgtattttctagagctgtaattatatgtctttactttgtccactctaagaagaccagattcagaagtaagttctagtctactggaataaaattttatactctcaggaaatatattatcttaattatagttcccactcccttgctattgtttctagtcttctctttgtattttaaaggacttctggttactatatctttttctatcacaaacacggtagaatatccttggaagtacacagggtgaacataaaaaaaacaaagtaataccttttggaaattaaaaaaaaatttgtttagcttttccagttttaaaattgcaatatggaagatatgtggctaaatatcacaggcaaactatagtcttggtttctgtaatctgtaagttgtaaaagttgatgtggtaaaatcggagcacttaggaaaactaaagaaaatcacctgggacaaaattgaagaaattttctctgcaagaatcaattatttttaaaacctgcatttgcctctctttgacatgatgcttcaaaggttaatcttctatactccaccttcctactttatctctttattttttagtggtttgactccaattccccctctttctaaaagctatcgccttcttgcttctataattacttattctgctttttaaaatgcctaccttatctacatgagccatttaaacaaaaaaaattgtctaacctcgttcattatatttttaattccatcttgattcaaacactatactctatttgaggataaggctattatcaacaaccacataagctacagtactttgggagatttcatttgaggagaataaggtatgattcttttaaatgttcttttcaaaggatccctcttatactgccatgctaagatagagtctactttgcttatttgactcatttgaagtagggctaaaacaaaccttcaaattaggcaggatatcaaggttcaatcttatcctgaagatatttcttggatgagattccatgtgtgacctgttatctgtatcactgctattggcttaatcctgccattcaaaatagcttcctggataatcggcactaagagaaagaatagctcccttaatgcagctaccaccctactccacaaggcagggactctgaccatggtgctgacagatttttcaagtgaagctcattttattcacataccaaagacaggcacaagatgatcaggataggggaagaaaatattagaactcagagacacaaacaccagtgatgctggttctacttaatgaaactgactattaagactatcaaaatgatgacaagacagtgctcacatgcaggggatttaaggtctgcaacaaaagtccagaaagtagattagttatgctactaacacatggttatcattttctaagtcacgcagttatacttcttcaccagtaactcccagcatcctctttatttatagactcaatttgagatgctcagaatgcaacacagttgggaaggaaagtggatgaaaaatggcacagtgcaacctagaccatgtagttaccttaagaagattaagtgtgagcaggtatggaaaaaaaaaagcccatggaaagtacagacatttaaatactatgaaagactacatttgaatctctaaaacagccagaaaaacatactggtggaataagacaatcagttcaggagttgtagaagatgaaagtctgtgaggcactgaaaagtagatctaaaagctgaagatccagaggtctggttcacaccagaccccagtaaaaggggacaatgtgggagtaccaactacaaagaaggtgctcctatagatggaatcctataattagaaatagtatcaaagacacttggtcaggtaattgaaatacccgagtctcaggaaagattgagtggaagggaggatccatacctaattatatcaaggcataatatctgaattttaaagataatgtcagctatttttacatacaattatgtatagttgtattaagaaaaagaacagggaattattaatcataacaatgggaaaaaagtaatataaaaatatgtaggctttgagtcctttatgtaaaaacaacatatttagcatgtatataaactctgcaatgttgtagaccaagtaattattccatagtagaagaaaggagaattgatatagtcttaagggaaacttccactgtttatcatgtattcttttgcactaattacattttgttcaataaacttttatgatattttaaaaaaatgaaatgtgtcaaaatactgcttacatgagcagactatattttataatcaaacaataatcatttaaagaacaaactaaatgcaaaacgcttccaatttagtattagtatttaaaaattcacggtaaaaatacaatctaccactattgctttaaaataaaatgatcctttttatagagtcagtgaatatagactgtgtaattctattcaaagatctaattatccttaccggtattttaacattataaatcagtttttcccaattccttcagagccagggactctatattattttccactctcacgaggccaatattttttgagattctagcataagggacttattcattaatgatgtttttcaattatattattaaatacacacacatatgcatacttcctcctttctctttgccaactgaaactttttgacagcgtaagattaaaatgctagtgtgttgagaatattttaagcacaggtaaatttatagtctcaaaggtgtggcaaatctttaaaacaacatatgaacctgcctttgtatctaagactctcaagtctccagggactgtgagatgtgatcacctattagataatataactggaggtgccacagtctgtactgcctcttaaggcccaacaaaataaaagctgaagttgctaatgaaaactggaagaaaaaaaatatccacacataataggtatgagtcattaacatttatttatcattatttactatttattattattgctaaatatgtaaaatatataaaataaaattatctaaaatataaaccacatacagataaaactaaagcctcattaaagtttacttcaaactaataacataaatcctaaagcttaactgtgatgttcttttgagatagaatttaggagaaatgacatttcaactgtctaagaagaaaatttttaaaaagtatataatttgtattactgcagcattatccttcagcaatattagaaactttgtgttaatttactaatttctaaaatttgtgttttaattgctttaaatcatatagcaaggaacatttagctttattgccttttaagatacctgaacattttcattccacttctcagcaaaaaccttgtctggaaactctgcaggtagagataactgttctttaaatattttaacatactgtggaaaaccaaatgaattcattaagtgtatctgccggtgagaaaatcttgacttcactcttttttctaagagttccaaaatatccttaaaaacaaacagaaatctctataaggaagatgaatgtttttaaaaaaacaaaaacactgtaccaatgttagaggtataagtaaactatcacctataattagtaatgtttagtctacaatacataattaaacatttaaaacattttatgcaaactaaataatccacctccaggcatttgctggcttggtgatgtcatgcctttttcccaccatgttactctcagctaatctgtaacattccaagacccaacatgactgtttaaaaaaactgacaatattgaatagctatatgtcacaataacaccaagagtgtcaataaggaattctgtacattctatgaagaactgagattaaaaaattaatagcatgataggcagcaggaaccaactttaggagaggaaagtggcagaaatgcaacatggcattcgtaagttatcttccggcttttttttttttatagtaatgcttttagactctatttgtatttgtgctatttttccttaaaaagaaatcaggaatcaaatttactgtcaaagaacactaaaaaccaaaggataactaatatgtactgcttgtaaggacatacgaagtgttcttaaatgaagaaaatacttccacaaaactgataggcattcaaactatccaagacatcaaaagcacaataggtaagctgtcttcctaagtcacatatattgcaggaactgtcattcctaaatctctttttaataatgaacttgagcaatttttcaaaatatattatagtacacagcatattatatataatatatataatttatattatatatgtatatatacatctatatatatacagtatagtataatatatatttattacttaagttacactccaaggtatacaaccaagacaaatgaaaccagataaccacaaaaaaagtgtatgtgaatgtttgcagcagtattatttttaatagcttaagaaatataaacaacccaaatgtccatcaactgatgaatggataaacaaagtgtggtatatctacacaacagaatattatttggtaataaaaaggaataaagggctgatatatgctgtaacacagatcaactctgaaaacatgttaaagaagccagtcacacaaaactatacgttgtatgattcaaaaattactaaacagtcagaaagtggattagcagattagtggttgcatagggctggggagggaacaggggatttggggtgatcactaaaaggtacgtggctcttaaactgtggtgataaatgcacaactctatgaataaacaaaaaccctgttaattgtataatttaaatgagtgagttgtatggtataaattacatctcaataaagctgttttaaaaacagtgacatgatatttgatgactttaaggaattacagctaatataacaattatattagggaaatatatttttaaagagctcttatctcctaaaaatacattctaaaatacttactgataaaatgatataatacctagtttttgcctcaaaataatacaggaatgaaaggagatgttgaggataaataaaattagtctgtagtaattgaatcttggcaatgagtggagaagggaattcagggctcattatttattctttcctatgtatattgttgaaatgttataaagatttttaaaaggggagtagtttaagcccagaaatatacatctccacatctagccagatgactctcataatacctacgtgaagaaatcatgatatagaggaaagaattcaagtgatcaaaatgggatcatggttagtttgggaaggtggacaggaaagactaatagcctgaggtaggaggtgggagggtgaataaaaaattttgaatgtttttatgaggtcaaagaaaagtatagtgccagcatgagaactaaaagacaagaaaggttatattcagagattcagatattgtacatttattttctattaagaaagagttctaggtcacccatataggtagacagtggaagtaataatctatacaagcaacaattcagaccctaaatttgggaatgaaaagagatggaagtaaatactgtctttgtagtaggcagtaatgacagaagttggcaatgtgggcatacaggaactagtaaaaacaaaacaaaaccaaaaaacaaaaatggaattactcccaatggggaagaagatgcttgctggcaaagtcactactccctctatacttttgttctctccctataaacgtggatacacagataaaattatacttgaggccaggcgcagtggctcacgcctgtaatcccagcactttgggaggccaaggggggtagatcacgaggtcaggagttcgagagcagcctgggcaacatggtgaaaccccatctctactaaacatacaaaaattagccaggcatggcggtgtgtggctgtaatcccagctactcgggaggctaaggcaggagaattgcttgaaccccgaaggtggaggttgcagtgagccgagattatgccattgtactccagcctgggcgacagagcaagactccatctcaaaaaaaaaaaaaaagaaaaagaaaaaaaattacacttgaaagaactacacagttggagaattatatatatacaataaaaaagaacatctgataacactgctaagaagttactggcattttatttggtccgttattgggtcaacaacactcaccacagccacttccacccaaaggaagatttttttttttttggcaagaaggaggatgcttctttgatccttgtcatcgcctgctgcttttggcaaggaggaataaagatatgtggagcaccagccagtgatgtatgagggatgtttatactaaagccatgtatcataagctctagagcacaggaaaggaggggcaaatgacagtcactctatagagaaacagcactggaaggaggactgttgaaatatgaattagaaaaaagtttcacttttctgaaaaagaaaaagggttgtaggaaaggagatgtgaacatgtaaatgtgcctgacacatctgccgagaatggagggggaagaggattgcaagaaagctatggaggcatggcagtcatagcatgagaaaagagacaactttgctatggtttggatatggtttgtccccaccaaatctcatgttgaaatttaattgccagtgcaacagtgggaagtcactggagtggaccctcataaatagatttaatgccttcttactggagtgagttcttgttctcatggggatagattagttcttgagacagtgagttgttataaattgaggttccaactcctatctggttcgtttttgcacatttcggttccccatttgaccttccaccatgtcatgcagcatgaaaacccttgcaacaaagccagtgccatgcgcttgaatttttcagcctgcagaactgtgagataaataaacttcttttctttaaaaattaccaagtctcaggtattatgttatagcaacacaaaatgggccaaggcactcttcaataccagttttatctgaattcagtaagttaatactacatgcgtgtaagaaggtaaacacaaaaaggcctgtactgctgtccaaaggtacacatggttcaatatgtacagagccttcacaaggcaaagtgatagtgatattgagactatagttaaaatcattctaaaatatcccatggaatgaagaagccactatctactgtcagtgcttggtagaatcttttccatttctggagatgtgtactttgaaagttggaatagtattacttagagttgatttcaagccttttcaaaatatggaaaaaaatcttaaaataaaaactattaccaagttttctcaaatattggtgagatttaaccgcctcattacttgataatgtagaaattatatttattagcataatctgatttcatacttttttcttcagtaatttcactgggaggagggaggtattcattaatgggctaaggtaactactaaactgttttcctcaatttgagttgaaagcaggataaatacaccaggcactgctgaaacaaaatttttaaaatgacctaaataagtgaaaaaaactagcagtgtcagcaattaagcttgaattttaaaatattataatcaatttttttaatgaacagaaagacttaccaatctacatgtaagaccaataactgctattggggtctgtgcagactgagaaatgtcaaaaagattatagagaagtgtttggtttttatgatgagcaaaaagatcaaattcatctaatatgaagatcactgggcaactgctagttcggtcacctaagataaaataagagcattacattaataagaaattatatccacctttcctaaatttccaaaccatttactatatttcagtttttaaaactcaattctgtaaacattctgatagcctactttgggtaggggatttactgatgcatatacgttcattcaacagaaaaaaattattcaaaggacaaacacagccccgactgctctcaagaagttcagtctaggctgggcgtggtggctcatgcctgtaatcccagcactttgggaggctgaggtgggtggatcacctgaggtcgggagttcgagaccagcctgacaaacatggagaaatcccatctctactaaaaatacaaaattagtcaggtgtggtggcgcatgcctgtaatcccagctactcgggaggctgaggcaggagaattgcttgaacccaggaggcagaggttgtggtgagccaagatcgtgccactgcactccagcctgggcaacgagagtgaaactccatctcaaaaaaaaaaagttcagtctaggccgggcatggtgactcacgcttgtaatcccagcactttgggaggccgaggtaggtggatcacctaaggtcaggggtttgagaccagcctggccaacatggtaaaaccccatctctgctattaaaaaaaaaaaaaaaaattagctacttgggaggctgaggcaggagaatctcttgaactgcggaggcagaggttgcagtgagctgagatcacaccattgtattctagcctgggcaacaagagtgaaactccatctccaaaaaataaaaagtgcagtctagttcctagactctagtagagtttgttgttgaaaaatgtcaaaaatcatttaaatgactaaagactattatttttataattacgtaaatataattcttatttaatgattataaaattgacagagttttctatacctacacagaaccaaaacactttaagattaaaatataaggggagtcactaattaatgaacaaaactaatgctttaaaagagagttgtttatttagtagaaatacaaggtacatttcttgtagaaatactttttataaacaaacttgtagattataaagttcaactaaagccacttaaactcccttgaagcacaacttttagcatttcaactacaatgcttttcatggggaaagttccacatcaccctctggttacatttttctcacttcaataatggaaacaactttagtaaaagaatcccttttaccttaggcttaacgcctttatatttgtgttaaaaagtgaaacaaatatctgataaaagaaagacttatttcaacaaataacaaatacagtagcctaaatgacttaatactggtacaaaaccaaagggattactcaaaagtctagaaagagacttatgtactaatatagaattttagtatttgataaaatattgcattatacatcagtggggaaaattagtctattcaaagtcagatccctactttacaggtaaaatcagaataaattccaaacaaattataaattacaaatatatatatatattaaataaaaagatggatcaatgaatgtttttataatctgaaggagagaaaaaactttctagataaacttaactatgtggaaaacataaaactttagatcagcagaaaagtccaaaccaaacttaagggaagagaaaaataaaacacaaaaattccgataaataagcataacataaacattaccacaataggtcaaagacccaacaggaaatacagtcgtgtgtcccttaatgacagagatacgttctgagaaatgtattgttaggtgactgcatcgttgtacaagcatcctaacagtgtacttacccaagcctagatggtatagcctactagacacctaggctatatggcatagcctattgctcctaggctatgaacctatgagcatgtgatagtgtagacaactgtaacacaatgcgaagtatttgtgtatctaaacatatctaaacacaggaaaggtacagtaaaaatatggttttataatctaataggaccactgtcacatatgtggtctatcattgaattaaaggttgttatgtggcacatgactgtacataaaccaggaaatttcaaaggtcaataaaaatatgaaatgacaagcatcaccactatcagaattatgcaaattaagtaaccagaattatgcaaattaaagaacaaaattattcaaattaaactaagagctgaaagtttttctattatatgggcaaacataaaaataataattgtttttgaggttgtgaagaaaaaggtattatcaaatatttttacaaattaaacctttagggtagtttttaaatgttaaagatggtgccttttaacccagaattctacccacagaaatttatcccaggaaatatctggatgatcatcaaagtatctcttcttaattataaaaaattagaaacaaaagcccataattggtgattaataaatagcaccttataaaacaagaaccataaaaatgatgatgcagatcaaaatcttattacaaaataggtaaaataattttattgttgtaaaaaatcacatttatctctatcaataatatactgatataaagatcagtatatcattgaataaagataagaaaccaaatgctaattgagataatcactgttatagtggtgggaatacagtgaacattgtattctttttaatgtttctgtattttatgagagcttttttttttggcaaaagcttgtattacctttataatcagggaaaaaataaagttaaaacagatcttctgaaacggctgaatatgttaatatttacctttttttaaagcttccagaagaaatgaaaggttttcagcaaagcttccctgaacaacaaaatgagataaaatgattaaaagtttagtgaaataaagaacaaaagatggctgtctgattctcaaattttatataaacactgtatatcttctagttattagagtcattgcccagactctgctgagtgtctctatacttcctatctaaaacttaaatacttaagcaaagatggcacatcactgaaaatggcaattacaatgtcatctttgaaattttatattttagaacttgaggataaaacggtcaaagaagaaaaagaaaagtaagaaattttatattttccggaaaaaatctgaaagaatgttaaatttatttgaaggtagttttgtagaattgccatattctaaatatagtttgagacctagaaatggattctactttgtgtcttcaaacacaatggggtcttgcaagtctctaatttgtactggtaaagaaataaccatgaatttaaatgagaaacaaaaagaaaaggcttttttgaaacattagatactataacagtgtttgtctattcaagagtatactgaagaatttatgtatatcatatcatgtttggctatgtttacttggaatatagccaaaacatttttggatactattaaatattcttgatgaaacttagtgtagtagatgcattatccaggtgctccagattgtgggtagaagccccattaaaatatttgtttcattaaaattattaacttttacttcattcagagttcataactaaaagaaacagccaactttaaatttgaggagatataaaggagaaaagaaacacacttattcactctccagttgagagatctaacataaaaatagcataaaggttttaaaactttcacatattgtgatgttgttatgctatttccaaggcaggcagaccaagaggtgttatccataatttaccgtaatataacaaatcctcaaagagacaatctgttgggaaatcagtggtcagttactcaaaggtagcttgtctttcaggctttttgcttaaaagattattacatctgatactaagtatatgcttctataaatacgtatttgtgcatgtataatatacatatatatgtctgtttatatcaaaccagaaaagctgtgggttgaattaagtgacttaggttcttataatgtccaggctctgccattttatgaccttcggcaacctaattatgctctctgagcagaagccaaatttatataatgaaggaattaaactattaatttctatagcagtatttctctattcaagagtacattgaagaatttatgtatatcgtatcatgtttggctatgcttactcggaacacagccaaaacatttttgggtacaacttaaactaataatctctatatatgataataatagcgaagattagaacagaatgataaaaaattgtcatttttattatttcacataaaaccaatatgaatatgtaacatttaaaaatgtcagaaacacctacccagatcaactgggaaccaaaagccaaactgagcatacttaacaagaactgtctttggctcagtataggccactagcttcaacatcacattctaaacaggaggtagaatattagatttatagatggggcattttgaaactgcacttcaaagacctacagactttggaagggacaaatttactcaaccttttagattagattaacattttatattaatatttttatagattaatatattatattaataatttagattataatctataattacatataataaactataattatatataatctattagataattatatagatataacctattatagaattacatagattatataattatataattatataattaataattttatagagtatataattatataattaataattttatagattgattattaaagaaagaaactcataaatgctaggagtcttacacaactatggcggtgtcattgcagcacaaagcacacagttcagaaattagagcgatgccaccgcatggtcaccagtaaccagaaaatgaagttggaatgtgtataatccactccaactgcataagcagtatgaggctaggtaatttcatcatgaaaattcaggtaggtgcaaaattaaattatcatgttttccttaggccctatatattaggtgaaaggtaaaagtttaatacaagtttcaaaacatttcaagtcagtttcttttactgatgttgttcactgccctgagactataagatgatatgataatgaagtatgaataaatttctgaaaacagaataactgacatttgtacagcacattaccatccagcaaattattttttaagttaaatgatgtgtaatgttttctttcttcttcaaaataatcctgtgaagtatggataataaaataacgcccaattaacatgtaaagaatctgaattcagagatacttgttagctcaggattatcaggcagtcaaagggttgtaaggcatgactgaaacccacctattgcagcctcaaatttagcacattttctactatacacaggctactcaagtctcaaaaaagtagaaataggctgctggagcatggtatttttaaaaatgtgttaatctatctccagagatacagaatcaaagtattcaccttacagaaaatgaaataaactcagaatatctacataaacttgggtttcttagctattttacagctactataacctactatggaaaaatccaagtattgtagacttaatgactaaatgtatcctatacattacacatttttatgaaagaatctcatatatttcaattaagaatttctgaacctctccctacccttccagaaatataaaaatatacatggtataaagacattaccttaaaagtctatttaataaaataactgaaatgatacttacaaaaactttatctccaactacattttccagatttaactgccttgtgatttcctttagggcgattttgtcattgatctgcagcagtcctaaaataaagtccatttaaaagtatttaattaaaattaaacatgtatttgatacagcaggttgttttccagttaagtaaatcttcccagtcaaagcctgtgagttcatatcactttcttcttaaaacttagcaataaagacattcggtagaatcaaaaaacaatcctccttgggattagaatgattaaaaaaaaaaaaaccaaaaaacccacaaaaaccagagtccttctgcgactccttcattattattattttaatttctaaaaatactgcatatggtgtgctaagtaaaacatggatctagttttcaaaatctaactattaaaatggatttgaaatatacaagtcatataaaaaccccacaaagtttacataatctccaatggcaaaataatggcatacttaccatttaagtgaacttgtaatacattttcactcacttcttctatttccatgagttctttcaaagcatgatttattaactaaatatgaaaagtttatgaaataataataggtaaaagataaaaataagtccatattcgtttttaaactacaagcagtaagaacagaatataaataaattgacctctttaacaagtaagttttcaaattctttacagataaaaggtttaactagaacatctcatatctgactctttttaagaaacaagagccaggactgatacaatattctctcaatcacctacccgaacttttaatacaaatttagaaacaaccaagttttaaaataaatatttctctacatgtcacattaaacatgtgacatggcccttataaacttcatgtctcagttagtacattacacatctctctgacaattactctactaaatatcattgtaatcagttaaaagcccattgaattaaaggtttctatgaagcatacttttttaaataacattgtattgctcttgtactgtgatatcatacatatctcttcatattaccaatgcattcttttttttaaagaatttgaaaatgaatgtaattaagaaaagccaaaaacctatttaaagagtaaagatggactgttccttccaatattaaaatataggtactatcataaataagtgaactgggaaaagcagttgtatacacaaaatattaatagagatggcatcaaaacttaggacaaaaagtattactcaacgaaggcactgggacaactggtaaactattttccaaaacaaaatactgtttgtatttgcaatatgctacttatttgtcattgcaacaccttatctaaaaagaaaaaagcaaatatgatcctcattttaaattacatatgtttcataacaagacaacaaaaataaaaaaaatttcctgttatacctgcatggtttttaaagcatagggaattccaggtcctctgaaaaggagacaatctcaagatatcacctgtcatactaccagtaatagcccaactgagaagtgacatttaatgagaagtgacatttaatgagaagtaacattaaaggactgcatagaggtacttcttcacctctggatcaggtcagacactataataagagtacatccctagatgatacagagttggtctctcaaaacagtgctttcagcaaaaattttttattttttattttttttgcaatccatggtattttctttcttccatctcttgatattttgcttaatatattttttcctaggttatgattttgttttaattcatacaatgttttatgttttgatgaattattcaaaaccatttcaaatcctttgctaaaaggaatggggattttaataataccttccattttatatatgcataaggagagttgtaacagatttatagctttctttccactcaacttactttaaacaccaacttatgctttgcttggatcagcccactaatattttatgggttgtgtgtatggtctgaaatgataaatatattagcaagtgagtcttcaaataatgttagttctaatctgggtattgctaaaatttattgtttatgcaatcaaccatttaagttagcttttttcttgaatatgttatcatttcaaatatttaaactacattatacactaaaaatatttagttggttattaatatcacactgaccaacataaccaaatttggtcatctcctttccacattctttgtgcctaaaatttaattttacaaacatactaagataattttcttagacctcccaacatccagtaatttttatgctcaccaacttatactattcccaaatattataataaacacaggtttcaccaatatgcaactaggagaaatatcctatttaaccatctagcaaatttgtctacagtaaattgcatgtgtaagagcattttctaagggtcggtacagtgggtcacacctgtaatctgagtgctttgagaggcagaggcaggaggactgcctgagcccaggaggttgaggctttagtgagctatgattgagccgctgggcgccagcatgggtgacagagagcctgtctcttaaaacaaaaaaaggtattttctaggggtcaatctgtcacttgaagccatatcaattttttttttaaataaaatgcttgtaatattataagccacactattgcctttttcaattaactatagagttagcatttttgtatttcagacagtttggccaagtatagtgttttaaatatactataatcttagggttaggattaggggttaaaacaaacaaacataagactacagtcttatgttttaaaatttgaatttatataattatactaatgaggctaggcacagtggctcatgcctgtaatcccagcactttggaaggccaaggtgggtggatcacttgagcacagcagttccagacaaacctggtaaacatggtgaaaccccatctctactaaacataaaaaacttagctgggtgtggtggcacatgcctgtcccagctactcgggaggcaaatgtgggaggattgcttgagcccgcgaggcagaggttgcagtgagtctagatcgtgccactgcactccagcctgggcaacagagtgagactctgtcaaagaaaaaaaaaaaaagaaaagaaaaagaaaaaaattatactatcgagagttattgtctaaaaataaattatatctgacaatttattcaatctatattttctctcaggatactcccacacatacaacaaattacaaaagtagcacaagtcaaacaatgctcatctcttcaacctgccagcatcagagtacatcaggaatatatgaaactatatcaaaatggaatgccatgcaagggactcttccagattccactatagtgaaaataaatgactgcaaggcaccacaatagggctctggtttaaaaagcaaaaagtagataaactgtcagtgtggccaagaataactgatccattttattaactgataaatactatgatttaatgcttttgcctttaaatttcagtacattgattaaacctataggggtttatgaaaaggtgctataacgtggaagggaacaacaagcagattaaaaagattaagttcagatttaaaatattaagcaagatggctgattagagactcctggtgctcgtactcccaacaagaaaggaccacagcaatgaatgaacagctaagatttgactggcgtgttgaagggagagtactggagtgcagcagggaaggggaaatgtgtagtgactgaaaatccaggagggtagtgtgtaggcacctggcctctgcagctacatctcctgcaccccgatcaaatcttcccgtagtcaggagggacttcccgttctggggaaaaggtaagcagaagatccccaccagtcctcaccgccatcacaaacacctacagtccttaccacaggagaatcccatagtcctagcaagccctaagtcaaggtggacagctgctgggaattcaagcagttgcattgctccagatcatgagaataaggtatgcactctccaaccctcacccacctgtaggccaacctgccctgctgcagcatggcaccattgaggccagagccacctctgttgtgcgccccgctctgtgggccagtagtcactgcacctttccagtactaggggtccatcttcattccaccaagcccacataggtggctgaacacacaactctagctgcacagagactgagcctataattggttatgactctggtcctacacagcaaggaaaccaaccccttgctgccacacttccagccagagaaccaatctggcagtcccacccagggcaaactctcacttgaggtgaccaaaccagggtggggctctctcccaagaaggagaggcccccgagcatccaagcagctgatacaccccttgcactggcagagcggctatgcacccacactcagaacctgagaaacagccccacaataccgtgcacccctccctcccgcagacatacccctagcttgcccagtggtcctgtgcccacaatcagagcctgaaaaatagcccagaaggttacccctggcaggcatgcccccagcccagccgagcagccatgagccatgacctgtacctgagaaacagccctatgggccacccatggtgaatacacctcccacagggtggccaagcatccctgtgaacacatactaggcctgagaagtagcccttcaggccattcttgagcctgccaagcagtcttgtgctcacctcccaaacctgacaaacagcacagcctccctataactccatcagacatgccccaggaccagccaagcaatcatgtgcccacgtcgctaacctgagaagtacacttgccaactgcccctaacagacacattaccctagctggctgagcagcattacaccttaggcctacaaatcagccctgagggttgcctctggcagacactcttttgggccagtcgagcaaccctgctcctacttcccaggtctacaaaatggtccagtgggccatctgctgcagaaaagttcccaggccagccaagcagcagtgtcacaggcctgagaaacagcctcacaggacgcctctagtgggcatgcccataagccagctgaatagccttgtgcctgcatcctaaacctgagaaacaatcctgtggaacccctcagcagatacggccctaagccagtcgaggaactgtatccctacacctctgttgggatcaagcagccttgcacctggatcccaggcatctcctgggcctgagaaacaaaccagtgagttgttcctggcaaacattcaccaagactggctaagcaaccacatgactatgctcctggccacattaatagccccatctgccagtgtgtcagatcccaaggtgattgacccaccatatgcatgcatatgcccccaaactgagaaccagcccagcaaacccaccccttgcaaagctgtacaactgccaccacaaacaactctcagcctaggccactgagacacttgtaaatgacactagtgtggattacagctgaaaaaactacacaaagaccacactactgtatccaactagaaccaaggccaatgaaccacatcaaactgacacctcgagacacattgacacaaatcagtacttccttacgagatcaattctgtaagattggaaaagacaattttacttttctacctgaggcgtatcaatcaacatagggacacattaaacataaaaaagcaagaaaacatgacacttccaaaggaaaacaataattcctctagtaacagacaagaatcataaagaaatacagaaaatgccagaagaatttaaaataataatcttgacaacactcagtgaaattcaaaagaatacagatagaaaattgaacaaaatcagaaaaacaacttgtgattcgaataagaaattaacagagataccataaaaaaacaaacagaaatcctacagctgaagaagttaatgaatgaaatagaaaatacaactgagaccttcaataacagactacatcaagcataagcatttcttaaattgaagacaaattgtttgaaataacacaggcagacaagaaaaaaaatagaatgaagaaagtctacaggatttataagacttcaataagtgaacaaatatttgtattattgtactttcaggaggagaaaagaaggaaaaggtgagaaaaacatatttaataaaaccatagttgaaaacttcccagttcttgagagaggaatggacatccaaaggaagctcaaaactccaaacagactcaacacaaacagaaggtcttctctgaggcatattatagtcaaattgttaaaagtcacagacaaataattaaagcagcaaaagtaaagtgtcaagtcactataagggaatccctattatactaacagtagatttcttcttctttatagcagatttcttttttttaattaaaaattttaaactatcatttttttaaatgatattttaaaacatctttcatccttcttgtttacattttagctgattgtcagaatatacaacagcagatttcttaagagaaacctgacaggacagaggggaatgggatgatacaatcaaagctcagaatgaaagaactgtcagctaagaatataatacccagcagcttcagaaataaaggagaaataaaatctttcacagacaagcaaaaactaaagcaatccgtcatcactagaccagacctataagaaatgttcaagggagtctaacatccacaaatgcaaagatgatgaccaccatcatgaaaacagggaaaactataaaactcactggtactgcggatacataaaggagaaagagaaaggatcaagccttatcactacagagaggcacccaactggaaaaataaatgagaggaagtaagaaacaaaggatatatgaaacaaccagaaaacaatcactaaaatgacagggtaagtcctcacttatcaataataatcttgaatataaaccaattaagtttcccatttaaaaaatacagaacagataaaaaaaaaaactcaattatatgctgctacaagaaactcacctcacctgtatagacacacagacttaaaggtatgaaaaagatatcctatgaaaatggaaaataaaagtgataagaaagttgtaaaaacaaagaacattatataataataaaaggatcaattcaacaacagaatataacagttgtacatataaatgtacccaacactgaaacactcagatgtataaagcaagtattattagatctaaagagagataaattgcaataaaataataggaacttcaacaccctattctcagcattggacagataatttagacagaaaatcaacaaagagacattgaatttgaacttcaccatagaccaaatggacctaaaatacatctatagaacatttcacccaacaactgcagaatgtacattcttctcatcagcacacagaagattctccaagactgacctcatgttaggacacaacagaagtcttaaaacatttttttaaaaaaagcaaaatcctatcaagtatctgatctggccacaatggaataaaactagatatcgataataaaaacaactggctaggtgtggtagctcacacctgtaaccccaacactttgagacgccaaggtgggaggatcccttgagcccaggagtttgagaccagcctgggcaaaatagggagacctggtctatattttttttaaaaagtaataataatgacaggaacattaaaaactatacaaaaatatggaaattagacaacatgcccatgaacaatgggcaaaagaaattaagaatattacagattcctagaaacaaaagaaaatagaaacacaacttactaaaacttaaggaacacacagcaaaagcagaattaagaggcaagtttatatcaatatatgcctacatcaaaaaactagaaaaatttcaaataaagaatctaacaatgcaatccaaaaaattagaaaaattttaaattaaaaaatctaacaatgtattccaaagagctagaaaagaacaaaccaaaccccaaattagtcaaaggaaataaatatcagagaaggaataaacaaaattgagactaaaacaatactacaaaaaatcactgaaacaaaagttgcttagctagactaagaaagaccaaaataaataaatgagaaaagaaaaaggagacatcaaactgaatatcacagaaataaaaaggatcattagggactactatgaagaactatacatcaataaattacaaaacctaaaggaaatggttaagttcctggacacatacaacctttcaatattgaagcaagaagacacagaaaacctggagagaccaataacaaataatgaggtagaatcaggaataaaaagtcttccaacaaaggaaaatccagtactggatggctttgctgctgaattctactaaacccttaaggaattaatgccaattcttctaaaactattccaaaaaattcaagcagagaaaattcttcctaattcgttctatgaggccagcataaccctgacatcaaaactagacaaggacaaaacagcaacaaaaactacaggtcaacatctctgatgaatatagatgcaaaagtcttcaataaagtattagtaagctgaatgcaaaaagatcattcaccatgatcaagtgggatttatcccagggatgcaaggatggtttaatatacgcaaatcaataaacatcatacaccacatcaatagaatggaggccagaaactatatcatctcaatggatgcagaaaaaaacacgtgataaaattcaacatcccttcatgatagaaactgtcaaaaaggtatagaaaaaaaacaccacaacacagtaaaggccatatatgacaaacccaaaaccaacatcacaccaaatggggaaaaactaaaagtttctcctgtaagaactggaacaatacaaggatgttcactctccccattcttattcaatatagtactagatgttcaagccaaagcaatgggaaaggaagaagtcaattcattcctttttgcagatgacataatcttatatatagaaaaacctagagactctaccaaaaaactcttagaatttcagtaaagttgaaggctacaaaatcaatatacaataaccagtactgtttgtatatactaacaacaaactacccgaaaaaaaaaaatcaagaaggcaatcccatttataagagctaccaaaaaaacgtaattactgaggaataaattcaattaaggaggtgaaaggtacagttttgtacaaggaaaactacaaagcactgaagaaagaaattgaggaggatacacacaaatgaaaagacacccatactcacatgatagaaagaatgaatattgttaaaattactatattaccagaagcaatctacagtttcaatgatattcctatcataacactaatgatattcttcacagagatagaaaaaaaatcctaaaattcatatgaaacaacaaaagatgccaaatcgctaaagcaatcttgagcacaaggaataaggctggagtcaacatactgccttacttcaaatatactacaaagctgtagtaaccaaaacagcatggtactggcataaaaacagacatgtagaccaatagaacagaatagagaacccagaaattaatctgcttatcaacagccaactgatttttacaaaggccaagaacactcactcatcagggaaagggcaatttcttcaataaatggtgctgagaaaactggatatgcagaagaattaaactagattcccatctctcatcctgtacaaaaatcatttcataatagatcaaagacctcaatgttaagacctgaaactataaaactactagaagaaaacataggggtaatacttcaggacactagtctaggaaaatatcttatgaataaaaactgcaaatcacagacaacataaaaaaatagacaaatctgctaacatcaaactcaaaagcttctgcatagcaagggaaacaatcaacagcatgaaaagacaatctacagaataaatgaaaatatctgcaaagtattcatctcatagggattcatatccagattacacaaggaactccagtatctcaaaagcaaaaaaccaatttgcttaaaaaacaggcaaattatctgaacagacatttctgaaaggacatacatatagccaacgaatacatgaagaaatgcttaacatcatcaatcatcagggaaatgcaaatagaaaccacagtgaggtatcatctcactccagttaggatgtctattttcagaaaaacaaaaaataataaatgctggtgaagatgcaaaaaaaaggaacttttatacaccattggtgggaatgtaaactagccaatattgaaaacagtacaaaggttccccaaaaaccactacaaatagaactaccatatggtccagcaatcacactactgagaatttatataaaggaacggaaatcattacatcagagagacatctgcagcccgtatttattgttgtactattcacaatagccatgatatggatcaacctagttgtccaacaacagatgaatggataaagaatatgtgtatatacacacaatggaatactgttcagccattaaaaaaagaaatgaaattctgtcattcacagcaacatagatggaactggaagaagttatattaaatgaaataagccaggaaaagaaagttaaacaccatgcgttttcactcatctatggaagccaagaaaagtaggtcttacagaagtcaaaagtagaagagaggatagggtaggaagggtaggaggaaaggagggatagtgagagattcaataatgaacacaaaattacagcaagataggaggagtaagtaacagtgttgtactatcatttttctgtaactataggatgactataattaacaataatattttccaatagctagaagaaggatactggatgttccccacataaataaatgataaatgtttgagatgattgatatgctaattattctgatttgatcactatacactatatgcatcaaaacatcactatatatcccatgaaagtgtataattattatgagtcaatttaaaaataaagtataaaaaggttaattactacctaaaatgactattttatgaaataaatgttttgagctatttaagccagacttagacaagaagaaaagattcttagaaaactgaaatgcaatatcagattagaagaagcaaatgacagcactggcagtaaagaaaatcacattggccatatgacagaatgctgagagagggggaaaaaacatgaaaaagatggtagacatggaaaaatgaaaacaaagatttaagaactgaatattctaatattggatattcattttttctaatcataagaaaaaatgaaagaatattcaaaaataaaagaatattattctttagtgaacaataccctctaaatttatactaaatcagtatgcagagtattagtgaattttatgattaactgttagacatagtctatgaataactaatgcaataaaagaagaaaaggaatagaagtatggagatagggaaggaataattaaaactgtctttgttgacagataacataactgtctaagtaaaaaaatctcaaagaactgacaaaaaaactaatggaattgagaagcaattatagcaaggttgcagaatacaagcaaatatagaaaagccaagtgtttagctatctactagcaatgaagacttagaaaaggaaataaaaaacacagtactattcgcactagaaccaaaaaaatgaaaaattaggtataaatctaacgaaacatgtgtaagatctttattaagaaaactacaaaaactgacaaaagtcttaaataaatagatactccaagaacgggaagactaaatatagttaagatgtccattcttcctattgtgatgtataaatttaactcaaaatctagcaattcacaaagattcccagaattttctggatatgtacaaagtgattctaaagttaatatgaaaaggcaaagtatgcagacagccaacacaatactgcagaagaacgaggtcagaagactgacagtacttaccttaaagactcactaaaaatctacagtaatcaaaacaatgtgatattggcaaaagacagacaaagcaagggaatagaaagagaacctaaaaacagaaccacataaacatagtcaactgatctttgacaaagaagcaaaggcaattcaatggataaaagatagtctttctccaattgggcattcatttgcaaaaaaaaaaaagaaaaaaaaacgaatctaaacacagaccttacatctttcacaaaaattaactcaaaatgaatcacagacctatatataaaatgcaaaactataaagcttgtagaagatacataggaaaaaatctacatgactttcggtttggtgatgaagcttcagatacaataccaaaatcataatacatgatagaaaaaactgacaaattagattattaagatcaaagacttcagttgggcacagtggctcatgtctgtaatcccagcactttggaaagctaaggcaggattgcttgagctcagggttcaggaccagcctgggaaacatggggagacctcgtctctacacaaaattaaaaaaaaaaaattagccaggtgtgatggtgcatgcttgcagtcccatgtactcaggaggctgaggtgggaggactgcttgagcacaagaggccaaggctacagtgagctgtgatcatgccactgcactccggcctgggtgaaagagcaagaccctattcttgtaagtaagtaagtaaaataaataaataaaaactactctaccaaagatacagttaatagtatgaaaagacatagcaacatcccatctcaaaaataaataaataaataaatgaaatcttctgctctgccaaagacaatgttattattaatagtatgaaaagaataatattcttttaatattatgaaataatattaatagtatgaaaagaaaagccacagactgtaagaaaatacttgcaaaacaaaactgaaaatcagaaatataaaggactcctaaaacctatcaataagaaaacaaataacccaaattaaaaatgggcataagacacctcaccaaacatatatagatgaaaaagaagtgtatgaaaagatgctcaacagcatatgtcattagagaattacaagtacaaacaatgagacaccaatatatacctattagaatggttaaaataaaaagtttcttaaatttaaaaatttaaaaatttgaaatttaaaaacatttcacatagccctcttgtgaaaactacccaaaataacagtgaattcaaatgcaaagaaaaaccataataaaaaactcaagaatgaagaaatagtgattatagaagctgagtatgaggactaaaacaaattaaacatagatttgaaactaaaaaattactgcaaatatgattatatataaatgtgacaatttgtgaaatattgaaagaaattacctagatctaaattctcaatttatattaaacaatacttcagatgtgataacagtaaaatcctaacgtactcatcttaataatgtaatttcaatatacattgcttaaatgttaaaaaaaattttgcttctcatccatttttttaaagtacattggtcaaaaattgaaatttattgtatataatacatgagaacagattttacacagactacttagcattgaaattaattgctttcaaaagttaacacccataatttgtctcctatattgcataaaggatatcaaagaaaagagtaaagggaaataagtaagaatatctttttgaggtaactaagcaaatatgataaagagcaaaaggagacaagaatgatataagatgtgagcatgcactgaaaaactgtgtaagttagggttaaacaaatagtaatgatgtaggaaaaataaaaagaatgcatgatatgatagttccctaacctataacaaagggaaaaaccctaccgtgcagtgttgatgtaaagaataaatgagagaacacaataaaaagacacatagtacatgctcaatacatgctattttctttttccactggaaatctctacttctttaaggacaaaagaccatgttggaacaaacatcaattgacaatttttcactaggaggacaaataagggggaaaaaggtctgctacactcaaatataccaccctaagtttataaagttttacatgtcttctgtgattaaaaaagaaaaaaacaaaaaagtaaaacattacaaaataatgaaaagtattttcagtattacataaaataagatttatatatgaatttatttattcttatataaaataagaatcatcacatgccaacaaacaccagaaatcaacagcttttaccatagtttttcctgatcctcggggtccgataataaggacagagttactctctccatggagagcagttcttttcagcagctcacttaagtgtctaaaatgatataaataggacaaaattttaaaaatgaagctggaatactttgttatgttgtagtttttaaaaggcatatttgaatatgcacagaaatttcctctcttctctccctctgggtacttggcctagcttctgaatggtcctaaatagaaaaatacaaaagaaatagtagggcagtattgattctctgaaatcttcaggtgaaaacgtagtcagattggaatatattgatttatacgatagtaggggacaagggacaatagtggcaactctcgggacccttggattcaaatctcttttcctactaatactctggacttttactccatagctggctgctgggtattaagggcaagatggctagaattctctccacagtatcagataacagaaacaaaacaaaattgaaagttaaagtgctattgcattatggaaatatttgtatctgctcctgcttcatgctatgtggtgtttctattcacaaagcaaaattttttatttctataaaagtgtttgttagctttatttaatatcaaatttgtacaataatttttgcaaaacctggaaggcatctgtaagtaggtccataacagtcaagaggacagctagacttacttgtattgtacttgcactccaaataggttactatgtggactctgacgacaaaatctttcacgtaaaattctttgtacctgatgaaaataaagtgaataaatataaataaaaatattacacatgatataaaaaataaataagaaagcacatttacaatagtcagaattaggtattaatgaatcaattcaaccctccctaaattcttatcctctagagttctggcaccattttcatatgttaaaaaattaatggatttcttacctatctcaagtcccataggaagaatgagaatttagttgtgaaggtttcaacaagagggagaatcactgactttagctatattagcaacttaagggccattgtaatgcatgtgaacgagttaagaaaagaattcttgtaagcagctatattttgaggtcatcttagaactaaggccttagacttagtcatgaaaaattatgtcagataatctaccatactctttaaaaagatggaccattaaagtcgttccttttttggatctgcagctaatacagaggtctttcaaggacaacaacctgagggtgctatctcagatttggccccatgaactggaataaaaaggctccaagaatatttgcttctcctagactgacagcatggaactaatccttcatgtaccaaagaagtaaatctgagttcttgttccatgtacagaggcaaagcaaagaaaatgattcattagggacaaaacaatacatacttgttcattatcgaggaagttaaagagtaaggacattggctccagaagagtctattatatgaattttaaaaggttaagtctgttctaaattttaatttctgtatctataaaatagggacaataacatcttatggcaggcctgtttgaaagattaaaaaagggggctggccgctgtggctcacgtctgtaatcccaacactttgggaggtcgagatgggcagatcgcttgaggttaggagttcaagaccagcctggccaacatggttgaaatcccttctctaataaaaattcaaaaattagccagacgtggtggtggatgcctgtaataccagctacttgggaggctgaggcaggagaattgcttgaacccaggaggcagaggttgcagtgagccaagactgcaccactgcactccagctggggcaacagagcaagacttggtctcaaaaaaaaaaaaaggtttaaaaaaggcaattatttgtaacacaaataggctttgtacaggtaatagctaatatctgtaaaaatacataaaagaacatatatatgcctcaactaatcataatgtgtattcctctacctagatgagatcaaaagaaaaaactcaatcttttccttaaaaaaaaaaaaaaaaaaacccagaaaacctcattaaaatatcttagaggcagtaacggggtataaaatataagctagataaagctacagtgactagtcagaaggttcacaaatctcaaagtgatctggcatagaagttaaataggtatacacatgtattgatattaagtcagctgtacatggaggattcgtgcactttacatacaaaggtatgtaaagcatatttcagttaaaaatttttttagaaagagagttaaactacttccttcaaaaagaaagccaagtcgtataaaagaataccagtaacacttaatttttatttaaaaactacatggagttcaggtcaagctagataaatacaaatgccagggtagaaataccatgctcatttccctactaatctataagcttcttaaggaagagacatacagatagatgctcagcacttggaatacaatatacacttcttataacattcattataaaaacactcaacagatgaggaaacgtaacggaacttcctcaacttaataaagggcatctacaaaaaaatcctacagttaacatcatatataacagtgacagactgaatgctgctgtttctctaagatgaaaacatagacaagaatgtccattcttcccaatcctattcaacattttaaagaaagttcaagccagggcaattaggcaagaaaagggaaaaaaaaaaaaaggcatctagattggaaagaaaaaagtaaaagctagaattctgactacccagacttaataaggataaaattaaattacagtataaaacactaatattaaaaaaaatatatgaactgacaaaaagggcagagaacaatcataacaacaaaatctgttggtccacatttaattttgacagagtttggaaaattttgcttccagatgattgttcttacgaccttgtgctggcatctcgttaaggtctcgtactgatatctccctaaggttagaaagagtgattcttcctaaatgctaaagggaaaattcaggttaagaagataactatttctctgaacagctttacagggtaaaatatcttgagattaatgaaaatacatactaacctgtgaaaggcactctgtgtgaattaagctgttactctttgatttacgactgctcatttcaacaaattcaaatcctttaaaaaaattggcataaatattataaacgtagtgacttaaagagattacttaagaatttactgttctagaattaaaataaatacaagtttttaaaagtaaaaaatgctcaaaccctaagaccttcaaaatcttcgatggcttcattttgtctaagtacaggctgattcaacactctcataccacactttaggcacactttgttttactgtgctttgcagatggtgcattttttttttaaagtaaactgaaggtttgtagcaactctgtgtccaacaagtcgataggcaccatttttcaaacaccatgtccccattttgtgtctgtcagcattttttagcaataaggtattttcaaattaaggtatgtacattttttagacatgctactactgcacacttagtagactagtatactgtaaatataaattttatatgcactgagaaaagttttgggtgattcactttattgtgatatttgcttcactgcaatggtctggaactgaacctacaatacctccaggcctgtatgtggttcttacagctactcctccctttcgattaaatcttctattcaccttccctttcttcctttttctttttttaacttacatgcttcctttatgattctcccacccatccatcccacaggatcatcccttatagaaaaccttccctttcttgctccactcaccaacaatacacaaataatcattacagactaggttaaatgcctcttccttaaacactcataagtgcctgtattttgctttattattgaattattttaaacaaaattgtctgtttaattgctactgtttccaaattgagattttttatattctaagcattgtagcataatgcccaaaacaaagttggcaatgaataactggaatgaaaaaaaaattaatgaaaaaattatattttttgtaaaattctcctcaagtgtaccatactcatagacaaatgactaaaagacctttgactaaaagacctaattttcttagcactgatttcctataggaataaattttaacagatagacagtaacagcttaagcagtgtttaggtatcaggaattgttacaaatgctttgcatttatcaactcatttaatcctcaaaactatcatgtggaataactactattataatcctcttttaaggttagaagacacagataggctaggtatgttgaccaaaatcaaacagtatataaatggaagagccaggatttggatccaaccaagttaaccacttttttaaaaaagtgtattctggtctcatctaatctccagaaggaacacagctttgctaacaccctgaatttagctcagtgaaagacattttggaacttttttactgccagaactcataaaactcaaaaaaagctgacttatcatcaaatcaccaatgattaacattataataatgcgagaatgacagcagcaagatgaaataggaggcccttcagcttgtgtccccaaatagcaacaataatttcacagccacccacggacaaaatggtctttgtgttagcgttgagattcaggcaggcgtctgtgaaaccccagtggggcccaagacctggaaaagtcaattggagggcagatcttcattcacgtgacagattccccaactgtggtccaggcttcagacttggaaagggccctgtcctcccgataggaccttgttaccaggggctgtagcaggatatgaaccctatctggtcccttggcggactggactttttctaggacctcggtctgtacagtggatgaagatatgcagagaaaagacctgttaccaggtgtgtggatggtttggctttctctgggaacctgggagggctcctactggatcactgagtagattccttaacaggcagtactgccctagtccacagctgagtggggctggaactaagctacagggttgcttcagggcctacagtcaagacttaggtcttcaggcctaaggtgtcacaaacctgcatgtctcccttcaggtccttaagttagcgggcctgctgtattgagaggggctggagccacttttcaggggtgtttcagggactgatgagggacctaggtcaggtggcctgtttgcagggctatggacagccccatctccctccaggatgctgggtaggcagaactgctctctgaccacagctgagaggggcttatgccaagattcagggttgtttcaggacctgctgtgggactgaaatctgcctgcctgtcctgaggacacagaaggatgtatctcctgactacaggaggatttctgtgcaggatttctgtaagactgtggctgagtggagctgaatccccgattcagagctttttcagcatatgctatgggacagagattggcaagtctgtactgatggcacagacaggtgagtctcctagcagttccttgtgcaggcagggttgctctcaggctgcaaccaacagtggcaggagctgagcttcagggctgtttcagtatttaatgcaggaccaagttcagaaagcttgacccagggattcagacagttttgtcttcttgtgggtccttgaactgatctcagaccatagccaagttaaagtgtcttatcagggtccgcagttgggactgaggacagtggacttattttctgaggtaccagtgtgcatgaattttcccaggcctcttggtgaacagtttcggtagcaggccaatatccttgatgaatataggtgcaaaaatcctcaacaaatactggcaaatctaattcaacagtacattagatcaattaccatgatcaagtgggatttatctttggaatgcaaagacggttcaacatatgtaaatctataaatgtgatataatgcattaacagaatgaaggacaaaaatcacatgactgactcaacagatacagaaaaagcttctaacagaattcaatattccttcaggtttaaaaactgtcaatatattaggtataaaaggaatatacttcaacacaataaaggccatatataacaaactcacagctaacatcacaccccaaaggtaaaaagttggaagctttccctctaagatcaagaacatgacaagaatgcccactttggccatttatattcaatatagtactgcaagtcctagccagaggaattaggtaagaaaaaataaataaaaggcatccaaatcaaaaaagagaaagttaaatggtctgtttgcagataacataattttatatagagaaaatccttaagactctaccaaaaaactgttagtactaatacatacagtaaagtggcaggatacaaaatcaacataaaaaaatcaataagatttctccacactaataactatttgataaaattaaaaaccagtcctaattacaatagcatcaaaaacaaattagaaagaaatgtaacaaaagaggtgaaaggtctgtcactgaaaactatacaatattgatgaaagaaagtgaagacacaaataaatggaaatatactccatgttcatggactgaaagaatcaatgttattaaaatgtccctactactggaagtgaaggttcaaagtaatccatatcaaaattctaatgacatttttcatagaaatagaaaaaaatcctaaaattcatatggacccacagagacatttaatagctaagacaatcatgagctaaagaacaatgctggaggtatcagactacctgatttcaatacctagtgcaaaactaagataattcaaaacaacatggttctggcataaaaacaaacatacagaccccagaatacagagtcgagaaataaatccatacttttacagttgacttatgttcaacaaaagtgccaagaacacacaacggagtaaggacagtctcttcaagaaatggtgttaggaaaactggatatccacaggcagaagaatgaaattgaacccttattgcacaccatatacaaagatcaactaaaaatggattaaagacaaacataagacctgaaacataggggaagaaaacacagggggaaagctttttgacactggactcggcaaagatttttttgggatatgactccaaaagcagaagcaagaataatgaaaacagacataaaactaaaaagcttcaatcaacagagtgaagagacaaccttcagaataagtgaaactatttgcaaatcttacatctgctaacaggttaaaatccaaaatatgtagtcgctcctcatcagcagattcaaccaacttaagagagagaaaatttagaggggaaaaaaaatgcaacaataaaaattaatataaattttaaaaacaatacattataatagctatttacaaagcacttacattgtattagaaattataagtaatctagtgatgatttaaagaatatgggatatgtgtaggttatacgctaataccatgccaatttatagaaaggacttgagcatctacagattttggtatctcaggggagtcctggaaccagtttcccgtggatacagagggatgactgtataaggaactaaaaaaaacaaaaacaaaaacaacaacaaaaaaaacttaatagcaaggaaacaacccaatttaaaaaatggtcaaaaagatttctcacaggacataaaaatgtcaaataggtatttgagaaaattctcagtgttactaattgtcagggattttcagggaagtacaaacaaaaccacaatgagataacatttcacacctgctaggaaggctattgtcaaaaaaaggcaaaagatgatgagtgttgttgaggattatgaagaaaggaaactcttgtacactgttggtaaaaatgtaaattagtataatcattatggaaaacagtatggaggttcttgaaaaaattagaagtcaaattacatgaccggtaatcccactcctgaatatccatcaatatatacaaaggaaatgaaatcaatatgtcaaagatatatcctcactcccatatacactccagcattattcacagccaaaatacggaatcaacctaagtgtccatcaatggatgaaaagataaagaagatgtggtatatatacacaatagaacactaactcagccttaaacaaaaaagaaatcctgtcatttgcagcaacatagatgcatttgggagatattctgttagctgaaataagccaggcacagaaagacaaacaccacataatctaatttatacagtagtctctccttatccatgggagatgaattccaaggcgcccctcgcatgtctgaaatcatggatagtacccaactctctctatatactatgttcttttaatctgataacctagatggctactgagtgattatgggacacatgcaatacacagcatggatacgctggacgaagaaattatgtatgtcccaggcaagacagagcaggacactgcaagatttcatcacattactcagagtggcatgcaatttaaaactcatgaattatttatttctggagttttccatttaatattttggaacttcagctgaccaaaagtaactgaaacaatggaaagtgaaactgaggataagggagggactacaataggtggaacctctaacaggggaactcatagaatgaaagcagattttaaattttcttactacaaaaaaatggtatgtgaggtaacagatatattaataggcttaattttgtcattccacaatgtatacctatattaaaacattatgctgtataccataaatggataagatttttattcatcaattagaaaaaaaacatataaaatatacatcaaaaagcaagtaagtgcagagccaggatttgaatgatttgaacccaaataagttgtactcttatgaaattgttacgtatttagcaaacttttttgaaaaaagaagtacaaacacatttcaataacctgaaggaagatcagccaatatattttacattcacatttattaatttcatatagtgacaattagaaagcaaaccatggtaatgctgttttcttctctagaaatgttaacaggtccttagctgagccaggccttgacagacagacagcaagcaaatctgtgtcctccttaatgtgtaagccaggtagctaaggcctcagccaccaaaagtcctctggctccaggcttcctaattgaaaattaaataacagagtactcaattattgtcttgacccttaagcatcttctttcttagaagaaaagtggtcttctcagctgtcttaggataccttctagcagtcttttatatctaaagttttatcttattctattttttatttttcctaatcagtgttatgagagggaaaaacctttttagctaataaaatatcctcaactctggtttatgatgctcttgactatcagccaaaatctaaaatcacaaagaactatgtaataattgtctcctagattataagactaattaaaatgtaaaaaggagaaagggcttttgcagtatgttttattttgtagaactacattagctatcttacagtattgttagaattaaaagatattttttacccacttcatgaattaagaaagaattactcaaaaaagctaaataaatgtccacagttccaaggcaggtatctaatctgcccctttgcatcatatataaatcaggtaagctattaagataattcattttttcttcatgtggggccagcattcataaaagaaacaacaaacatgccactatggtatctaccttataacctacataaattttgactgtaaataaagttttagtccaaaggttattttgacatcttcccccttcatgtaatggtcaaatatctactatataataaagaatatttcaaagacaattctaatagtacagatgagacaagcttcagactgggagaaaatacctgcaaaccacatatctgacaaaagatctgtatctaaagaaccctcaacactcaataataaaaaaggaatcccattagaaaataggcaaaatacataagtagacatttcaccaaagatatgcaggtggcaaataagcatatgcaaagatgtttaatatcattatccgctaggaaaatgcaaagtaaaaccatagtaagataccaccacacactgattaaggcagctaaaataacacaaagatggtgaggatgtaaagaaaatgaatctttcatttaaccactggtgggaatgtataatggcatggctactctgaaaagtttcttgacagcagtttcttagaaaactacaaatactcttaccaagccacatagcaattgcactcttgggtacttacctgacagaaaaacttatgttcacacaaaaacctgtaacacgtatgttcatgataaatttattcgtaatagtcaaaacactggaaccgattcactcaatgagccaatggggttaatgaattagttccactgatgctttgtcactgaagtcaggaagtacccagacagtaagggactgccttttgaagttcttctgatattggacaatgcccctggctacccagaatcccatgagttcaacaccgaaggcttttgtccaagtggtccactggtccccaaacacaaactctctaattcagcctgtagatcagggggtcatagggacctttaaggttcattacacacagaactctatggaaacgaatgtcaacactatggaaaaacctccacagacagaacatgatgaaagtctgggaggattatcccattgaagatgccctgttgtcatagaaaaagccatgaaagccaacaagactgaaacaaatttctgctgaagaaatctatgtccagatgttgtgcatgacttcacaggatttactacaaagccaatcaagaaaatcatgaaagagattgtagacacggcaaaaagggtggggagtgatgtgtttcaacatatgggtcttagagaaattcaagagctaacagataccacaccagaggaattaacagaagacaaggtggagatagatgcttctgaaccactgccagacagtgagaaagatgcagaacagtgccagaaaacaaactgacattagacaatctggcagaacggttctgaatatacaagactactcttgacttcttttacgacatggacccttctatgatacaggtactggaatcaaagcaaatggttgaggaagggttgatactgtatagaaacattttaaaagaaattagaaaccaaaagagatagacagaaattacctgtttagttacacccagtgtgcctaacctgtcttgtctccccttctacctcctccacctcttctacccctaggcaacaagatcaacccctcctcttcctcctcagcctactcaacaggaagacaagtaggatgcagacctttacaatgagccacttcaacttaatgaatagtaaatatattttctatatatagtagatatattttctaaatatcttttctttaccttactttattataataatacaatatataatacatacataaaatatatattaattgactatgttaccagcaaggcttccagtcaagtaggctattaacagttaagtttttggggaggcaaaagttatatgcagattttcaactgcttttggtagggagggggtgtttcgacccctaacccttacattgttcaagagtcaactgcgtatggaggaaattctcattactgcagttccagagcactactatacatcagagagctactgaccattttaaatttacttctgtattgacaaaggacaaaaattataggaattgtaaaaatgtgtcatctaaagctgtctgctctctaaattgcctatgtgcatttccccatgacagtaagtcccctacaatctatacctttacaaaggaagggatgaattctgaaatatattcactgaccactacttactgtatctgtatttgaaattttatagttacatgctaactaaagcaggatgactaaataatctcaagactcaatcacatgtatattcatactcccatttttcaactgaggtggcttatttattgtaattctccattcctatgctttccaagggttgcttgttgataaattctaaaaattatgaagtacatcctttactgctcttgaggtttcatgagtacttataactcttctttctcatgatgccttcctcagatccaaaccctcactcagagcctctttgtctaccacactgattctgcataatgtattttagactaactctgtttggccaacaataatgataactattcagtaaactctctgttttttttgtttttttgtttttttgagacagagtctcgctctgttgcccaggctggagtgcagtggcgctatctcggctcactgcaagctccacctcccgggttcacaccattctcctccctcagcctcctgagtagctgggactacaggcgcctgccaccatgcccggctaattttttgtatttttagtagagacggggtttcaccatgttagccaggatagtctcgatttcctgacctcgtgatccgcctgcctcggcctcccaaggtgctgggattacaggcgtgagccaccgtgcccagccttagtaaactctcttaacatctaaagacagaattagaaaatagctgacactaacaacttattcctacatatagctcaatagccattcagatgtcaaatgttttcctaccttagaaatagaacataaaagccctccatttagtttgcacaactaacttaagctcctcatcttaggttagttctaatcactgttttttagactaacataatcctaaactttgtgggagaagcaacctggatgaactcctggtgacagtccttcatgtcaaatttgaagtttggtcaatttaccaaatacctctctgcttgctgactagcaatggtatacaatgacctgcccaagatgacatagcttacttaacagcagcagtagctgttaggtctattgactcccaatcagaggttggttagtctcaactggcatgaaaaaaaaccctgcaaacatcagaaagttcatcaaaatcatcactgggcttttctttaggagacaaaacatagcagaggaatacattctgaaagaacacggttattataacagatgttcaataccaacaattcacttctctttgaatgtctatgtgtacaatttgtatttttttctgtacacatctttatttttaagatcataaactttcttcccatcgctaaaaaggaatacatgtttcgtacagaaactctggaattttaattaggaattgtgcagataaaatggtaaaaaatggaatcagagaatctttctcctctaataaaacaaaacaaaaaactgttaaacagaaatactttagcagtaactaaacaaagagacaagttaataataaacaagcctagaaaattctacaggagttctccatagttcctaactttaacctcactcttaaaagctatacttgcatcaataaaatctcctaaactctcatcaatgtatcaaatatgaaaagaagaaaactgataaaaactgtaattcaattattaaatttcaagcctaaaaaaaagaattcactgggactcagcctgaaaaacacctacaagggagaaaaaaatgctaaaatatggtgtcataatatctacaaagttctgagagagagaccaagactcatacctagcaaagatgtcactcacatataaaggtaacaggtatagccttatcaaataagaatgaacttatttagtacacagagccaataaagccttgtgtggagtgtgtgtgttgcaggaggatatggggaactcaatgacaaaatccagccaactaaagcataattaaaaacacaattttatacagacacacacacacatacacacacacacacacacacacactagtgacctttgaatccactaaaataaaaaactaaaaccaaaaaaaggtaaataattatagtagcaggtggaaacataagtcgttacacagtgaaaataatcattcaacaaaaaaatgaaaaaaaagtggcatgaatgcatacggttgctaatttcattcttcagagtagaaagaaaatgtctaaacttaaaacatgaagtgtaaaaaaggaacttaaaactattttttttttagacccagggtctcactgtattgcacaagctggatttgaattcctgggctcaagagatccttccgtctcagcctcctaagtagctgggtcaacaccttgagcagcttgaaactttttttaacctaagattgagatctttaaaaaaaaaaaaatctcttgggtttaataaatatctaaagtccagcaattcctataatttttattaggttaaaaatgtggcctgcctacacacacacatactttttcaaccaaaatgggctctatttcataatatttgtcatttaaaagaacaagaactttccatatatagatatatatatgtgtgtgtgtgtgtgtatatatatacacacacacacacacacacaaaaagtaacatattttaaattattttttctacagctaccataaggtaaaaaacaaaaataagaattagtggatcaaattgtttaagaaaaagaaccatgtacctcagctggataatcaaaagtactctagtattatgagcatcttactagtaattacgacgccaggagctgtaacactgtgtacccaaaaaaaagcatttaaggagaaaacaggtgtgaacatgtccgatttatttagtttcaaagttgtccaagcacaggtcaaagaggtaacaacaaacaatttttcctatctttcatataaatggtcagtaaggtggctggtgcaaaataaccctctggaataagaaagtattgtaggctgggcacagtggctcccacctgtaatcccagcactttgggaggccgaggcgggcagatcatgaggtgaggagatcgagaccatcctggctaacatgatgaaaccccatctctactaaaaatacaaaaaattagccaggtgtggtggccggcgcctatagtcccagctacttgggaggcttaggcaggagaatggtgtgaacccgggaggcggagcttgcagtgagccaagatagagccactgcactccagcctgggcaacagagcgagactctgtctcaaaaaaaaaaaaaaaagaaagtattgtaatatgtttacctataaatatctatccaaaaaataagagctaaattaaacttaactaatatttaatatatacattgacaaattttacttggtctctgtatcagcaggtcaagtcatgttactcaacccagacgccctaaggaaagggaagagttcaagatcaataacaagaaggggttccgagtggcaccatcacatattcatttactgtcagctcattaatacacaatgtaggtatatgaatccagtttggagacattactgaatccagctgacttactgaatttttttttttttttgagacagaatctcgctctgtcgccctggtgggagtgcaaggttgcaatcttggctcactgcaacctccgcctcctgggttcaagctattctcctgcctcaggagataggagctgggattacaggcatgtgccaccatgcctggctaatttttgcatttttagtagagatgggggtttcaccatgttggccaggctggtctcgaactcctgacctcaagtgatccacccaccttggcctcagttgggattacaggcctgaatcaccacgcccagcctcacttgctgaatttaaagatgttattatttttaaaatgtaagtgaaataatctcagctgttccaactgcagctttttcctggaatgaaaaatggctgcctgtcaacagcatgctgcttagtaaataaaaaacaaaaagcaaaaaaaaaaaaaagatttacttcatctggaattttaaaataaaagtaggaaagaaactgctttttagaagaaatttgtgttatagggcattttgaaaatgtttccaacactgattttatagccaaaaattaggtgttacctataaaaattctcatatctatacacttaaaacatttataaacataactttttattctattcacaaatatttctgtaaataatgtaagttttatatgtgttgacctaaaaggaaagaagttgaggcaaaattaataacatacatagagagttcatttgagccaagcttgagggttgcaaccaaggagcataaattcaagttgccctgaatatgctcattagcagcagtaacaagtagatttttaaagagaaaaagaaaaataaaaaggcacgctctgagttgttcaccaagaatctacattaaaataacaaactatccattggctacagagtggcagggggtagggagttggggtggagtatgggggcataactgaagtcccatactactcacatctctctgggcctgcatacctcagagctcagactgttctgagcattttttgttttctcatacccatttgttaaaaatataaaaacataccacttttcggctgggcgcagtggctcacacctgttataccagcactttgggagactgaggtgggcagatcacttgaggtcaggagtttgagacgagcctggccaacatggtgaaactccatctctactaaaaatacaaaaattagccaggtgtggtggcacgtgcctgtaatcccagctactcaggagacttgaggcaggagaactgcttgaacccaggaggcggaggttgcagtgagccaagatcgccaacactgcactcccaccagggcaatagggcgagactcatctcaaaaacaacaacaataggaacaacaacaacaagaaacaaaaaccatgcaccactttccaagaacactaatttatatcaagtttttcttagtttggaataagaactaacacatcaagagaagatgaaattggctaacaactcctacaaaaaccttggtaaaattagtggatgagactagaaaatataattcaaaaatacacaaatgatcatgtattattttctctaatacccttactttgaggcaaaaccttacagctccagcagatgggggcattactttgtgaaaagaactcttagtaaattaaaaagatgtttaatactgctttctttccagatggtggcagaagaaaacaccgaaaacaataccactaccccactccctttattagaaaaaagttaaaatacaaattctattactgtttacctaggacctaacttcacacggctgacatttctcaaagataggtaagtatggacaaaatttcagaactttgcctctcttcagttcgataaaatgttcttgatttgctagctaaacagtcaaataacgtaaaatgaaaggtattttaggagaaatttgaaggtggtttccatgttttgttactgtcctttgagatgaaactgaggcaagaaaaatacatttaagctgtttttcagtccatcagaattagttttcattcttttttctcccccagttggattgtttgtacagaggtaaagattaaaatagagttaaaagaatggttgagtgtggggagaaataagggccaatactgatatatattccaagttagaaaataagtaaactctgttagttcttcctaaagagatcagctcaaaaatgctatctatatcaagttggggcacagcctctggtgagatgtttccttgagttctccagagctgaagaataattccacacaaatcaacttttggaccacaggtgaataaaccatggtaattactgacagttttgtaaaatctttttttcctcctcatttgttgccagtgaatattaaaaggacacaatttacttaaggacacattcagattaaatgattccaaggtttgataacctttagttaagtaatatgatgccatgatattttctcattgatattaaaatgaagaaaaatattttataatgtcttggtacttaaactgattaaataattgaaaaggcttgcaattctccagaaaagccatgttctctctaacctctgaatttcagtaatcttcactagtacatggcagtatgtctggaatcatatatacacagacacacacaaccacacatacatatatatacacacatatgaatataaacgtatatacatatatatcttttttttttttttttgagctggactttcactctgtcgcctggctggagtgcagtggcaccatctcagctcactgcaacctccacctccagggttcaagcgattctcctgcctcagcctcctgagtagctgggattacaggcatgcgccaccacgctcggctaatttttgtatttttagtagagatggggtttcaccatattggccaggctggtctcgaactcctgacctggtgatccgcccacctcagcctcccaaagtgctgctgggattacaggcgtgagccactgcaccccatacatatatatcttttaataagtgtacttactttataaagtacctattagagccttgatattcatgaataagccaataaagttgttttcaagaacatgggaggtaaatagttatgaaataaacaacccccagaaggataatcagagagttaatactatgatatgttcagtaaagaaagacatttagaaattactacagttggccgggcatggtggctcacacctgtaatcccagcactttgggaggctgaggcgggtggatcacctgagttcaggagtttgagaccagactagacaacatggtgaaaccccgtctctactaaaaatacaaaattagccaggtgtcgtggtgcgtacctgtaatcccagatactcgggaagctgagacaggagaatcgcttgaaccggggaggcggaggctgcagtaagcggagattgcaccactgcactccaaccagggcaagacagagcaagactccgtctcacaaaatgaaaaaaagacattactacagttgttttgattattaaccatggaatacaccttgtaaatgatacaaagtatcaattctgcagtagtgttgatgaatgaataaaaaagaaatactagttggaggacttctttaaagtatacgtcttaaaatgcatttacttctgaattatataggctaacaaaagaactaacacaaatttgcaacgtatttagaaatcctttagaagctttggaaatgcattatatgatcttactggcactgacataactacatcttaaatattatagtgatcaacagtagtctatgttctctgagcacatggaagtaggctaccttcaggatttaagcttgtgaatccaagctaatgtgtttaattggatggataaatagtataagggcgacagacacttgaatcaacgaaaacttttttttgtttttggtttaagagatggggcttccctctgtcaactagggcagtggcacgataatagctcactgaagtcatgaactcctggcctcaagcaatcctcctgactcagcctcctaaatagctgggattacaagtgtgaggtactgcccctgacaaaaatatcatttttgtgaaggatggttgcattatatgggacacaagatttaagactagggcactaaaattggtgggtgagaaggcacatgtagacaaattttccttgaaaagccccaaactacacataaattacagaactgtactttcttgcaatatcaattacttcagggtatatgttcatttgagaagaataatgaatagaatactgtccactattcaaataaatttttcctttgccacgtttacagacttgagtttacttaaatgtaagtatgatactgctagggctaaggaaatgatactccaaaataaagtcctccaaagcagctctctctgaccatctcctaacttcctgtctctggcctctcattctcctgaggctagccactgaaactaccatccctcgtccccaaggtagtccacagaaaccagaactccctttccccaaagccagccacagaacctaaatatattactctaatgttccctgccctcatctttctgtgtaaaaactaactataaagacatatctgacctattctgtttgattgtaggtcataggatccccattccagaaagggtgctgttccatacccggaaggaaagaatgctgcacagagaggccaagaagaatctatacagacaggcaggccttgctgggtttccccactcagtatatggctgtccagactttgctgaacctaagcataccaatgggcagttttctcctatatctttaggtctttattctgaaggctcccatgtcacgtaacaccaagatcaaataaaatcatatgccctttctcctattaatctgccttttttcagctgattttcaaagaaccttcagaggctgaaagggaagttttttcttggcccctacaatatgctacaactccagtaagttaattagtaaatattaaactatttttggaaggaaaaaaaactgaaaataacattgctttagagataaattatttaagaattgctagaaattaccctagaaattatcctagaaaaatcttaaaattttccctaaaaacttttaggaataatacattgtttctaatgagacccttcagcttatgcaaaaagcacaggagactaaattctagagtcaacgaaacgatattctccaattctgttttgctaatgaatatgttgtccatccccccatcagcatgcttaggtaatcttgcaaggataaatggaaatgtcagttgacatttacaatgaaataggatttttagacagttgtgctttttgggtgggaaaaggagagctaaaaattagggggttgggggcttaaaaaagacagcattatatggcttagaactttggtaccctaccttcatccttttctgcaatcccttttactccccaaagttaaaaggctatcaatgggacaataattgatgatcaactatgaagaaataggctcaaatacactgttttattatatttttatcattctttatataccttttctcatcattctttgtcccaatagtatgctatgattatgcacgtagaaaatcccaaaataacaacaaaatcactggaactaataaactactgtagaaaggttgcaggatacaaggttaatatacaaattgtcaacttccttcctatgtatcagtaatgaacaactgaaattagaaattaaaataataccatatacattagcaacaacaacaaaaaacattcaccaaaaatgtagatataaatctaacaaaatatgtacaagatctctatgaggatcactataaaactctgattcaagaaatcaaagaaagtctaaataaatgagatcattcaagagtagaaaaaaattcgtattgttaaatgtcagttcttccaaccttgatctataaattcaatgcaatcccaatcaaaattctggatagttattttgtggatatgacaaactgattttaaagtatacacagaaagacccaggagaaccaacacgataccgaaggagaacaaagttggaggacaaaacctacccaacttcaagacattataaaactatactaatcaatacagtgtgataatggtgaaagaacagacaaatcaagggaacaaaacagagcccagaaataggcccacataaacatagtcagctggtcttttacgaataagcaaaggcaattcaatggagaaaagaacaatctttgcaacaaatggtaatggaaaaactagacatacacatgccaaaacatgaattgacacagaccttacaagtttcacacacaaaaaatctaaaaatggatcacagacctaaatataaaatgcaaaactataaaactccaaaaatggccgagcacagtggctcacgcctctaatcccagcactctgggacaccaaggcaggtggatcacctgaggtcaggagttcgaaaccagcccgaccaacatggtgaaaccctgtctctactaaaaatacaaaaattagctgggcattgtggcaggctcctgtaatcccagctacttggtgacaggtgaagccagctggacttcctgggtcgagtggggacttggacaacttttctgtctagctagaggactgtaaatgcaccaatcagcactcaataaaaaaacgcaccactcagcgctctgtggattaaaggattgtaaatgcaccaatcagcactctataaaaacgcaccaatcagcgctctgtgtctaaaggactgtaaatgcaccaatcagcactctgtaaaaatgcaccactcagcattctgtgtctagctaaaggattgtaaatgcaccaatcagcactctataaaaacgcaccaatcagcactctgtgtctaaagtattgtaaatgcaccaatcagcactctggtctagctaaaggattgtaaatgcaccaatcagcactgtgtaaaaacgcaccactcagcgctctgtaaaatggaccaatcagcaggatgtgtgtggggccaaataagggaataaaagttggcatggaccaatcagcaggatgtgcgtggggccaaataagggaataaaagctggccacccgagtcagcagtggcaacctgctggggtccccttccacgctgtggaagctttgttctttcgctcttcacaatagatcttgctgctgctcactctttgggtccgcactgcctttatgagctgtaacactcaccaggagggtctgcggcttcattcctcaagtgagcaagacacaaacccactgggaggaacaaacaactccagacgcgccacctttaagagctgtaacactcactgcgaaggtccgctgcttcactcccgaagttagcgagaccacgaacccaatggaaggaagaaactccggacacatctgaacatctgaacaaacaaactccagacacaccatctttaagagctttaacattcactgcgagggtctgcggcttcattcttgaagtcagcgagacgaagaacccaatggaaggaataaattccagacacatcgggaagctgaagcaggagaatcgcttgaacccaggaggcagaggttgcagtgagccgagatcacgccattgcactccagcctgggcgacagagcaagactccatctcaaaaaaaaaaaaaacaaaaaacaggccaggtgcggtggcttacgcctgtaatcccagtgctttgggaggcagaggctggtggaccatgaggtcaagagatccgagaccatcctggccaatgtggtgaaaccccgtctctactaaaaattcaaaaattagctgggcatggtggtgtgtgcctgtagttccagctacttgggaggctgaggcaggagaaccacttgaacccgggaggtggaagttgtagtgagccaagattgtgccactgcactcaagcctggtgacagagtgagactccatctcaaaaaacaaacaaacaaacaaacaaaattccaaaaatgtaacacaaaagaaaatctaggtgaccttggttatggccatgtgtttttagatacaacaccgaaagtacaatccatgaaagaaaataaaaaattgatttagacttcattaaaattaaaaacttctgctctaccaaatggcactactaagaaaattaaaacacaaaatacacatggggataaaatatgtgaaaaacacttattttgttacacaaaatatacaaagaactcaacaaggaaataacccagtttaaaattggcatccaaataaacatctcaccaaataagatacagaggtggcaaataagcatatgaaaagatgctcaacatcatatgtcaatagggaattacataatcaaacaatgagataccattgcacacctattacaatggctaaatccaaaacaatgacaataccaaatactagtgagaaggtagagcaatgggaactctcattcatggctcatggaaaagcaaaatggcacagacactttggaaaacagtttggcagcttcttataaaactaaacatatttgttttacataatctagcaatcatgtaccctggttacacccaaatgagttgaagacaggtccacacaaagacctgtaccttcctgtttacagcagttttatttataattgccaaaacttggaagtaagcaagagtgtccttcaatatgtgaatggataaaccaactgtggtacatccatacaatggaatcttactcagcatgtaaaagaaataaagccatgaaaagacatgaaggaaacttagatgtatactgctaagtgaaagaagccaatctgaagagactacctactgtatgtttccaactatatgatattctggaataggcaaaactacagaaatagatgttttagtgatcttttcactaaaagatcagtggttgtcaagaaaagagaagtatggaacatgagatttttagggcaattaaattattctgaatgatactgtaataatggatcattatatatttatcaaaatccatagaatgtacaaaacaaagaatgaatttattcatatgtttgtcgtttttaaagaaataagacatttcaagaacatttatataccaaagtaagaaaattttttatatcttatctttctttgtcaacaccaatcatcacactattcaagagcataattcctaatggttgagaagagactcttgcaatataaagcaaacaaacatattgttattttgtaagtatttaatataatgaaaacatgttatctatgattatttcttctcaaagtacatgacaaagctctatgatctcatgctgccattaaatgtataaaaacatagcttaaaaagactaatattacacatattagcatcttggaattatttctgggtgcaaaggttataggtaattttcattttttaatcacttttatactgaatgtatattatgtttgtaactttaaaaattttcttgcacatttaaatcaaatcttgtactttacaatttgaatatataaatttctaagtgtaaattatgatgctaaaattctattttaacttttaaacatgttacaaacataaaatgtgttttaacataaaattttaaaaacatgatgctcaccagatattgcagcagtgttggtataacatgctggacataattaaaaaaacaccaaagtctaatggatattagctgaaacccagctttttagggaaaatagttttggtatttactcattataaagtaagttgactgagacataaacaaaccatacaagtggtcatattaagagtgcatttaagactgacatgtctgggttatctgtattagatatttttgtaaacaatacaaaaaagaaacaaaggagaaagtgaaaatgtgcaagtgaaaagccaacagatcagaacttaattcttgaaaaagtctgacctcactttggtcatgctataatttggatttggtttctttatcaccaccaaagctaatgtggaaatttgaaccccagcgtggcaatattgaaaggtgaggcctagagggaggtgtctgggttctacgggtagatgcctcataaatggctcagtgctattctggagttagtgtgttctggctctcatgagactggattagttctctggcgaatggcttagttccttcccacaagagtgggttgttataaggccactatgcactcctcagattttcctctctttgaatgtttctttttctcctttgaccttgtccaccgtgttgtgaagtatgaaagatcttgccagaagccaggtctatgctcttgaacttctcagtctgcagaactgtgagctataaaacctcatatctttataaattacccagtcttaggtattcttttatagcaatacaaaacagactaaggcaggtcaaaatttcacactattctcaattcccctattaatcaaaaaagtagtataggactaagaatttgttatgttttattggaggtgaggagagatatgggagaatataagataaaggttaaaaagagattaggaaaaggtagcaaccccaaagcatgtttaagatcagtgctttgagcaagatcaggaatgaaaagagagaataaaacagaaatgaaaggatgggaacagctgtcaattccaggtttcatctaccttttggtttataatcttcaactcatgtcttatttttctacttatgcatttagtaaaatatacaaagccatccagtctcgtcagctaatactctaaataatataaacatacaacaagttcactaaataactggtcttttaatttgggctagaattcaatgagaaaaccatttctaaaagacttgcagtgctaacatggctcaaattaaacagaagcctctaacccacttcatcagaggccatgaggcttattttctacacagggtaagacagaagaaatctaccctgaggacacaagacacagcagaaggtgagggtatcagacaaaaaggttttgagggggaggagaggattaagagagtgtttatatattgaacgttgaggccccctagctctcttctttcacatagttctcatactactggcaatcagacttataccctaaagcagggtttctcaggataacattttaaacttgattgttcttcgttgttggagctgtcctatgcactgtaggatgtaacaagacccccagattctatgcatcagttttcaggagcaacctatctgtggcaatcaaataagtctctagacactgctaaatttctcttagggggccaaattgtcccacttgagaatcactgacctaaaggcagaagcttggagaactcttcttattagactcttattaaccctagaaaaaaggtttccaaacttaaagataatgacaccaggggtttccacccacaaaatgcccagccatattcacagagctctaaaatagctttctaatgaatctaacataaatttgaacatgcaatcaatgattgctacatagctgaggaaagcctcgattaaaaagatgaaaacatattaacagaaagaataatttggaaaaagtagagaaagcaggaagcaataaatttcaaaaccaaacaataattttaattcataaaaagaaaacataacaggatataataagaaaattatacagagatcaaaaaaggccttggaaattaaaagtatgatagcagaaatcaaagtctcaaaagtttgaaaaaggtaaattttccagaaagtatgaagaaaaaaaaaacataaaaaatgacagaaaaaaaataggtccaggaggtagaatgtttaattagagttccagaaccaaaaacaaaggcaagaaaattaaagaaaaaacatgaggaattttcccagagttgatggacacaaattgtcagactgaaaggacccataaaatgcatggcaaaatgaaagactatagactcataataagtaacatggctgtgacatttcagaactctagatacaacaaagagaaacatttgataagtttcaaaatgagatcgtataatcttccacagaggagacaaaagtgatctgaagagtgatggaagtaagaagggcttctaattttacaacagatgctatgaattccttcaaagctcttaagaacaatttcacctttataatttgaaagccagctaaactaatagttggggtaaaataaagacacttatataaatataataccacagaacacttgcctttcagaaagctactagaaaatggaataaaccaagagaatacacaagccaaaggattacataggatataggaaacagaggaactagcataggatagagactgcaccagcagcaactatatcaagcaatgggctaaaactgcagcacataagaatgctctgggagaaatttcttgatgatggataaactgataaaaatacttgatacctctgaatatatggaaaggctgttttgacaaccagcagatagtttgggtctaaatgactaataaatatttagaactatacaaatgctcaatggtcgtatatgaaaaattaaactatcaatgggaagatggggggaatggatgggatgtttgtggaaaaaggctaaatctacatcacctatagtaagtcaagagataatgcctaaaactgaaaaaacaggaggtagcaatataaaatgttatttagagatacagaagtatataccaaaagaataagccaaaaaaagttttagaagtatttccctctatttggggaaaactggggtagtgacagctaccttgtccaacatcacagccttcctgggattaagcaaataaggcgataaaggcccaatcatttcgttgcaccatggtatcaatctgaaggaaaatattctggagaacctaacctgtgacaaagaagtaagaactgtttttaatcataagctatggagaagcagttaaaaacttaagcatgtgttcttttacctttgcaacagttaaaagaaaaagagaaagagaagaaacaggctgcttaaatatattttctaatttcattaacttggcttcttatactgcagagccgaatgttattttagaaatttaaagcccatcagactaacaacggatctctctgcaggagccctataagccagaagagagtaggggccaatagtcaacattcttaaagaaaagaattttcaacacagaatttcatatccagccaaactaagcttcataagtgaaggataaataaaatcctttatagacaagcaaatgctgacagattttgtcaccaccaggcctgccttacaagagctcctgaaggaagcactaaatatgtaaaggaaaaactggtaacagccactggaaaaacataccaaattgtaaagaccattgacactatgaagaaactacatcaactaacgggcaaaataaccagctagcatcataatgatagtaccaaattcacacataacaatattaaccttaaatgtaaatgggctaactggcccaattaaaagacacagactggcaaattggataaagagtcaagacccatcggtgtgctatattcaagagacccacctcacttgcaaagacacacaaaggttcaaaataaagggatggaggaatatttaccaagcaaatggaaagcaaaaaagagcaggggttgcaatcctagtctctgataaaacagactttaaaccaacaaagataaaaaaagacaaagaaggacattacataatgacaaagttatcaatgcaaaaagaagtgctaactatcctaaatatatatgcacccaataagggagcacccagattcataaagcaagttcttagagacctacaaagagacttagacccccccacaacaatagcagtgggagactttaacaccccactgtcaatattagacagatcaacaagacagaaaattaacaaggacactcaggacttgaactcagctatggaccaagtggacctaatagacatctacagaactctccaccccaaatcaacagaatatacattcttctcagcaccacatcgcacttattctaaaattgaccacataattggaagtaaaacactcctcaacaaaggcaaaagaatgaagtcataacaaacagtctcccagaccatagtgcaatcaaattagaactcaggattaagaaactcactcaaaactgcacaactatgtggaaactgaacaacctgctcctgaatgaatactgggtaaataacaaaattaaggcagaaataaatacattctttaaaaccaatgagaacaaagacacaatgtaccagaatctctgagacacagctaaagcagtgtgtagagggaaatttatagcactaaatgcccacagaagaaagcagaaaagatctaaaaccaacacccttacatcacaattaaaaaaactagagaagcaagagcaaacaaattcaaaagccagcagaagacaagaaataactaagaccagagcagaactgaaggagatagagacacaaaaaccccctcaaaaaaataaatgaatccaggagctgcttttttgaaaactttaacaaaataggtagaccgctagccagactaataaagaaaagagagaagaatcaaatagacacaataaaaaatgataaaggggatatcaccactgatcccacagaaatacaaactaccatcagagaatactataaacacttctacacaaataaactagaaaatctagaagaaatggatgaattcctggacacagacaccatcccaagactaaaccaggaagaagtcgaatccctaaatagaccaatagcaagttctgaaattgaggcagtaattaatagcctaccaaccaaaaaaaagcccaggaccagatggattcacagacaaattctaccagaggtacaaagcggagctggtaccattccttctgaaactattccaaataaaagaaaaagagggactcctctctaactcattttatgagtccagcatcatcctgataccaaaatctggcagagacacaacaaaaaaagaaaattccaggccaatatccctgatgaacatcaatgcaaaaatcctcaataaaatgctggcaaactgaatccagcagcacatcaaaaagtttatccaccatgatcaagttggcttcatccctgggatgcaaggctggttcaacatatgcaaatcaataaatgtaatccatcacataaacagaaccaatgagaaaaaccacgattatctcaatagatgtagaaaacgccttcgacaaaattcaacaccccttcatgctaaaaactctcaataaactaagaatcgatagaacgtatctcaaaataataagagctatttatgacaaacccacggccaatatcacactgaatgggcaaaaacaggaagcattccctttgaaaaccggcacaagaaaaggatgccctctctcaccactcctattcaacatagtattggaagttctggccagggcaatcaggcaagagaaagaaataaaaggtatttgaataggaagagaggaagtcaaattgtctgtttgcagatgacatgattgtatatttagaaaaccctgttgtctcagcccaaaatctccttgagctgataagcaatttcagcaaagtgtcaggatacaaaatcaatgtgcaaaaataacaagcattcctatataccaataatagacaaacagagagccaagtcatgagtgaactcccattcgcaattcctacaaagagaataaaatacataggaatacaacttataagggatgtgaaggaccgcttcaaggagaactacaaaccactgctcaaggaaataagagaggacacaaacaaatggaaaaacattccatgcgcatggataggaaggatcaatatcatgaaaatggccacaccgcccaaagtaatttatagattcaatgctaaacccatcaagctaccactgactttcttcacagaattagaaaaaaaactactttaaatttcatatggaaccaaaaaagagcccgcataagccaagacaatgctaagcaaagagaacaaagctggaggcatcacgctacctgacttcaaactatactataaggctacagtaaccaaagcagcatagtactggtaccaaaacagatatacagaccaatggaacagaacagagtcctcagaaataacaccatacatcaacaacaaccatctgatctttgaaaaacctgatgacaacaagcaattgggaaaggattccctccctatttaataaatggtgttgggaaaactggctagccatatggagaaaactgaaactggcccccccttccttacaccttatacaaaaatggattaaagactaaaacataagacctaaaaccataaaaactctataagaaaacctaggcaatatcattcaggacataggcatgggcaaaaatttcatgactaaaacaccaaaagcaatggcaacaaaaggatacgaacagacacttctcaagagaagacatttatgtggccaacaaacatgtgaaaaaaagcttatcattactggtcatgacagaaaaggaaatcaaaaccacaatgagataccatctcatgccagctggaatggtgatcattaaaaagtcaggaaacaacagatactggagaggatgtggaaaaacaggaacgcttttacactgttggtgggaacataaattagttaaaccattgtggaagacaatgtggcgattcctcaaggatctagaaccagaaataccatttgacccagcaatcccattactgggtatatacccaaaggattataaatcattctactataaagacacatgcatacgtatgtttattgcagcactgttcacaatagcaaagacttggaaccaatccaaatgtccttcaatgatagaccagataaagaaaatgtggcacatatacgccatggaatactatgaagccataaaaaaggatgagttcatgtcctttgcagggacacggatgaagctggaaaccattattctcagcaaactaatacaggaacagaaaaccaaacaacgcatgttcccataagtgggagctgaacaatgagaacacatggacacagggagggcaacatcacacactggggcctgctgggggatgggggggctaagggagggatagcattaggaaaaatacctaatgtagatgacaggttaatgacacgtgtatacctatgtaacaaacctacatgttctgcacatgtatcccagaacttaaattataataaaaaagaaaaatttaaaatagacattgtttttccttgcagaggaggcagaacaagattgctgaagagaatcccccaggaatcatcccgtagcaggaacaccaaactgaacaactatccatgcaaaaaaaaaaaaaaaaaaaaaaaacaaccttcataagaatcagctggcacagtggtacatgcccataatctcagcactttggaaggtcaaggcgagtggatcatttgatctcagttcaagaccagtctgggcaacctgatgaaaccctgtctttacaaaatatgaaaaaattagctgggcatggtggcatgtgcctgtagtgccagctactcgggaggctgaggtgggaggatcacttcagcccaggaggtcaattgaggctggaatgagttgagatcacgccatgcactccagcctgggtgacagagtgagaccctgcctcaaaacaaacaaataaacacactaacaaacaaacaaaaaatccaaaatcaggtgagtaatcacggcacctggttttaacataatatcaaggaaagaagcatcgaagagggtaggaaagacagtcttgcgctgactacaccaaccctcctccaaccccaggcagcacagcactgagatagaatctgtgtgcttgggagagagagcgaaagtaagtatgggactttgcgctggaactcagtgctgctctgtaacagcagaacacaacacagggcattctgctggtgcccacagaaggagcatttagcttagtcctgggccagagagaaatcctccccccaaggagagtaattggttttcatcacattctgactaaagtagtctagggcccggaataaattggagtgacaggccacaaggactgcatcctttggcaagccttggtactgcactggccttggaggtaatggacttaagataaaacccagtgcaataccacccgtggcagctaagggaatccctgaggcacccctccccaactacttcagcttggggtaaggaaaaggaagagtagacagaactttgttttgcaaccggagtattggttcagtcacagtaaaataaagcaaaagacagatttctgaagcttttgatagcaagcttttgctccgggatggcatttatagattgaccctaggcaggaagggaatggctgccatgatgggatggactcagtcttggcagaattcaccacctgctaactaaagtggcctttggccttgaataaccagtggcagtcacgcaggactggccgtggaccttgggtgagccccaatactgtgctggtctgcaatgcttcagaggcaactcagcatagttccaactgtggtggctacaggaatgcctgtatcaccccccaccaacactgggcaggccagtacagagaaagactcctgattgaaggaaagggaaggtagagagcaagagactctgcctggtaacccagggaattctcccaattatcttcccaagtccatcaggactgtgtatgtaggagtctgcaagactcacagcgttcctgtgctttggatgctccttaatgccaaaatggctgcagtgactacaggcttaggtcacaacactcaatctgctttgatttcctggaaagccccctggagagtgacaggaatgaacaaacccaaactgtgaagactagctcttcgatgcctagacatcaatgaatatccacaattatcaagaacatctaggaaaacaggacctcaccaaacagactaatcctggagcaataaagatacgtgaccttttagatgggaaattcaaaatagcggtcttgagaaagctcaatttaattcaagataaaagagataaaaaattcagaattatatcagagaaacttaacaaagagactaaaatgatgaacaagcagaaattctgaagctcgaaaattcaacaagctgaaaatgcatcagtctcaacagcagaagaataaattagtgagcttgaagacaggtttatgaaaatacagtcagaagagaaaaaataataaaacaataatgaagtatgcctacaaaatctggaaaatagcccccaaaagtcataatctaagagttactggccttaaagagggcttacagaaagagattgaggtagaaagtgttttcaaagaaataatagcagagtacttttcaaactgagagaaagatatgaatatacaggtacaagaaggtcaaagaacaccaaatagattcaacccaaataagattaccttaaggcatataataattaaagtctcaaaagtaaaggacaaagaaaggatcctaaaagcggcaaaagaaaagaagtaacttcatatgaaggagttatactacatctggcagcaaacttcagcagaaacgctacaggccagaagagagtaggatgacaaactttagcagaaaccctggcaggccagaagagagtagaatagtattaggttggtgcacaagtaaccacggtttttgtaattacttttaatggcaaaaaccacgttaacttttgcaccaatctaatacatccaccgaaattatccttgaaacagggagacatgaagactctcctagactaataaaagctgagggatttcatcaacaccagactcatctttcagaaaatgctaaagggaagttcttcaatctgaaagaaaaggacattaacaagcaacaagaaatcatctgaaggtataaaactcactggtgaaagtaagtgcacagataaatacagaatactctaaccgctcatatctttagcaggaagattaaaagacaaacctatattgttagaagagttctaaactctaccttatctagagaaccttcttcttttagaaaatcaagcaaaacaactaagccaagacatgttaagaaaagtttgaaaagaaagctgtaaggaaatacaaggggagggattgttagatatgagttctaaatttcttttcaaagaattagtgtgtcagtatgttcaattctttgccttctagttttaaacttaacttcctcgtaaagcaacctttttcgattacctactccaccctgactcattctgatcatctgctccacccaacattccaatcacctgctccaccctaactcattccaattacctgctacctgctctgccctgactcccgccaaagcattcaccctgtcattctctttaaattagccaattggaattagtttagcccgtgcggtctaaccccagccaataggggaacgacagagcagcaggggccacatacgtcagggattagaaccccttcccatcccttgtccaaatgtgcgctcaccattgttccatctgtaagggtgcacccttctatatagaagtagcttgccttgctgaatattaaaaagaaaattttgtattcgagtgctatttcttttgcagcatcgaaactttctatataacactatcaaaaaaaaactactccaaaacttaaaatataaaaatatatagagacaaaaagtcaaaaagtgaagggatggagtagaagtgtacaggtttttagttttttctgtgcgtgtattttttcttttctttgcaatcagagttgtcatcagttgcaaataattggctataaattgttatttgctaacctcatagtaaccacaaaacaaaaacctctaataggtgcacaaaaaaataaaaagcaagaaattaaaacatactaccaaaaaataattatcacaaaggaaaacaaggaaaaaaatgggggaaaagccctagaaaataaccagaacaacaataaaaaggcagtagtaagtccttacctatcaataataatactgaatgtgaatggactaaattcttcactataaaaacatagactaacaacaaaaagacggaaaaagatactgcaccaaacagaaacccaaaaagagcccaagtagctttgtatctatttttagataaaatagatttcaacataaaaactatgaagaaagaaaaaaaggttatcatataatacaaaaggttttaattcagcaagaggacataaaaattataaatacatatctatccaacacagaagcatctagatatatagagtcaagtgtattagagttaaggagacagaacccaatacagtaatgacttgggacttcaacagcccactttcaccattggacagatcatctagacagaaagaaacaatgaatttaatctgcactatagattaaatggacctaatagacatttacagaagctgtcatccaacagccgcagaatacattcttctccttagcacatggaacatttctcaaggatggatcctaaattctccaatcaaaagacacagaagagctgaagggctaaacaaaacaaggccctactacctgctacatataagaaacccacttcatttataaaaacatagatagaccaaaagatggaaagagacattgcatgcaaacagaaatccaaaaagagcaccatcatgttaggccgcaaaacaagtctgataaaaagtatattttctaaccacaatggaataaaagtagaaataaataacaagtggaactttggaaactatacaaacatataagaattaaacaatacgtgcctgaacaaccaatgaagtaattaaggaaattaaaaaatgtcttgaaacaaatgaaaatggaaacacaacctactaaaacttatgagatacagttaaagctaacactaaagggaatgtttatagcaataaatgtgcaaatcaaaaagtagaaaaccaagaaataaacaacctagtaatgcatcttaaagaactagaaaagcaagagcatgccaagccccaaattaagaagagaaataataaagaaaacaagaaaataaataataaaaaacagaaataaaattgagacaaaaaaatagaaaagatcaatgaaatgaaaagggttgtttggaaagacagacaaaatcaatgaacctttacccagactaagaaaagaaaaaaaagaagatccaaataaaatcagagacaaaaaaggagacattacaattgatatcacaaaaattcaaaggatcattggagaccatttgaacaactgcatgccaataaattgtaaaacctagaagaaacgaataaattcctaggcacatacagcctaagaagaatgaaacattaagaaaaccaaaatcgaaatagacccataataagtttcaagatagaaacaataataaaaagtcccccatcacagaaaaggccaggacttcatggcttcactgagttctaccaaacatttaaagaagaactaacatcaatcctactcaaatcattctccaaaatcaaggaggatctccaaattcattttatgaggccagatttattctttttttttttttttttttttttgagacagagtctcactctgttgcccaggtgatctgcaacctccacctactgggttcaagcgattctcctgcctcagcctccagattagctgggattacaggcataagccaccatgcccagctaatttttgtattttttgtagagatggggtttcaccatgtcggccaggctggtctcaaactcctggcttcaagagatctgcctgcctcagcctcccaaagttctgggattactggcgtgagctaccatgcctggccccagatttattctgataccaaaaccagacaacgatacaacaacaacaaaaaagaaactacaggccagtatctctgatgaaaatagatataaaaatcttcaacaaaacacagcaaaccaaattcaacagcacattaaaaagatcatcataatcaagtgggattcatcccagggatgtaaggatggttcaacatatgtaaatcaatcagtgtgatacatggtatcaacagaatgaaggacacaaagtgtattgtcatttcaatagatgccaaaaaaatcttttttgataaaattcaatatcccttcataaaaactctcagcaaactggggacagaaggatcatccctcaacatgataaagccatacacaacaaacccacagttagtatcagactgaatgggggaaaaactgaaagcctttattctaggatctagaagaaggatgggcactttcaccactattactcaagttagtaacagaagtcctagccagagtaaacagacaagagaatgaaataaagggcatttaaattggaaaggagtaagtaaaattatcattgtttgcagctcatgtgatcttatactaacctaaagactccaacaaacgactattagaactaataaattcagtaacattgcagaatacaaaatcaacacacaaaaatccatagaatttctctatgccaacagtgacaacctatctgaaaaagaaatcaagaaggtgatcccatttacaatagctacaaataatattaaatatctagaaataaacttaaccaactacaatgcaaactatcaaacattgatgaaattaattgaagaggacacaaacaaatgaaaagacatcccatgctcatgggttgaaaaaaattgtattgttaaaatgacaatacttcccacagcaatctacagattcaaagccatccctatcaagagcaatgacattcttcacagaaatagaaaaaaaaaatcctaaaattgtatggaagcacaaaagaccccaaatagccaaaacaatcctgaccaaaaagaacagagctggtaactggtagacttaccacactaccaaacctcaaaatatactacaacgctatagtaaccaaaatagcacgatagtggcataaaaacagacatgtagaacaacagaacagagagtccagaaattaatctgtgtatttaaagccaattagttttttactaaggtgccaaaaacactcattgggaaaggacagtctcttcaataaatggtgttgggaaaactggatgcccacattcagaacaacaaaagtagaccccaactcttgccatatacaaaaatcaaagaaaaatgcattaaagacttacatctatgaaactaatcaaggaaaccattaggcaaaaactccaggacattggtctaggcaaagacttcttaaataagacctcaaaaacacaagcaactaaagcaagaaaataaaataaaataacaacaaatgagatctctccaagccaaaaagcttctgcacagcaatgaaaacaataaaatgaagatataacatgtagaatgggagaaaatatttcaaactaatatctgacaaaggattaataaccagaatatataagaatctcaaacgactcaataggaaaaaaaaatctgattttaaaatgggcaaaagatctgaggagacatttctcaaaaagacatacaaatggcaaacaggcatatgaaaaaaatgttccacattattaataatcagagaaatacaaatcaaaactataatgaggtatcaactcactccagttaaaatggcttttatcgaaaaggcagtcaatatcagatgctggtgagaatgtggagaaaggggaacccttgtacactgttggtggaaatgtaaactggcacagtcacaacagagaacagtatggagcttcctaaaaacacaacaaatagaactataatccagcaatcccactactgtgtatatacccaagagaaaggaaatcagtatataaaaggtatctgtactcccatgttaactgcagcactatacacaatagccaggatatggaatcaacctaactgtcaatcaatggatggataaagaaatgtggtacatatacacaatggaatgttattcagccataaaaaaaaaatgaaatcctgtcattttcaacaatatggatgtgactgacattataagggaaataagccaggcatagaaagacaagtatcacatgttctcacccatatgtggaagcttcaaaaaaattgaagtcatagagatagtgagtaaaaagatgttagcagaggctgggaagggtagtgttgagaggagaatcaagaggagatggttaatgggtagaaaaatatagttagatagaaggaataaaatatagtgttcagtagcacaatatagtaattacagctaacaataatttagtgtatgttttagaacaattaaatgagtggaaatgaaatgtccctaacacaaagaaatgacaaatacttgaggtaatggatatcccaattacctgatttgatcattacacattgtatgcttatatcaaatatcacatactccccattttatgtatccatagtaattaaaaattaaaatttttaaatatatgagttaagttaaaaaaattttggctcaaagcataaatatattaaaatcaaatctcagaagtaaaaaagaaagacaattagggttttatttatggtagtggcagacaggaccaacctttctgctgacgccaacaaaaaaactaaataatgaatgaaataaagtaatgtgaaattacttaccaaattccatgtgaaggtaaaccagaaacaaaccatacaccaagtaacttttgttctgaggacattttcctgtctagaagaaaaggctgagaaaaaaggctgagctaatggaagatgtgccggtctatggtaaaaaaatcaaagcacaaggccaggtgtggtggctcatgcctgtaatcctatcctttgacaggccaaggcaggaggatagcttgagcccaggaattcaggatgattgtgtgcaatacagcgagacctcatttaaaataaaaataaacacaaaaaatcaaaatcaaaaataaaaataaaagcacattgcctaacaaagctggggactcagataaactacccaatttatgttcagagtttaaggacaacatcattaggataagaggaaattgaaggaaaatagaattcatgatcttaaagtcttccttaatgtcatgtgtataacagaaggaatcccaactcttgaacatgaatagtgacttgggactgaaagcactcctagagacctttcctagaaaaatgtaccttcttaaaaaagatactattattctaggactcatatattcctataattttttaaatacaactggtactcaaggcacacaagaaaaaaatatcataagctagcagacacagacttagaaaatttagaaactggaattatcttcaacaaacaacaaatgaactatgaatatagtcggcccttcatagccacagattcactcaaccaaggattaaaaatacatgtatatttttaaaaacacgactataaaaaataatagaaatttttaaaaagccatgacagtataacaatatttacatagcatctacattgtattaggtaccataagcaatctagagattatttaaaatacgtgggaggatgtgtgtaggccgtatgcaaacatgatggcatgttatataaggaatttgagctgcctgtggattgtggtatctgcacggggttctgaaaccaatttccagcagatactaaggagcaactatactaggccaataaaagcaagattgtaattttcagcaggtaaccagaaacagtaagaatatcaccaatatctttaaaaagatactgatgcattgatctaataatctcgatgaatacagggcaagataaagaatgccacacgatgattgaacatttcctctacccccacaaccacacttgactaggagaaaaaaaaaaaagaagaaaagaattccacacaaaaagattagagtgaaacagcagaaaaattacaaccaaaaaaagaaacaaacaaaaaaaaattctaaaagagagatttccttcaaagcagcatgaattattaggttggtacaaaattaattgtggtttttgcattgttggaatttgccatttgatattggaatttttttttttttttttttttttttgagatggagtctctctctgttgcccaggctgggctgcagtggcgcgatctcggctcactgcaagctctgcctccagggttcacaccattctcctgcctcagccttctgagtagctgggactacaggcacccgccaccacgcctggctaattttttgtatttttagtagagacagggtctcaccatgttagccaggatggtatcgatctcctgacctcgtgatccgcccacctcagcctcccaaagtgctgggattacaggtgtgagccaccacacccggcctggaatacattcttaaataaatgtggttatgttatatgtcattttaatgggcatttcttgctttttttttttggctaatgacttattacttgctgtttatatttattttggactatggaaatgatgctagacaaaaagcaaagttgagtgattttcttatttaagttcaaagtgggtcgtaaaacagcagagacaacttgcaatatcaacaatgcatttggcccaggaactgctaatgaacgtacagtgcagtggtggttcaagaagttttgcaaaagataccagagccttgaggatgaggagtgtagtggcaggccactggaagttgacaacaaccaattgagagcaatcattgaagcagattgatcctcttacaattacatgagaagttgctgaagaactcaacgtaagaactcaacgtcaaccattccacagttgttcagtatttgaagcaaattgaaaaggtgaaaaagctcgataagtgggtgcctcaccagctgagcaaaaatttaaaaaaacaccgttttgaagtgttgtcttctcttattctccacaacaacgaaccatttctcaatcggactgtgaggtgcaacaaaaactagattttatatgacaagcaatgaccagctcagtggctggaccgcgaagaagctccaaagcacttcccaaagccaaacttgcaccaaaaaaggccatggtaactgtttgctggtctgctgccggtctgatccactacagctttctgaatcctggagaaaccattacatctgagaagtatgctcagcaaatcaatgagatgcacttaaaactgtgatgcctgcagccagcatgggtcaacagaaagggcccaattctccacagtaacacccaaccgcacactgcacaaccaacacttcaaaagttgaacgaactgggctacaaagttttgcctcatctgccatattcacctgacctctcaactgactaccactccttcaagcatctctacaacttttttcagggaaaatgcttccacaaccagcaggatgcaggaaaaagctttccaagagtttgtggaatcctgaagcatggatttttacattacaggaaaaaacaaacttatttcttgtcggcaaaaatgtgttgattgtaatgacctattttaattaataaagatatgttagagcctcgttataatgatttaaaattcgctgtcccaaaccacaatttcttttgtaccaacctaatgcattgacagctgatttctcaaaatcaataatgaaaaccaaaaacagtgaaatgttatcttcaaggtacaagtaaaacaaccacaaatctgtaatatcccccaaaacattcttcaagattgaaggcaaaacaaaaaattaagacaaagcaaaaaaattaagagaactgaccatcagaatgtctgcattatgaaacttctactgagtgtgctaaagtaaaagttaaaagattccaaaagaaaagtcagagacgcaggaagaaattaagacatggtaaacacataggaacatctagctcaaagtactgtccagcagcaatacagtaaaagtgacataagtaatttaaaattttctattgttcacactaaaagaaaacaaggtgaaatcaattataatttcaacatgtaatcataatgaaaagctgaggtattttacattgttttcatactgtctttgaaatatggtgtttatacaacattacaatgcagatgctaaattaaaactgccatataaaatacttgatctatatttttatataatttgcagctaatgccgggtgcagtggctcacgtctgtgatcccatcactttggaagcccaaggtgggtggatcacttgaggtcaggagtttgagaccagcctagccaaaatggtgaaactttgcctctactagaaataaaaacattagccaggtgtggtggcacatgcttgtaatcccagctactagggaggctgaggcaggagaatcacttgaacttgggaggcggaggttgcagtgagccaagatcatgccactggactccagcctgggcaacagagcgagactccatctccaggggggaaaaaatctccaaaaattaaaaaataataatttaataatttgcggttaagaaaggtttatgtatccgagttgttccaaacatacaggttttacagtaactgaatcaagtgtcagtttttaaacttaattgaacactaaataaaactaaaaattcagttcctcagtcatactagccacatttcaagtgctcaaaagccacacgcagctagtagctactgcaatgaatagcacaagcatagaacttgttatctggagtttaaactacgtatacaattcaaagaacaatgacagcctataagacctacatgaagataaaagttgccatcccagaagagagtaatgctccaagcacagagaagatattggccatactgctagaaatccctgagtaaaacagacaacccaattaaaacaaaaaacaaacaaacaaaaaaacctcccaaaaagatttaaaaagacaatgcacaaaagatttaagaattaaaaagacaattctagaaagaggaaattcaaatagccggtaagtttttgaaaaagtgctcaaactctttagtgtcctgggcagaataaattaaaacaacaataagataaagccacattcatcaagttgggaaaaaggaaaaataactcttggtgagacagtaaaagtaaagggatctaccatatactgctgtcggggtatacattggtgtatctactttggaaaaggcataactagtgaagttgaagataaacatacgtactctacaaaaacccatggtaatgtacattaagaatacatgtacaagaacattcataatagcattgttcataactactaaaaacggaacacaatccaaatgtttattaatattagactaaactgtggctcatttccattaagactttttatactatacttattatactatagattactacaatccaatataagaactagagctaaatgtactaatagagttatatcccagctgcatgagagaaaaagatacataatgatatgtaatatataatccacttacatacaattaagaaacaggcaaaacgaacctaaattgcttaggaatgctgacataggtggttaagaaatactaagaaagaaagcagtaaatgattgccataaaaatcagtatagtgttaaccactgaaaagaattgaggaaagggatgatcaggaatagaatggagaggggagcttctcaggtgccacagacgttctagttcttgactgtggcagcgcttacatagagttcacactttatagtttttcattatactatgtatcgatgtttgtatgcttaaatactaaatgtatggaaaaagacacaaaatatttaaaattgtagctaaggcacattaactgccttgctggtatttttttttttcattacaaagtggcagacaattggttacactataaagacagacaattggttacactacaaagaaaattttaaagcacaggagtctagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgggcgcggtggctcacgcctgtaatcccagcactttgggaggccgaggcgggaggatcatttgaggtcaagagatcgagaccagcctgaccaacatggtgaaaccccgtccctactgaaaacacaaaaaaattagccaggcgtggtggcacatgcctgtagtttcagctactcgggagggtgaggcaggagaactgcttgaacccaggagacagaggttgcagtgagccgagatcgcgccactgcactcgtctgggagacagagcgagactccgtctcaaaacaaaaaacaaacaaaaagaacccacccaacagaattaagtaccaacataataaatacgaagaattttagattcttggtttttaaaaaacatacaaagatgatattccttcaaaatatctttacaaaacatattgagactgtgatgctttatattgattgtatgaaaacaatgaaaaagaaccagcactgtttcactataaaagctttactaatgtaaatttataaatcctttcttaaatattttgagttaattctaattttatgatagaaattcattattttcagcaaaaacagctggcatttgggaaaccaaaggctcaaaaactaagaatagtaaccaaagaaacttgacaaaacagtccttttaaaactctcatctacactataaggggaaactttgatcacgtcccttctccttcatcaatcgtagaactcaacattaaggactacacaatcccacatccctctccgagaaaaagcaaaggctttgtgttgtagcaacaacgcaagacatggagggaagctccactcaagacttccctgcctgctccttccccaaagccactccagaataccagggagggttgagaggtaaggcatgaagggcgcaatatccaatatgagcaacgcgtgtgatgcatctggtcaaaatgcatacagaggacttgtctctgtccctagatagaagtcctccgtcctgcagtcatgagggtcaattgctgaggcttcacagttcccttctctcttacactcggaccgtcacgctcctcacctactaccccgatgcagaggtagactcaggatccctgcacttgtcaaggattcctcggcaagctcacggggcgggagtggccacaagacggagctcgcctggtcctggccttcccggcctatacaagcctgcccccttcccaattcccaatctccacagccttccatcctcccactttcgattcaccttgcgccaccgacgcccctggccttcgtttgcagcaagtttacccccaccattacctctcgcataaaagcctgcatttaccaggtcaaagaggggaaccaacgcctgcaggaatcgcttcaccgaatcgcctggccgcgtcctctgctagacttcacctgccgctgcggaccgtacacaaccactcccggcatgccccgcgcacgcactacctctcccaccccgcccctctcccgcccaaacacgtgacctcctttcgtctccgtccacgcccacttccgttcctccactttcccttaggaaggaggagggagctgggggtgttaaaagcgtagcgacttcctcctcctccccgcccccgctcctgtacctcccgctacaatgtcttccgggtcgctagcgcctcgacgccttctgggaaaatagctcatttcctcccctccccctcctcctgccttcaaccaaccagccacccgtcagagagggacatgcgcagtgagtgcctcccgtctcttctacccgaaccccccctcccccccaagcagagagaccccagcagcagcagcagctgatgatgaagagagaggcagtggcagagggggggcaccttttatttctatttttaaagggacaggacactaattctaccccacttcaaccttgaattcaggggggtggggggaaggcggctgagttccttcccccaccctccagccctgagccctgagagggggattgagcctgagagaggagaaggagtttcttcttcttcgaaaacccccatccacgactcctaccccctcacccctccaactcgcctccctccctccaccctcctcctctttggccgtgagaggaggagagaaagaaaccaaaagcctcttagcaacacagaccctttgctgctgctgttgctgctgctgctgctgttgctgctgctgctgctactgctgctgctgctactgctgctgcttggccctggctggagacatctcactacacccaggagcagccacttccccagctctcctcctcctccttcgcctcctcctc

SEQ ID NO: 2663 - DNA, 35060 bp, Homo sapiens
  source 1..35060: mol_type = genomic DNA
gggcgggccacggtgacgcgcgcggaagcgctctgcgggccctcggaaaccgccccggcggctgagaggctgcggccactgcctggcaccccgacgggaggggctccggatcgttcggagccggctgaaccccttcggccgcgagcgaccgcatgagtcgggggactatgccccagcccgaagcgtggccaggcgcgagctgcgccgagacgccggcgcgggaggcggcggccacggcgcgggacggcgggaaggcggcggccagcgggcagccgcggcccgagatgcagtgcccggccgagcagtgagtccgcgggggcgcggggcgcgggccgtgggcggcgggctcggtcccctccggaagccgggctggggtggggagtcgtcagcggagggtcctgggcgtcttcaattctgagtgaggccgttggcgacaaggaggaattggcagacagttttcccagtgtccgagtgcagatttttaaccccagggcccctcacaattctggtcacacagtgactcccctctcgtctcatttttgatatctgcatgtctgaagttaaagaaagttccagaaacttgggaagcaaacccgagaagtgatgtattttattactggttcccgctagatctttccttcagcctggcacagggaggaagtgaggtcgaccctgctgcagccgccggagaacggcgctgcgcgacttgttcttggaggcgacgtcccacctgttggacagactttggacccaaagagaatctgacccattctctctgaccctttaacggcctgactagtatgccttcccgcttttccttttgaaaaggaaagtcagtgctggttagatcaatttcttactgtactgtgaagacgacgatttgggaagagttcctaatttctgcaagggtctgggggtacgcgtggaagcagaatagaaactcgagtgaaacttttctacactttcaagttttaggcacctataaatgcccttggaatttaagaaattatgaaagcacacagacagccagtttgacagatattttaactggctggaaagttaaatttaagatgtgtttaaatgcaaaaagcactgctagaacttttgaaaaaaaaattcctaaaaaggggtcctttggaggcctgttaggtagatattgtgttataataacatatttgcatagtacttagacattctcatttgttgagagcccccttgggatggtgttattcacacttaatgggttaatggccactggaaaataagattgaaagtcagcgggattaccttttagcatgagattggaggggagaaatatccaaatcatatcagagacttaacctcagactctgcagagggttaaatagagggtctcttgcccccaagccctgctccacggcccgtgctggttcctaatcgctgctttgcctgccttctaccctggtggtgagaacagtgcgcttaatttaatgccctgtctcacgtgctgcatgcacctcggccccagctgtgtcatgcctcctgagcaatgcagaaactttgaagccagaccatgttctcagaagtatatgtagttatttggcaagttttctggtggacatgattctcattcagaacacctgtgaaaacagacaatgataggaagagtgctctttcttgaagagtttttgtggcacaggtgcctcttctgtctgctgctagtagaactatatagacttagagctgaaaggaatgtaaaaaaaaaactagcctaggtttgtcattttacacattcacagatttttaaagtgtagcttggctggagagaccctgatgcatcaatgggaacctccccctacctcttctgggcttcctcagcaaaaccaggcagagagacatgatttatagtgacagccaacttcactttttttccccccttggtttgcttcccaagtttgcttcccagtagatgtcccggtttgtgtgtgtggtttttagcagcttaattttgctttttccttatttttgttgcgtttgattatctcattctctttcacctctcataagatggggcagaacaagagaggtgagtttaagatgtcaccttttaaacatcatgtctcaagttttggactttctagcctttttccatctttctgactcggcagtatctgggtagtgggctgtttctctatggtattttcctcacggcctagagaaactagtacagttgtcatataaacaaagtttccaatataaggtattcatgtcaattcctgcatgatgatatatacagcttaatagttgagtatcaatttaaatagtgtaatgtgcatttttagtctgtgtttttttgtcattggagccaaggcctttctttccgcccagatagttgggtttgctatgcagaggaattatttaaaatgtttacacttagaagtgtgaacactgtaagactgtagaagttttgagatatcctatagagtcatttttaatacattcagtggacagtaattacaaatacaaatcatagcccaacttctgcagctgaattagacattcgggatgtgactctgaaggctgtggtgacgagtagagaaagagatggcttatttcctaggtagcacactaggttactcttgattcctttccactaagctcatcgcatttcacacgtgagagaagtgggggaaaagaaacattaaccacatggataagctacattgttttcttgttttgtgagacagggtcgctctctgttgcccagtttggagtgcagtgacaatcatggctcactgtagcctcaaccttctgggctcaagcgatcctcccacctcagcctcctaagtagctggggcaacaggtgcacgccaccatacccagctaatttttttttactttttgtagagacagagtctcactatgtggcccaggccggtctctacctcttgggctcaagcaatcctcttgccgcagcttcctgaagtcctgggattacaggcgtgagccacagtgcccagtgatgaactactttgtatatctcattgcagtttttctttccctccctctcttccttccttttttccatacacccagcagctcatttgagagctgtggttggctcacatctcctggacaagtcctaaggatggcttgaaacataacttagggtcatatttgaagaactcttttgtcagaccagattagtttaccttcaagctccctctgctgctctcctatgctctatcccctgctcactccacccccaatatctgactcctgctgatctggtcctgggacatggttgctggctaggccagaaatgcttagggaattgagaagagactactccatggcccttctctgcctgtctgagggtgagacagggtttgaatctgtggaggcatactgtcggtgaacccctctgaaattgaaagcaattttatgtatgtttctgggcttaggttctgatgaaatctgaattctcagaggggctgtgaacaaaaaaagtggcacactgttgttcttgtggatgtattttctgccccaccccacccccagatgctgctacagttcggagtagggataaagtccactttctcccaacctcatgaagagcctgctttgaggcccagagctgggatgtctctaagaatcaaaccttattgagagtggctgcattgaccccggatacctctggaagtcacatggagtagcatgagccagtcgtggaaagtccacttgcagaagaggggtggaattttggcctgggtgccggtactttcctgtatttgatgtgttgttcacccatctctgaaccgcaaagtggtgaagaaaggctgggttgagtggtctttgcttttcctgtgcctgtgtgggaaggtgtgttagtgtaatattggttgacactgtctcaccaacattgccttagtgttgacattagtctcataggagaggctaagttaagtatgaactgcagggttcaagtccagagagttgaattaaaaaaagccatacttagttcttatagacgactaaggggaacaacttttaaaaagttcataatggtgagtgattaaaattctgtcttgttagctttgcatatacattagaattgattttttttctgtacgtatttacttgaatcaaaaattgaaaaactggcttcacagaaatgccttcggcttcactaagttctgcttttaactcacagcttttgctcttgggaatagtataattttgtgtctgtacagtaagcatgtttaaaataagttttcaaaaattggttggtatgcaggtctttgaacagaacaagtggtaccagttataatttagtatgcaacgttatatagcttactcagttggatatgttgccttaatatcaaaaataaaatattttatctccaggttaagagaaaataggtaaataggccgggcgcggtggctcacacctgtaatcccagcacttttggaggctgaggcaggcagatcacctcagagtcaggagttcacgaccagcctggccaatgtggtgaaaccctgtctccactaaaaatacaaaaattagccgggtgtggtggcagacgcctgtaatcccagttactcaggcgtctgaggcaggagaattgcttgaacctgggaggcagaggttgcagtgagccgagactgcgccgttgcactccagcctatgcaataagagcgaaactccgtctcaaaaaaagaaaataggtaaatattgtttaataggaacttgaaaatatacactttaaaataatgccatagtgcaaaactaagtattttctaactaggaattgttagcatttggttttaaaatttaggctgagcacggtggctcacacctgtaatcccagctctttgggagatcaaggtgggaggatctcttgagcccaggactttgagaccatcctggacaacatagtgagaccctgactctataacaaattttaaaaattagccagatgtggtggtgcatgcctgtggtctcagctacttgagcctgagatgggaagactgcttgagcccaggaggtcgaagctgcagtgagctgtggttgcacggctgtagtctagtctgggcaacagagtgagaccctttctcaaaaaacgtatatataattttttaaatcggcttaattatttttaagttgtacatatttatggggcacatagtgatgttttggtacacataactatagtgatcagggtaattagcatgtccatcatctcaaacatttatcatttctttgttttgggaacacctaatatccttctagctgtttgaatctatatagtagattattaactgtagttatcctacaatggtatagaacactagaacttactccttctatccagctgtagttttatcctttatttgtatcctttaacaaattttaactgtggaattgaggttgactgccagaaaatcaagtcatttagactttggcttaacttttctttaccacacaaagaatgtgtgatctggtgatcacctgagtcactgagcttcagtggtttcttttgtgtcagagtggatacctctccaccaccaccccaacttgacacacaaaaggttgccaaatcccttttcctcattgttttattatcttcccatcccataacaaaaacgtaaacttaacctctacctgttccagattcctggcctttagtatcatttcattgtgtcattgttttcagctttattattttaatacttaaaaaattaaagcaaaagtttattgagtgaagtatttttaaaataaaattattattttttggctctgtttcttcctctctttctgtttgcttatctttctattagacgggtaactatttcattctgcctgcgaaatgtcctccttcctgaatatattgattgcgcttcattgctcaaacctaaaacttattcttcgggattattttttaaaaattaattaactaattttttttagtgacagggtctcactctattgcctgggcaggagtgcagtggtgtgatcatagctcactgcagcctccaactcctaggcttaagtgatcctctctcctcagcctcctttctaggggggattacaggtgagtgccagcatgtccaattaatttttttttttttttgtagaggcggggtcttgctttatgcccaggctggtattgaactcctggctttaagcaggattatttttattttaatggtggcctttagtaaaggctgtgttacattttctgtatgtccttggtggccatgaagtaagcagatgtttgtgcacaggatctgagtgaaattcagttgtggttaaagcaatttgattatactctggttctcttattcttccatttctgctttgcttttttcatatatcctgaatctgtgctctttatttccagtaatttcccgttcagcttccctttgcatttagttctcctgtttgttctgctgtttgtttcctttcctttcctgttggcctttgtaggaatttgtacttgtgggatggagagttgcttgtttagagaacctcctctgggcattgatgttggattttggttattttgtagattaaaaagaaagagaacaaaagtggagccaaatgtgcatgtagtatagccacagattttgctcgaagtacagttttcgtagacttagactaaagaactggaagaggaaccatgtagcttacacggcctcttccagtcttctcattttgaagatgagaaaactgaggccgtggggaagtggcttgcccaaagatatatgcctctgataatgatactatgaaagtgctttgcttaaatgtctgttttacaggattggaatttgtcccttattttataaagccaggaaaggggctgaaagatgttaaattattgagagaagaacgaacacatttggtcacttttgattttaggcctttgatgtatggtccccatgaatcaggtttctgtttgtttttacctctggcatgggctctaaggatgacatcacactttttacttgaaatctcactggaagcaaaagcacatggaaagtacctttttctgatacttgttcccttaccctcacaacgttaaaatacacacagttacacatttagagagaaaaaaagaaataaaaattgataattggtcagattgttcattaatactttgcaacagtggatataaaatgagaataagaatagcttacttaattttgagtgctaattattttccatgtatctgtttcttaaaaaagccctttaaggtgaatactcttactgcccttttgacaggtggttaaatctagatgccgagaggtgtagttactctagtcatagttatacatacagctaataaggaccagaatgaggactagttaaataaaccctggcagtctaattcctgggtccccactccaatcattgcactctgcatgcagagggcttacccacatggcgtgtatcgtgatgtgtttggcagggggcaggtcaggagttgtgggccgttcaggaagagggaacatctgagcaaatcacagatgtatgggcacatgataatgttggtcaggcgtttggactgaagtgtgagtaatgcatagggaaataatgggatgcaggctggagtggtgggtgaggtcctaattttgacattggttccctgagtgggaaccattgaaaggttttagtggggacatgtgagacttccttcctcagtctggccctcccagtaccccttcttcatctgtctcttgctgtctgacttcttcctctttcccccagctgtactaggccatataccaggagctggggtgatgagggaattgggggtagggatatctcagtcattcactgaatattttttttttagcctggcacctcctccttcctgtgttccactgggtctgcagccttgtgtgaggatggggtatgcgctcatgaggcaggagtatggggaatcgggggtctgatcattgcttatgtgaaggtcagctagtctccttgttttctgctcagtgtgttactcatgcctcctgaaggacttgatgcctccagttcctgagcctttctggggttctgccaggttttctgacttgcctgccacggatgcccatctcccagccttggcttccctgtcctgtgtcatttaccactccatctgctttccagctctttggactttcacctgtcttctggtttcatgaaagatagaatttgggtttctgtttccctttattgtcattttggggtgaatcttgggggaaaaggggtgcatcttcaaaccagaagtcccattcttcatctttgtctagcatctagtggattttttccctttgtagtacttagtgggctcttgctagttaactaaagtactagagactaggaagctctgagtaagaagtcggtagtagcggacagtgggaatctatgtaacagctgcatgggtggctggttgattgtggggtcaggaagcaggaggatttcgaggaggttttttagctttggcgatttgtaataactgatggtctcttcttgtttttaaggtagctattgtcaggtttgcttgtgacacgttacaaaggtcggcaatggggcctgcattcctatataaatatttttatcagcactatctccattcttggaacttgacagaatcagttcaggagcttcactaataagatgcatgctatgatgtctagatatatagttgaggcactaataggcattacaattaaaatgccttcagagctacctagcaaatgaagtgatgtaacttgtcttatttaagtaagaaattctgaagtagaagaaagtggtgagatagaaacataagcatctttattcttaagatagaagactcatattttattagattatcatcatgtaaagtgaaaaaagttaaacccttagtatattatgcatttgtaagcagctgtataataggacggaaaatgtcagtgcaacaagtgtttgaaaatgtctgctttggtgtaatttcagtgaggaggacatgtaccgtgctgcagatgaaatagaaaaggagaaagaattgcttatacatgaaagaggggcatcaggtatgtttggaattgttttatttatagagttcttattgtttatagcagaaaatgcagttaaatccgtataaccattttcataaaatatcaataaaatattcttatgtatatggtcttatctacattgattgttttgctgaagtatgttagagactgtttcctgaggcttttaaattttaatgcaaacattctctctgcattctttacattcatatcgtttttcacacctatgaggattgttttgtttaatctcttgacaccgtcctctctcagttcttgatttccttatattcttagagggagagttcagatttgaagtgcatttttcatttcaaatggaaagacttaactgagaaactggctgtgcacatctttgcatgcagatggccatatgaatgtgattaagtaataagaaagacagtgatgggatcagtagcacagagtctcatcgttttgtgatttcatgtctgtgtttttcttgtcttgcctgatcttaccccaaccaggacccattgctgccggagtgaggtgttactcctggacccctccgctggtccgtggagacttggctggcaaagttgcatgtgacgtacatccttagttccctgagtggcctcatgcaggagctgcatagggttactctgattttgggatatcccgtgaataatcacaagtggcattttctctttcattacctgtgtaatgtataaggagacttcaaaacggttgtggaaaaatggaattgaaagatagaaggctgggtgtggtggatcatgcccgtaatcccagcacttggggaggccgaggcgggcggattgcttgagtccaggagttcgagaccggcctgggcaaacaaggagaccttgtgtctacaaaaaatacaaaaattaatcgggcgtggtggtgtacgtttgtggtgccagctactcaggaggcggaggtgggaggatcgcttgagcctgggagtttgaggatgtagtgagccgtgattgcattactgcactccaacctgggtaacagtgagaccttgtctcaaaaaaaaaataaaaaataaaaatataaaccttatttctcaacataagctccatcagtttcaagccacttttaaatgatgataccagccatttgttggactcatccctaaagaactgacaggcctgggaatttaacaatgtgaatgcagcagtcttttttgcattattagctgaagaaaaatgtgtgtcctttaaagcttcttaagattaggaaacaaaaggaagtcagaaggagccagatcaggactgtaaggtggatgcctaatgatttctcattgaaattcttgccgttgtttgatgttttttcttgctttaattttagcagaactcatgttgctctaataggggctcttttcaagctgatgtcttatccttcttagtgccttagactagatcctgttcatacatgttataacaagttagtatgagtttattatggtgccaaaaaaaattgaaatccgtccatagctttttcataaaactcattttccatgaaccttagaagacccttgtctgtgctcttctgttttgagaactggcttctgtttttggtgaacaaaagcattgtcatgtgtgattaggaacaaatgatacacagtgtggtttttataatacttcttgagcccccctcaagcaattggtgaactcttcactgtggtagccacaggagatattctttgtagtgatgtgtggcggggccgcaccgttccagtcttccatgaaacttgaagaatgctctgtctctactctgtggttgttcaaaatttcatgtagggtgcagtgtcctcattagtcagattcctaagaagaaagtgtgtattcagctggtgtttgttaccgctgacagtatttcaccctgtaggctctcggttgtgattctcttctgtctggcattgtaccccacacgggcaatcaagctttatggtgggtcttgtaactcctagctttagtctgagagtgaaatggatccctttacacttctcacatcatctcagaccttctgggttcattgtctttcttgaaataacatttgttaccctctcagagcccaggctgaggcaaaaagttttcttatcctctctgttagtgaaaatatttttttccaccttgcctgagagtcagcaaacaatggtttccaggccaaatctgacttgccacctggttttgtcgataaagattttttgaaacatattaatttacatattgtctgtggtggctttcgtgcatagtaaagttgagtagctgtgacagaaaccttatggctctccaagccttaacttatttcctgtctggcccgttacagacaaagattgagattcctatcctattccaccctgtttgagagtccctgctttccggaggggtttcagttttaacttcccgccttctgagggtctgattcttgtctttgtcacccatgtggtggttaaagatgaagcctcttggttatttcaacttgtggcttaccactctggttttcaacttccctatttttctattttttatttttttgccattagaaatgtccttttttgaaaacagcagcgtctgtgtagtttgcaactaaagaaagttgcttttgaactccataagctgctcgaggtcaggtactgccttgtcctgcatctccagctcctagcctggtacctggcatgtagtagccattggagtcctcctcagaggaccacagcagaatgggaattcaggtatttgatgctgccagctgtgccagtacccattttcccaaccctcactacgctacgtaggcctctgattcagcacttggctgtggcctgtggcttgatctcttggcctgtgtgaggcttgtgcctcctcccctcagtcatggggtgctgggcttgccccaccctgtccaggtcttgtcttggtgtgcacaggaatgaggactgcagggaggagagcaggaaggtagatttccttcccaggagtccctttctgagctggacatgtgctttctgttcaggctcataaccctacctggaggaaaaatgtggaccaataagtgtcctgactctggacattcgcatttcttcccttttgggcaggggaatggaaagacagctacatgagaatgcttccatccactaagtagacatgcaaaaaaatatttctcgaattaaaaaaaatgaagattctttaaggattggctgtgcagcattggtctttgtggtccctgtatattatacctcaggagtctgcttcacttttaagtgaatcctgatgtgtgccacagataaatatgtctatgttatctgtatatgtattattttctcttgtatgtaaaaagttacttttctttgtaaaagaattcacagtgagattattaaaaatcagcagttcttaagagtttacttaaaaaattttttttttaaatttacctaaactgcaaggaggatttagggcctcttttgtgctcctaatcatcctggcacccatcacaccctggtttataagtgcttgttgtcttttctcctccagcagtccataagccccttgaggatagaatcctgtcttcatcaccttttatccccagttcctagctcaatatttggtacattttagacactcagtaaatatttgttgaatttagttgaataaaacatttttattttatgtacaacttgctcaggagtaaatatgttgtaaggtacttctgcattctaaaatcattgctagcatctacgtcttcagtaatttaaaaaggaagtcaagatgtgcctgaaaatttaccgccttttcttcctaaaacacacacactaatatgtgcatgtgcgtgtatatgcacataccacaaaatcaaaccccaaaccatatatattaaactagggaaaatataaaggctatttttttttcactataacatttgtctgatggtgagttgtatttttaattttgggggatgtgttgttagagtcaggtgaggtctgtggattaacaaacatggagagttctgttagtttctggtttattatcgaccacttttaggtttttgggatcagggtaggacataaatacattaagataattaaatgtaatttttgttatagtaggtgttatttctttgtataatggttataaaaaactgattactcattgttagaagtgttttctcatagttcagactgtcgcgtctgtaatttgattagaaaagtattcatgagcacctgtgtgtcagtgcagctccagatgctgaggacacaacacaactgagaaacaaaacaaagtccctgccctcaaggagcttgtgttttactgtatttttgtatgggtgtgtgtggggggtggtgggtgagtggtacagaaaaatatttcaggtgttgatgagtgctaagaagaaaaaccaaatggtataagaggaatagagagcaaaagtgtacgtgatactatgatacaaggtgccagctgactctggagcagaggcctgcatggagggagggagcagctctgcaggtgcggggaagagcaagccaggtgttttggagagtattgggaggctgtagctggggctggagcccactcagtggggaatggtaggagcagagaccagagaggcagagagggggactatatgaggaataaggccatgaggcaggagcccctggagctctctgagcgcaggagtaattgataccatctgattcacgtttagatggatcatcctggctagctatcatgtggataatggtctggagagtgtggtgacaagggacacccattgggagacccccatggttatctaggggtgaggtgatggtggtctggaccagcggttaggcagtggttgaattctggattttttgacgtgaagaaagaaaatgaagagtgaagggtaacccccaactgaagcagtattctgattatgctttgatttattatttgctttttttttttttaaattctttaacagaaccgagattaagcgtagctcctgaaatggatatcatggactactgcaaaaaagaatggagaggaaatacacagaaagcaacgtgtatgaaaatggtatgacacagaggtgcacatatttcaggtctttcaaatagtctatcataagttgtttaatatgtcatttgatatttttagacattagttaaaatgactgctatagacgttgttattggtgttctaattttagagttaaggaaatagactccaaagataagggttttgttttaagtcacagtattaatatagaatcagcatcagttattcagtgacgcaatttctttgaaaaacacgtaaatgactgctgttcagagttgggccagctcttggttgtcctcttggggccatttgggaatgtcctttttggtctggtgttataaaataaaagcctcagggatgcctcaggccgattccacacttctgctttccacagcacattgagtttgcttacacaccctctggtcctggggcctagaaccttcttggactccctacacaggggaatcaggaactgctcccttcaagatagtctccaaggctgtgggatgacattggagattcatatgatgtggtcctgctgtgactgtttggtccggttcattactcagctcagacaccatggcctacatacaccacacagctgatcaagcagcagaccctgtgggctctaccctcagatgtataccaaatccagtattatcagtagggtgaaccatgtgaattgctcaaaaacagtcaaatagcagatttaacctaagacttccatgacctcttgaaacctctgggtttatcttttgctcatttttctcttgggattatttacattatgaatttgaatgcacttcttatatattagagatactgactgtcatatttaatagaaatatctttaactttttttggttaggattttaaatttttaaatatttgaatatttagttttttcctcagagctcatttttatagaaaatgattgctcatctttcagcatgtacctcagctgcccatgggctgaccttagaaaaatctagctgccacttgtaaagctctgagagcagatgatagttctctgcaagtctgatatgtagatgctttgtgttttaggcgttggttagagaactcaattatgaaaaacctggaattcttagttcctgccagaggttaagaacatttatatttttgctaaatatgctgttggtcacttgcagattttccaacctctagcccatcaggacccatggcagtaattagagcatctcagatgcctgaaaacagctttcacctccattctattttagtccttattggcgtgattgtctgtttttgtttcgaatattcttttggaagtaagtttctacaaattcagatttaattttattctgaaatagcctgagtaatttatgcatttggaaaggtacagctgcagttggatttgcataagtattctggggtaattgaggtttaccataggcaagaagtacataattattagtaggtgtgattctgcctgatggaaccttatgtgttacagtggttggaccactaaataaaaatgcaaccctcaaaatgttgttattgggggaaaaaagtacttttatattcacttaaaacatcatcctatgacttgaaccttgaaaacagctagtaatgaggttctagtacctggacacacaggacagaggtggtctgcattgcgtccaccccacgatgagggtaacacttctttctttctgtgagtgcagggtaggaagtgggtcttgagtgactgtcaatgaaaagttggatgagttaaggggctgactcgacccagggtcagggagatggtgggcagttcagtcagtctcaaggactgtgcatgtgtctagctggagaagccaggcatcatcatgcctgctgggggaccagactcactaggattttttggtgtcttttcagggtacgtttcagaatggtccattggatggctgtttttgagtgcccaagcatgtcactgaatattttcatttgcttgtttcacttccagactgagcaagagtgacacttcacttaagaaaagaaggcggggcacggtggctcacgcctgtaatccctgcactttgggaggcagaagcaggtggatcatctgaggtcaggagttcaagaccagcctggccaacatgatgaaatcctgtcactactaaaaatacaaaaaattagctgggcttggtggcacatacctgtaatcccagttactcaggaggctgaggcaggagaattgcttgaacccgggaggccgaggttgcagtgagccgagattgcgccactgcactccagcctgggcaacgagagcgaaactgcatctcaaaaaaagaagcctaacagaattattcagccatctcctggcatatagacttttatgtgtacatgcacatacacaaagcacccccgcccccctttgtgttttggaaacttggggtttttctatatttttttagtaggaaaatataaacttagtttagctctcttttttcttgccttttttttttttaaaagagtttagggtcatttgaaacacagagtaaacccttcaaaatgttgtttgccagtgagtaagtgttaaaacaattgcttagaaagggacataaaactccaactttgggcatcctcccagtgatcccaggccaagctttttccacaggaatgaaactttctctgctatctcaagtcagtaacgaccattttgaattctttcataccttttcccagggctatgaagaggtttctcagaagttcacctccatacggcgagtccgtggtgataattactgtgcactgagggccacgctgttccaggccatgagccaggctgtggggctgccgccctggctgcaggacccggagctcatgctggtacgctgctgctgcaggtttgagtccaaaatgtttcaaacaatttttgtgagaaaactttccctttctgtccatgctaccttctagtatcgtctgcagtatgatgtcagcatgtgcgtttattcagttttgtgtggctggggtgatttcacatagttaaatgaccaaaaataattggtgtttcctagaagagaaaaatgataaaatttatatgaacaatttagttgaattagagagcagatgtttgtataaagcacttaggaacagttcgatttcaattttggtgtttattttaagtaggctgtatatgttactatttgagaacctgctagggttttagaatacacatttctttagtttttagctataattcaataaattagtacttttggctaagtgtgaggattggcttagtaggtggcagaacaggaacactagaagagacatgattactgtcacatggagaggggcttcctgaggagctgagactcagcctgtcccaggcctggccctctttagcgttttaaatgtaccacatggcagacatgcactggaaagtcatgtgtctgcatgtcctgacacggataaaggcatatagtcaggtgggtgatagactatcctgaaagattttttggtcaggaatgattggtcagagacagcaatatacccatataacaaatctgcacatgtaccttctgtatctaaaataaaagttgaattgcaaaaaaagaaatggccacagccacccaatcttcaacagccaccaccctgttcagttagcagccatcaacatcaaagcaagaccctccaccagcaaaaagattacaacttgctgaaggcccagatgatcattagcatttttttaccaacaaaatatttttaaattaaaaaaaaaatgacaatatgacattaactggaagaaaattgaaagtcttgtgcttaaatttaaaaaatccaaaacccagaaatgctagccgtgggagattggccttatagcaatttatgaaaagaaagaaaaagatgttaggattttaattatgcaagcccactgtgagcctgcatgaaatgcgatggctagcaatgatcacaaagccctagctgcattttatttttattatttttatttttattttttttgatattaagcaaaaagaccaacctggctgcgttttaaaaggaatgattctaagaattaggcagtgacagccccaccttgaactgggctggtcagaggccatctcaagctcggtgcctgataaagtatcctcagcagatggaaatgtggccaggatgcttcttcacattctgggagccattgaaggaactggggtgttttcctagaataaagaagacttttagaggaacttgttgactaagctagaggtcttttaggtggatgagagatcacacgctcagaagggcaaaaccaggattgatgggtgaaggatactccccatctgttccatgattgtttaatacaccagcataaaatcagcacacctatatcaactgtcaaaatgacatctggagccaagtgtggtggcgcctgtagtgttagctactcaggaggctggggtgggaggatcacttgagccaggagttcaagtccagcctgggcaacataaggagaccccttgtattggggagtctattaaaaaaaaaccaaaaccaacatctgggaaagatattttcttctaagcaaagatgcatgccatcttaagccgatttttcagtattagcttatttctttcatatagaggcaagagaaatggatatactaagctgttttttcttttgtaaatgatgccatttattagtaaagtatttcagaattgccagttggcgaaagcattcctatggttggatataagacccaactagagaagcaaacaatgatttcactgtttttgctttgccttattttaacttctgtgcttgacaactgtagatatatatgacacaatttctagattttggtggtgtatacctatgttcttagctactcaggaggctgcgctggcaactgtggctatattatattaatctacaaatctgtatttctggatagtgacataatatcttcctcaattttaggcaaaattttccttttgaggctttacctttaaggagctatttggatttatggacttacttgacactaaatttgtatttttatactttctgagaatctggggtaaatagtgtcctaattaattaaataaagtataaaattgcttttaaaaaagttaagtacaatgtctccccccctttttttttgctagcaggatatattgggtaagattatctgccatattaaaaatagtctgggtagattacattcaaactctaatcactgttacaatatgttgcatgtgtgagtgatggggttttaaggtggtttttctgacttaatttgagtaatgtgaaaatagttttaaaattcttaagtgttctttccagtttctttccttttctatgtgtatcagctattatatttttctgggagcataatttaattagttggtcacttggtttggtttttgtcatctaattgaatgccaagaggcctctgtcagagagggaaaacacagtgtacctgcctgtgggtttgatatttatgtttattaaacgttggatctgaatgttagctgaagaacgtctttgttctttccttgctgtcatccagccagaggacttgtccttgtgttgctgttccagccctcagcaatttaacatagtttgaaaacttgctttacccagttcgttttgtggtatcacgtctgagacatgattggatgacaaattcaaattcagcacatgctttgtgtttgaggggccagtgaaggaaggaagggacccataagcttactctggttgtgcaaatctaccaggtggcccgcagaccctcctgtggatgcctttccattcctgttctcactctggcccccctggccccacagcccttcccttggaaggtccactctgacaagggctttgttgagtgagcgtttcttgcagtgtgactgaaataaatcaggggtggaacctttagctagctttatctgcttctgtttgcagattgagagatgttctctgtggcatgttgctgtcttctctgtcttttagaacatcatttggttttagggtattaaagggagctgggaaagctagactgagtgaccctccccttaatctatgctcggtgaagaagacccgggcttcctttctgctgctgctcagctttgctggccttgctctgttccctgcctgtgaggcagagctttgtccttatttgcccctctgacagttcggctgtccctcacctcctgtcatcctgcccaggtgtcctgtttgttgttcccatttctgcccagatcccagtctccgtgtttggctgcagccagatcatctgaccctcaccccagctatggagatggcctagcctggctctcaaatgtgggacaacactttggttcctgaggagggtaccctttagagtttggtttccaagttcgttacattttataatgtctctgaactggttagactgtgacagtgtttgcttagagtgagatagactgtgtatcaaaatttttttgtaagttttggggatgacacatttttattatttgctttctgttgtggtatcaagaattaccggcatatgctagagaaaacaggctgttttatagtttagtcacaaacaaaatgacacctaagctaattacctactttattcttgaatatttccaatcactgtttcttgtttaaatctggtttcttgcttaaattttctttattctaatagaagtccagtttgtgcttagtggaaaacaaaggttatttacgtgtgttccatgtgctgtgacctctgaaagcgtttgaagttgtattcacttttttcttctgaataaatttgacttcattcttttctgatggcttttttcatgcttcattttttaaaattgtcttaaggatttctgcatttcctggaagtctacaaccctgaactgtttgaccagtgtgtgaagggaatcagaaacaattgtttctctctgtgtagttaggtcttcagggtctcctgagtaattcagttgagtactgtacctactttttagataactgtatcatgtccccagatgctcagccggtcttctgggcttcccttcacctcatttcccagctcacatctgtgtagccagtattttctgcacatttgtagttctttgtgcccaattgtaattttagcttgttgccacttgagggcatgtgaggttcttgtgataaatctgagagactgaattgaaggttttgctgcagaactgccacatgttgccgaaacgcagggcagtgtgggcacggagtgggctggtgcagcctttaggtgggtggtcatttgttattctaataagatgaggaggagaagtccctctccacccttagtgagtgatgtagttcgccatcactgtggtcacagtgaaaagtaatttacatcccaatcgtggttctgtgttttgtagaaaccaccttagttcacacgattgctctaggttgagaaggtaccaccagaattactatttatgaaagggtcttttagtcttacattccagttgaatggaagatttggcctcatttaaaactgtatttattttattttatgtatttatttttattcatttctttcttactatataaagtttttaattttttggggatgaggtcttgctctgttgctcaggctgaagtgcagtggtgcagttatagctaactgtaacctcaaactcccgggctcaagtgatcctcctgcctcagcctcctgagtagctgggaatacaggtacatgccactgtgcccagtgaatttttaaactttttttttttatagaaatggggtcttgctatgttgcctgtactggcagaactgtattaataactgctaaacaaggtcaggttcctcataggatattgtaggatttaattattctttaatgatctgttgacttggaggtgaactttttttcctttctaaattttatagcagtgaagtgacacacctgtgcccagcctaattctaggatttttctcctgacacacccaagactgttggaagagtcttacttcccatgctgtcatcagtcaggctgtgcctcagcttgcctttcaaactgcagattgtgttgataactagagggaaacaaagtaacaaatactccaggaataaaaaaaatggaaactagcaatgtagttcagctgtcacttctttcatgaactaagtgagcacagctcacttaaccctgcctctgattttcaattgtatgttttatcttaatagatcgattagatagttaaactagacatagtatcatttctctgaatgttaaaacttgagtatatgtgttaacattatttaaccaaactttttctacctttttttggtggattttttaaatgccagaaactaggttttatttttcttattgggaaaggagaaggtttggcttcaccctggaccttctcacatgctcagaagcactgtcccgagccatgtgttaggtggtggttgagaggctgcagtgagtcccatagcctgaaggtggttggtgtgaggacgtgctgtgggcatggcctgctgtggaatgtcctggccgtggttggagtcctgcaaggcagattgtgctttggctcaaccaaaagcaccatttcactccagcagccctcctcagggtggtactttctaagttcctgacttctagatttaggtcctccatcctaagcccacatcacagatttgcagaattaattctggaaacaaagttaggttttatagactttgtggtttcttacagcttggattgtgtggtggatttcttggaatgttaacacttctttatctctttgtttctcgatgttgtagttaccagaaaaactcataagcaaatacaactggatcaagcaatggaaacttggactgaaatttgatgggaagaatgaggacctggttgataaaattaaagagtcccttactctgctgaggaagaaggtttggaacctgtagtgtcctgtctgataagggtgaagctctcgttcttgcttgccccagaagaccagtttttagtcttcactcagtggattttcaaatgctcttggctgatttttaggcaaaatggttttaaatgaattcaaactcttcccacgagggctttagtaaaatgggaagtaccaacattatatattcttagagcagatgccatgtactagggtatcaaataatgaagtgtttgactttcttaaaaggaaaccttaacaaatatagtctttgttccaagtcatatttatgtttcaagaatataatttggttcctatttcttatatcattagtaatttattaaattctttccaattatgctcatgttttaagattctgcccatatttatcagacttattttctttctccgtgattttccagttagtagatttagtaacttgtctttagaaaactgtcctgagagtttttctgaaacagaattgtagggagaacttggtcttctgattcctattgatttggtctttgaaattctacctttctgtggctttccactgtctcctctgggttggatgtcctgcctgcacactggcttacatgacccctagcttgctttcattgagcagcttggagcccttctcaccaagaaccctgattgagggcctgtcacttgcgccagggtgtcggtggagggtggtcaagtagagaggggtcaaacatggacttttcaaggtccttcctagcacgtacttcaaacagtgatttctgtactcacacatggtctgctgctcccattagactttcagctccacgagagactgtcctgtgcattccttgacaccctgtgtccagcagcaggtctggcacataataggtgttcatttagtgctttattgaattagtgaactgagggccctgacttcttggaacctagtttttgcttagaaagataagaaatgtttactggaaaatatactgtcaaaggaagtccagtagttttatctttcttttactataaagaaatgggagcaaaagaagggaagagggaaattccattcttgttacctgttggactagaatgcaggatttttgtgttccccagtccttgggttagtggaaggctgacggcagggctgtagccctgtgggagtgaacgagagggcccttcagcgcaaccacaggtcacaatttcgttttcatttttttaaggtcttgtgaaattgctatttctgctttattaggtttttctactataattagaccctcatttttgggaatgcttgagtggtgccaatttgcaataaggttaaaattactaataatctgagccagcattactaacacttctatgccaggctccacactaaaatttcatgtgttatttaattctcacaactatgaaggtggtgtcgctgtggtcatcactgttttttaggtgaggaaactaaggccaggagctcagttaaatgccctgcaaaaaccaccacagctgctctgtggtgaagccttgattccatcccgactgactttagagccatgtccatgattggcaacttggtctagtttggaaaatatgagatacagacaagcaagtaccagccttcagcccaaatattagagggaattgtatgcagtcattaccattgaattcactcttgtatttaaaatccataatggtgtttgagaggggcactagttattgttgattcataaggaatggtatttatgttggcgtctcttattctcattcactgtaacttaaaagcacatatatttataggttttcttttttaaagagtttgtctatattcactgaatacctaacacattactttattcttaatccggagtcaagagtttcctgaatggatttattcatttgaagttcatatatatttttgaggttagagggataagtttagtaaattattattcaggagcccctacgcccttccttgcctctcttccatttaggagggttggctttgtgtttctgggtgctaaccctcctgtaagccccttataattgtagctgcccttcacagcttcacacacaggcttcacacacatgtgttagctcttccataagtgtctctgattggctggttcaatctcattgcctgggaagttaagggagtcaaaatttccacagcctcggtgcttcttattgcattgtatttttctttcaaattaatgggagaaaaagctgaataaggagtttgtgtgctttaaagtgtaccatttgttaatctggaaacctgaatgttgtgagcattggtaagtgacccatggtcacttttaaaaaataattttgtgctcatagtatggtactataccagggatttttagaacaaaaattctaattattacataactttcttattgtagtgggcaggcttggctgaaatgagaactgctgaagcaagacagatagcttgtgatgaactattcacaaatgaggcggaggaatatagcctctatgaagctgtaaaatttctaatgctaaacagagccattgaactatataatgataaagagaaaggaaaggaagtaccatttttctctgtgcttctgtttgctcgggacacatcaaatgacccaggacagcttctgaggaaccacctcaaccaggtgggacacactggtggtcttgaacaggtaagttgtgcttttgagcatgtattaccccaaaataaagcagctttactgatcaaacttgatgtcacagtttttgtaggtcagaaattcagggacagcttagttggatggttctggctcaggatgtcatgaggctgcagttgtatgttcagggctgcagtcatctgaaggcttgactggggctggaagatctacttccagtgttgttcactcatgtggctgtgggcaggaggcttcagttccttactggtagttagtaggagggttcagttcttcacacataggcctccacagggctgcttgagtgtccttacaacatggcagctggcttctcagagtgaactaagcagtgagcaagaaagaagccaaaatgccttttatgacctaatctaggatgtcacacactgttagattgttttctactttttagaaacaagttacttgatgcattccactctcaagaggaggggaatttggctccacctttttgaatgaggggtaccaaagaattgtggacatactttacagtcaccaccgttatctcagcctgggctttattcttcagaggggtggatgggattagtactcttggctctgggaggctacaaataagtgaagtacttggaagagccattcgaagggtcttgtttaatcttggcaactgtagctgcattaaaaagagaaatggagtcaccttagccagtagagttcagcctgctcttggatcttttacagatttgttaagtgtggagttttacacacaaacccagtgcagtactatctctaagccaatatagttgagtcaccacaccttgtgctatctttgatgtgttcattttcctaaaaagtcttaatgaggttttttttattggaatagccaaccgctaaagtagcattaaggctgttcatcaaagtgccaccctcctacttacataattgactcttgtgcctgcttttttctaaaaaggcccaagtgccatgacagatactgcaaggattagagagctgagttagtttccattctgagctgtcctggagtgtgaggtctcttcttctgttattgccaagtgcgtaggaaggagtgtagactgatggtcactgctgggtcaggcagggctgatgatagttattttcaaaaattacctgtactcataatgtgggttacttacgtctcctgaaccatagcaagtaccttgcagtcaaaaggcttatagaggatggtttgcatattagactaaagttagtcttttccgagaccctataaggtctgctgtgatggtgagtccattcttttttttttttttcaataagaaattttcagtttcttttttgaaatacatataccataaagttcactcttttaaagttttgcagccatcactacagtctaattttagagcattttgtcaaaagaaacctcatgcccattagtaaccactttgtcttctttctaaccctaggcagccactaatctactttctgtctcaatggatttgcctgtgctggacatttcatatgaatggaatcatataatatgtggtcttttgtttatggcttatttgatttagcataatgtttttaagatttcatccatattgcaccatgtattagtacttcattcctttttattgataagtaatatcccattgtatggatggatcacattttattcatctgttcaatagtttgatgggtatttggattgtttccactttttagttctgtgaataaccctgctatgaacattcatgtataattttttttatgtgaacatatgtttgtagttctcttgggtatacaccgaggagtggaattgctttaacattttgaggaactgccagactgtttgcaaagcagctgcaccattttacattctcaccagcaatgtatcagtgtcctgtttcaccatatcttcaccaacacttctgactttttgtattggggtgaagttcatataatttaaaattgaccattttaaagtgtacatctcattgacatttagtacactgctggtgaccaccacctatatgaagttctaaaacatgtcacccccaaagaaaatcctgtgctcattaagcagccattccccattatcatctttttggttatagtcattctagtgggtgtgaagtactatctcattgtagttggatttggattttgatttccctaatgactcacaacgttgagcatcttttcatgtgctttcttggtcacttgtatatcttctttggagagaggtgtctgttcagatcctttgcctaatttttaagctggttatttggttttttgttttgttaattgttgtaaaagttctttattctggatacaggatccttatcagacatatgatccattcttgattatctgctttttttttttttttatttaaatcgaaaaggattggggctgggcccaaagcaggaggaaaaaacgttgtggcttcaccattgctgtgcactgtgggataatggatggaacatggtgttaagccacgtttttcagtgtgatcttcctcagaatacccgtttgctcttcttcccaggttgaaatgttccttcttgcctatgctgtgcgccacaccatccaggtgtaccggctctccaagtacaacacggaagaattcatcacagtctaccccaccgacccacccaaggactggccagtggtaacgctcattgctgaggacgatcggcactataacatccccgtcagagtgtgtgaggagaccagtctatgagagacgcatgctcctgacagcctggcgacgtggcgaagatgcacaggtggctcctgggcttgggctgcaggtttgggggtctctaagaacaatctctgagaagaacccttgggcccctgggagccaagttggacaggatgtcctgaagactagcttttgataagagaaattaaccaagtctttcccctcatctatgatgcaatatatttcagtgggggccttcagagcacacctgttggacggtgcaaaccatatcttctccagaaggcaaatacttttgtatcagaggaaactcagttttggagaggaatatgttctttatgtctcaaatcaaaactctctctaatggtaaactggcttctaatttttttaagtacagtatttttttttcccctttagtagtaacgggtttctatagatcttcctatacagtctgctttaactcaggaccttgagattatgagactgacgtgctgcccactgcactgagggggcttctaacagtctgctttaagtggtataattctgggatagatctgttactggcatagtcatgacaacctctggtaatcttaccttctcctttttatgaagggaagagcaatggtttggacttacatcttaattaaggctattttaagcagattgttttgcaacagattaagaattgggtcccaaagtgggttatttcaaggcatttttgaagactggaggagcgtaggagggagtggtgagggaacctagaacttcttgctccttgtgactatgacagatgtctgatgcccccagcgcactggagtctggggcttggtgcaggtggtgccccatcagtgtggacagacactacttgcctttgtggtttagtgttggaagctttaattattctacagttccatagattcacaattttatagccaaacagtttgtatccacctgctttcagaggaggaaccaaaggccaaattactttgaggtagggcttagctggacctgggttttcctatgctcttttcatgctgtgttggagggtgtgtccactgccagatctgtgtaacccgtctgggtcaggggatgagtgacagcaaaccatcttaaaatttttcatgagtacatttaagcggaagcatacgggaatatgagtgcaaaagtgtggctgagccgcgtatgcccttgattggttttgggaagcctgagggaggcagccttcctggctatgagccatcgcctgcccaatcaggctaagggtggtgactggggtggtgaaggggcagctctgctgagcatggtctgccttatggcctgaattgtcctcaaggggtgtggactgcagatggtgttcacatgaaccggagacatcactctttaggattctactggcagcccctgaattggctcaacgtttgtggaggtggtatttccctgaagtactgagctttgttttataataattaaaatccttatttggtccaatttaatatagtttagaagctattttttttgaggcaaaccgtttttgaaaatgtaaattttgtttttaattaaaaataaagtcttagttaagaaaactcaggatgcacaaaactattcagactgttactttagctttctcccattacctcatcagtaatattcaccacattttgctaaatatttattgattagagtgttgaaatcaaattctgctctaaatgtgtgtgaatatgttggagaggctttgtgttcttcactgtgaaatgcaattgtgccttgaataagaaggtacctagaagccaaattaaagtaataatgacttcttattggctttgatttttcattgcagtatatgggattgtacagcaggaaatgcttatcattaatttctgatgttttttaaagcacaactcgaaacatttcgatcatacatacatagcagtagagatctgtgcccttcaggtacattgaatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttatgtccgaaggccttgtcagaatctgtcagactcttgtttaggtttagtgtgatcatggcgtcagagaagcaaagctttcaaataaatagtacttcaggaaatagaaatgattgaccaactttaaaaataatttttttttaattgcaatatgcagcttcagttgcccagaatcttagttccgtttctcattcttggtcttgagctggtcaggtgacatcagcagattagaagttgaatggagattaagtggattcaggaggatgttccacttagagcagtcttcaaaatgataaggtgttctagaagaaaggaatgtagtaggaactatactatgcctaactttctatcccagagtgtcttgcaagagtttaggagttttggaccctgtgtattggcagaaaagttatctccatcttaagcaggcatgacttttatacctgtgagctcatttaaggtgcatttaaacctaaaataatttccctgtattatgcttcatgggattaacactgcttttccagaacattttcagattcccctccttacatcctgagctccttctgtatatacatctgttgattttatccatccacaaggaacaatgatagtcacattagagaacaagaaaccagtaatacatggtctctaactgatgattcgggcctggatttgattgaaagtgtttgcagttcctcttccgtagaatacagagtggatgaaaatgttttcaatgcacagaacaggatgaatccttttttctttatttagcgatttacacttttgttactctattatatattcagttagtgtctgataagattttctttgcttaaggagaacggacattgccttggtatgtttttttttttttttccctccacttttggagcttatcaggtaaaaatctcaagccacatgaattgttaacacctctgttgggaaaagcctttgtgagtttttatgtacttggtctttgtttttgttattcatcctgtgtcctccctcttcccgatgtgctgttttacctaggagttagtctgctttctgaggatcttttagagagaggctgtgaagtgctgaatcacctttaatgatacagcacttctgccatctcagcatctacataggacttacatagacttcctgaatgtgtcttcttcagatactaaagtacagttggatcattttcttatctccttttcttaagcagtactttgcaggtactcccctttgaaagccagaagcataaaccattggggaatcttaacttgtagacatgcagtaaaagaaatgcatttatgtaagatctgtgagtacttaaaaagaaagccctcagtgtgtgtgaagtgaatgtgaaatgtgtgtgaaatacatagaattcccaaatagtttagcaaaggcagggcgcaatatcaagtaatttaaaaatggtccaaggaactgtaagaaggaggaactaattctagaataaatgttaaaatgccattcaagaacaaaaccacagatgccatacagacctcctgtgcttaagttatagaagaataaaaatctgaatgaatggaaggccttacgtgtatacagtttacaaattcctatttctaaaatttaagtcccttatttaacagaagtatgtattttaatgcttaactgtctcgggaaacctcatttgtgacatcatctaaggggatgggaagactagggagccagtgccacgttgaacagaacagtggtttagtgaatgtgtgaggaaagacatgggcaactgattattaatgtttttgtaattcagtttataacttggaaccaatgaaaagcaacaaaactaaactggtttgacagcctgccacttctggcatttcctgtaagtcactagcagtaggtgtgaggtgggcttgcccatgaccaggaggggtgtgtgtgtgtgtgtgcatgtgtgtatatgcgtgttggtctgcagtcacagcatacctttatgtgcatgtgtcctcgcagcttgggactcagcagtattctgggagggtggaggtgaactgtcccatgtattgtattatatattttttgagatggggtcttgctctgttgcccaggctggagtgcagtggtgcgatctcagctcactgcaacttttgcctcctggttcaagcagttctcctgcctcagcctgccaaatagctgggattacaggtgtgtaccaccactcccagctaatttttgtatttttagtagagatggggttttaccatgttggccaggctggtctcgagctcctggcctcaggtgatccacctgctttggcctcccaaagtgctgagattacaggcgtgaactaccgcgcctggccccatgtattgtatttttttcaggttatattgaaatctactaccaggaatgtcggaatgggttttggtatgtataatggaaatagatagagtggttaagtctagaaacacatacattaattgtattgaaatgttatatcaatacatcatttatgatgtgtgtgtggtcccagacctcatggccaccagtttgtttaagcattgtgaatgctttttaatagcattcattagcattaatggaggaggacactgtgttttctcaattaatctcattgatttgtttggtataagtttgggtcagaaatgaaactgccaaaacatcgatcagtacaaggaagggacacagggcttaaaatgtccacagtcttggcagtggacttggcagttctcccagtaagcagaagtacttgagcttaattctgaacttcaaagtaatattttatacttaattttaggagttttcatttacatattgaaaaatgccttgactgtattcacataaatggtgctaaaacattgtaccccttataagaactgcagcaatccacagtaatgttggttacttctgagtatttgataaaggaacaaagtcaaaatgaatgtatttaataagcttctttctcatttccattgtttttataaaaatattttggtattgttgcctgcattttagccacttctaactttttgtattatgaatttggagaggataacaagccaactttagaccctctgccagtggcgatggtgtttttcttccatgggtaagccattgtgaatggaggctggtggagcagcacactgtgtgaacctggcagcgctcatcttggcttgtttagcagtgcctctgtttacaccataagatgttccgcatgtgtccaaaatttcgcctgctctgaaaaacatgcccccgaggctctgtgcagtttggggccttggttcccacctgcagatgcggtcagttgcctggctcctggggccagagtttcctctgttacttgttgagtctcttgtcttcactgtcagaagctgaactgacttgggggctttgctgttgatccactttagcaaaccctgctgcagaggactgtaaaaacaaataactaaaaataaacttagaaaatacaactcagaagcctggctctgttgctgtggtcaaatgcttgcctttgaggactttggcagattgtgctattacattgggctctaactttctggcacccgcaaggcagacctatgatgtccacatggctgactcttgacccctggccattgtgagcagaggaatcaagggtttagggaggcagtattgggcagtgtggaagagttagatgagatgaagcagttagcacagtgcttaacccatactaagtgcccccaaccctgccagccaaattaggtgcatagttttcagcttgggtctggattcaacagcattcccgctgcccactaaaagggtgggcttggacagttcctgaacctccctaaatctgtttcttcatctttaccacacacagtctgtctcagtggtggtgtggattaagtgaggtgctagcacttattaggggaagatcctccagacctgcaaagcagggctgcagccccaattctgacccagccctgctgtgtgtttgccgcaaagaggtttggtgtgtgcgagacatttctttatgaaccatttacactgctggaaatgtacccactaatgtgatggcaagaacttcaacaaattgcttatgaatcaggctctcaatggaagaagttaatcctctgaagagggggaagactggactttcagaagtatgttggggatagagaatgaagtttgagtcagcagagctctgccttcctgtttgtcaaagaactagagtctgggagtcttgcaagatggagctgggcttctgaagaacccagtgggtaggtactgggcatccattagacggcagtgctaagtcggtcatgtgcagcagaaagacctccccactgtgaacaacaaaccactttcctcctccagtggcccattcatttggattgatacactttttcagtgtcagaaatgcactttctccctctacttgtctgaattacgatgctctgctcaactctgtggacagtgtttcttgaatttccttttccaccgccttttcccactcaagaaagtggagagaaaaacagggatgcaggctgtgggtcttgtggaagccctttacaaccattaaataaagaacaccagctgcattatgtgtgtttagaacgaga

SEQ ID NO: 2664 - DNA, 194572 bp, Homo sapiens
  source 1..194572: mol_type = genomic DNA
gtcctatgaaaatgtttttaattttcatcttttggaaatacatttttcatttttatttccaccatacaaaaatgtgaaatatctaacaatgatctatctgaagcgggtggagcaaagcagcgccatgagcgtttgtcgttgctgtgatctgtttcaacggagaatgggctgggacatgttgtagatttgcacgatttcacacacacacacacacacacacacacacacacacacacacacacacagacacgtacgcacacacgctgccgtaccccgagaccgccatccaaacaaacgaacagagactctggaaagtgaacacagcgccacgcataagaacagaagttaacctttttactcgtacatcccccatgagaaactcacgtcttaggagaaaggaactctacataaatatgcccaaaggccagggcatacggcaagccctctcatgggtgggcatgagtggacatcttcctgaaggaaggacaagcttgagagcgtcatgttttcaggcagctatggtgggaagcagggaggcacaaccgatttttccactgggagactaaccgagggctgcaactgcctcaaaatctcagtgcgagaagatgcacaggcaggacagtacacccccaaattcatgatcacagcagctggaatgtcagctctttttgcagatttcacagccgacactccccatcaggcaggttcttaagcacactgggtcatgacaggaaaggcctcacaagagcaacacggaattcactggttaagcacgtacacattcatgacagcctacaaccgtgatgagtgtcaatgtcaacaggcagttagattaaaaaggggaaaaaaccacagccacaaaaataaaacctgttttctcccccccaggagacaacttggtttccaacccctcccataccacatttgattaagttaaatacagtgcggcttccaaatgtgccagccggctcttgctcacagcgacagcaccagcggtttgctgccctcaggtcttggttaccatgtgtcaggaacttcaaagagtgtggcagggctgttcttcgagatgcttcctggtgggaaagaacaaaacaatatgaacagcaggaccaggacggcaccttgaggagagcatgacatgaccagcagacagacagagggcctgtgacggctgcagacggggccagcgtctggctaaacagctgcgctggaaagagtccacagacaggtcttgtctagggagggcagtgcccagcatgggaaagtgaaaccacagaaacatcatgggggcgcggaggaagcacctccctgcctccagcatctatctatttatttcacaggagttaaactgtagccatgcacagtattcctcactgaacaccatgctggattctttgttggcaatacagcgggcatttaattcatataatcttcattaaaagcccaccaaggtggtaacactaccccattttacagatgcaagaacagattgagagaagtggggtaatatgaccagatgtacagagctagcaagtggctgagatggggtctgaatcctcccacagcaccaacatccctgccaaagtccctggaaactgagtttctctgtgctgtgctgtggctctgcctaggtgagaaatctcaggtgggcagctgaagggcagagggaagccaaccagtgggggttccaatatctcaacaggggcaaaagaaggttgcagctttttccagcttcggtgaagctggctggggtcctcttcttggattgaaaagatctcttcagtgacaaagtttcaccccaatgtcagaagcccttcttttttattcatgccactttctacaatacgagcagctgcggccagcaactgagctgggactggacttcaacgaatgtgagggaagtcaggaaagagcatgttcataatggaaagtgtggcccgaccaggcgtcagctgcacaagtggtgccatgcattaagtcataaagtagggctgacgggggaaactggcagtctctcttctagctgctaacaccaagattttagaaagggagagaagtctttgatgatacctccaatgggaaataacttttaaatacagagggggtgcagtgtcttacaaactagggaatcatatcactgagttcacagtggttatcatcagtaacagggatgcttaaaaataacgaggtctgaacacaagaaaaaacatgaagagaatttcagctaacatgagaatttctacttctgatcatttactgtgataagatccagggagttagggtgaggagaccgggaaagggtaaccggactctttctgccctgggtctcatcgctctgaacaggcacgttctgggacacccagtaaagatggcgagaccactctggagaagtgaagatgggcaggagatgatccactgaaaaggactcatggggtccagtgaagtactgcaaggggcctgtgataacctgcagctagcctggccttcccagtcccacaatgatacaataaacacctaactgtatgaaaagaaacatccattaagggcacttttataattcacatatgaaagaaatattgcagtagccaattagccattctaaaggtaaaagctacaatgccaaatgtggggaactgaagtaaattaaatccagctcagaggaaaaaggaagataaattgctaaaagcaactgcactgcaatacttgtaatctgcacctgccaatctgcacctgccattagttgggggggggggtgtgtgagtgcacagtgagccaccagacacacaggaagtggttccatgaagagctaacaggaaataatggaataagcaaaaagttctggagtaaggcaagtcaagttggaccattttactagctggatgaccttgaacaggtctcactgcttcgtctaagatggacccagtactattttatgctgtataggacttctgtgatacagcaaagttgctgggtaagtttttaatgaacgctaggtctcttcccctaatcaataagctgatccaacatggaacatggctgttccccagaaagccaacagtctataatcaaaaagatgctagttttcactgtctacctgtacagctgctgagcgagaatgatgtgtacaaaggggccagaactgtaggagccatctacaggagacccggaccagaggggaaatgaaggccactaacagcgttctttccagcaccttccagaaagggagagctgtagatcaacaaacggccagtctcaaaactggcagataagaaggtatggtttttaaaaagcagcagctatggtcagttttccacagaactcattttcacagccctgttttactggagtgtaaggaatcatttaggaacaacttttctttttaaacagatacttggctgtgtgtggtggctcatgcctgtaatcccagtactttaggaggctgatgagggaaggcttgagcccaggagtttgggaccagcctgggcaacacagggagaccctgcctctacaaaaaatttacaaatttgccaggtgtggtggcacacacctgtggtcccagctacctaggaggctgaggtgggaggatcacttgagcccaggatatcaaggctgcagtgagctgtgatagtgctactgcattccagcctgggtgggtgacagagtgaaactgtcgcacaaaaaaaaaaaaaaaaatagagggagggagggaaggaaagaagacagggagggagggagggaggaagggagggagggagatacttaaaaacacctgccttttgctacagtggaccttaatccatagcttgcattatatacaaagattaacttgaattgtacattttaattgtaaaacctaaaactgtaaaacttctggaagaaaacatagaagaaaatatttgcaacttagagttatgcaaagattttttagatatgacaccaaaggcaaaatccaaggggaaaaatctgataaactggacttcatcaaaatttaaaactactactcttgaaaagacactgttaaaataatgaaaagaggctggctgtggtggctcacgcctgtaatcccagcactttgggaggctgaggccggtggatcacgaggtcaggggttcgagaccaccctggccaacatggtaaaacccatctctactaaaaaagtacaaaaattagctgggcgtggtggcaggcgcctgtaatcccagctactcaggaggctgaggcaggagaatagcctgaacccgagaggcggaggttgcagtgagccgaaatcgtgccactgcactccagtctgggcgacaaagcaagactgtctcgaaaacaacaacaacaacaacaacaacaaaccaccaccaccaacaacaacaaaatgaaaagaaaaaccaacctagaagaatatatttgtaaaatgcttaaaaggacttgtatccagaatctataaagaactctcaaaatgcagtcagaaaataaacaaccctagaacaaagggaaaaaatgaaaagatatttcaccaaataagaaatctggatggcaaaaaatcacaggaaaagatgcttattagtcattagggaaataaaaaccaaagccacaatgagataccactacatacccattagaactgctgaacaaacaagcaaaaggggtgtgtatcaatatcaagtactggtgagggcgcagagtgagctgaagccttgtatactgctgggggaaatccaaaatggtgacgccactttggaaaagagtgtatcaatttcttatgaagttaaatatacagttaccatatgacccagcaaccccactcctagatatttacccaaagaaaatgaaaacttaattcatacaaaaaacctgtacacaaatatttatagcagcttgattcttgattgacaaaaactggcaacaacctaaatgtccttcccctgggtgatggataaatagtgatacctgtatacagtggaataccacttagcagtaaaacggagtgtactgaggatacacgcaccaccacaaatcacaaatgcatcatgctaaatgaaagaagttaaatgaaaggctcaaaaggctaactatcgcatgattccaggtatatgacattctggaaaagacaaaatcgcagggacagaaagaagaccaatggctgctgggatctgtgtgggggttgggggaaggatcaactccaaacgggcatgagggaaatttctggagtgatggagttgtatatcgtgatcatagtggtggttatatgactgtacacagatgtcaaagctcatcaaattgtatacctgaaagtgatgactttcattgggtacaattatatcttattgaagctgacctggcgcaagatattaaaaacaatgttttaaaagaaaaccaacaaaattttaatatgaaatactatgcttatagttaagattatttggccaagagtttctaaaaggggaaaaggcaggatacaagctgcatacagggtatgaggttggccgcagagcaacaatgcttgttaccacagcatcaagttgggggctgggggcttaattgtcttctatttttctgcattttccaaattctcatgctgagtacattatttttattaaccaaaaaaacaaaaaattaaaagacggggaacacaaaaggtgaatatttctgcttttctcccctttacctaactggagttgaaatggagaaacttgaaggggtaaggcattgctttttccaggtgaatcccaaacggattctaagaagctgcacaggacactggaagcttcccattgtatcctcttccacagagtggacatccgtacacaggaaggtcctttgggaagctgcactcaagtttctaactaggaaacgctgaagggggtacgccctggggccggtttcccacactaagaaggtgagccccctccctgcaaggctgatgacatcttggagttgccaggaggaacagggagggcacaaatgcgcactgagtgccctgcctctgcctcactgcacagcagcccacacctccttcgccacgttcactgcaaaccacacttgaacatagtaattaaaaggctccttgggaggccgctcggctgcctcagcctggtctctcaggtgaccgacagcagcagctgtagatcttgtttctgactttaaggagaccagtaacagcatgaggagactgctgctctaattaggttctaaatttttatactgtaacccttagggtttcagcttgaaaagttcagcaggttagtcaagactccaataaaactccaggttctttggcaaacacttaaaaggcctaacatgttgttttaaatgttaggggaaaaaagactttgaacaatgtctctatttacaggacaaaaaataaccgggaatagtcaatgtatctcctttgggcatgcctctgtaaacaccatctaactaaggtgctgatggaacctgctgctagggaccagccagcagtattttcacaatggtcagcccaggcagcatcagaccatccatgcggccctgagattctccagagaagtgagggggtgggcaatttctccaggtcccaggaacacatcaacaagaacaagtatgtgacagaaatccttcaattaaacatgacctgggaaaacagccacacttcctgaagacattttattccagcattaatggcatgcagagtagttttcctttgcgtaccgagtatgtacctagaactgcttggatggaaagtggctggcactaccaatcaacagtcatatcaacaaaaaaggaggggacttatgctgtacattcacctcctgaaaataggattgaaacaaccatacttacaagaaaaatatttgctgagtacatagtatacacataaactagaagccctgaaggagactggttacttggctttccctccctccctccctcctctctctttctttgtttctttcttgagacggagtcttggagtcttgctctgtcacccaagctggagtgcagtggcaccatctgggctcactgcaacctcagcctcctgggcttaagcgagtctcctgcctcagcctcccaagtagctgggagcaccaccattcccagctaatttttgtatttttagtagagacagggtttcgccatgttggccaggctggtctcgaactcctgacccaaggtggtggactaacaggcgtgagccaccatgcccagcccgcttggatttctatccagtgactttatcacatgaaagtctagattggtaattgtttctgatctagaacagctgcaagaaacattcacctttgtaatgaatccttcatttcctctaaagtctggatgagtttccccagcctcccacatgtcagttagatacttttaagtctgcaactctaagcctcagtttcctctgtacaactgggaaagagtatctgcaccttactgcatgtttaaaaggtctagacaagacaataaaggatgttcctagcactctgtctaatagtataaacccaataaatagtcctttcttccactatttttgtcattttgttatctgggattgggtctagtacttaattcttagtgtatcttcgatatcaaaatgtatactatgagttcatgtgcttgggtaaagagaaaaaattaaaagaaaaagaacagatataaagagattactttttttttttttttttgagacagagtttcgctcttgtaactcaggctggagtgcaatggcatgatctcagctcactgcaacctctgcctccctggttcaagcgattctcctgcctcagcctcccaagtagctgggattacaggtgtgcaccaccatgccaggctaatttttgtatttttagtagacggggtttcgccatgttggccaggctggtcttgaactcttgacctcaggtgatctgcccacctcgccctccagaagtgctgggattataggcatgagccactgtacccggtaagattaaattttaaaaaatttgttttgtgtggtatttgttgagcatcagttgttctgggattgctacaacataggatattccagcgtcctaatttttgctacttcctccttggagaacagaaaatacccacaggtagtgcccttttatgtctttcatgccctcactgccagtgctgggcccccaagcccctgaggatctgttgagtacctgctgagatgcttttctgagtactggagctcacacccaacgcctcagcaccgttttgggttggacagactttgtcgcgccgtgcctagcactctaatacagttcccgccaccacccgaaccagaccttcgcggctcctggcacactctaaatacttctgagagtttaatgcagaccctcaacagggcttgaactttgtactctcactcattatgggaccttattaaagtaaatgagcaagccaaattggctgattccacaggttctgcacctgatatcctgacctatatcctgctgatactaataggattaaacactgaaaacaaaccaggtggaaaggatccattaagtttccacctggcaccgtcaggggtcttgctcgatgaatggtgctccagaagaaagctcgattcactcaagttctctgattcaattaaaagttgtcaagatgtctctttctcttttttttttggcagcactgacaaagaagtacaaaatctacaattttttttttagctcaaatcttgtggcagtgacagctttactgtcaatgggaggaaaaaaacccttattttaattacagtattataaattcaaaaccctaaataacttatagaaagttttcacttaaaatgatgaaagctataaaaggaactaatctattaatgcagtctattattagttattttaattttaatatttttcagattatgctgatatagaggggaaaaacgaaaagcttgtccctgaggagtaataaactaaaaaaatccagaagagacagctatgaaggacaggaatacaagtggggaaacccccctgcccctctaaatcctgctcagtacgatctctagaaatcatgctgacattcattattttaacatttgttgagcacacgaaacatgacagtggtaataaaggtatgaaatttgaagactaaggatgctacagatttaaaacttctccaatactttttcttctttcttttcttgagacaaggtctcactgtgtcccccaggttggagtgcactgatgcgatcatagctcactgcagtcaaaactcctgggctcaagcgatcctcccgattcagcctcctgagtacctgggactacatgcccgtgcagctaatatttaaatttttttttttttttttttttttttgtagagaaaaggtgtcactatattgcccaggctggtctcaaactcccgggctcaggtcatcctcctgcttcagcttcccagagtggtgggattatagttgtgagctaccatgcctggccccctccaatagttaagtcagggaaaggacaggaggtaagtaaagagagacacccagagtcaagagacagctaaaacatccaatccaggcttcaaacacaagtttaagttttctgttgaaattcagcttcagcataatgtacaaaaagcatatgtgacatttttgctacttgtctgatttcattaatatccatgagattcagaaaactccccacagtcagatcgggccacatgcaaaaggggattaattaaaacagtgcattcatagcttgggtatgaatcaagttccaccacttgactactactttcctttgatttgattgttagttctgctaaccgtgacaactgtcacgatgtgagacaaaggagaatgattataattgtgtctgggtcagtgtctctcaacacataaccttggttaaaagcactcactttcttttgtgtgtgtgtatgtaagacagggtgtcactctgttgcccaggatggagtgcagtggcgcaatcttggctcactgtagccttgacctccctgggctgaggcagtccccctacttcagtctccttagtagctgggactaccggcatgcgccaccacacctggctaattttttgtatttttagtagagacgtggttttgccatgttggccatgctggtcttgaactcctgacctcaagtgatccacccgtcttggcctcccaaagtgctcggattacaggcgtgagccaccgagcctggcctcaccagctttcttgtaggacagacttaatggctctgggactttgggcaactcacataaccctttgggcctccgttttcttaactgtaaaatggataatgatgactgtctcaaggatttaaatgaaagaatttcagttacacattaagcactgtcctggctccagtaataagcactcaataagcagtggctatgattactgtcactgtgactgctgccttgctggaccgccccctgcagcagggaatggccttttccatgtgctgactgacaagatgcccttctggcctcttgctgtggccctgtgtggcatgtgtgcatgaagggctgagtgaggcacatctgcggggtggagaggacatgggattcagctcaggcagacctgggtctgcctttcggctgtgcttcttaagcgcagcatggccccgcacacttagcctcgctgagcccaggcatctgcttcatcaaataaggatgatgattcccacctcagggctacggtgaaaattaaatgaaataaggagagaaatggctcctactacagcgtctagcatgtagtaggctctcaacaggtgctaatttcctgtttcctttgcttcttatataattctgcttcggagagaaatccaggttgcctgggggttttgctggaaacagtgaaaacgctgctactgaaaataacatgtaggaggggcctctgcgcacatttaaatgcacattttaaatattgaggctgctttaaacacatcagcaaaacctctacaccatggaggagagagagattaccaaaatagactagccatctttaacaaggagaccccccaggccttatgctacccgagccagagctttttaggattcctcaaattaaattaaattgatcctaaaaatatctgctttggtggaagactacatgggctttgccaccaagtgaagccttgctataatttctcccccaaaataggagtttctagagcatttaaatagtccacggccccagaacttcggcaagatccaatacaaacctgctggagaaagctccttcttcattctttttaatttcttggcctttttccttccctctgagaggggctctgcacaggaatcggtctgctcaagctcagtgtcggaaatctcccctgacactccgtcctccaggccagcttcctcttgactaggactcaaatttctctttcctactgtgctgggagctgtaaaactgaaatgcaaaaagtggaacaacataaaaggtgctgagagttacaggaagactagtctataaaaatattttaatactcttaattctattaacactcagccagccatcaacaacatgggcagctgctgcctgtgtgtaaaaattaaagaccttattatgaactgaagtctgaaagtttacctataacaagcttattcagaaaaaagtcctaaattatgcttgtaaatagatatacacaaatttaagctgatccgagtgctcaagaacaaatccgtaaagtagcctctattttgataaaactattgtaacagaatagtagaatagaatagtagagataatataatgaaataatagttttggttacattaaatcagaagatagcattattctcttcatgactgcctaatgcataaagagcagaactgaagaattcttcaatcagtctgctatcccactgcttaaaacttggacatagctacagagcataccccaccttcatgtaatcttcttcctttccaaaaagatgacttgttaaatgtataattaaatgtttcattttgaaagctttataggctttgacatattgaattaaatcagattatgtgtcctgatttttccttacgaaaatgttcccttaaatataactagataaaaacagcgtccacatagccagtgagtcctttctcctctaaatgggtcttagagatttttttattatagcccccaagttatgaaagcctcaaataaattcaaggcattctatttaggagaggccattcaagcacatggggagggtgggaagtgagagataaaatgatcttaccagcttttcctaggaggtgggtacttttaaattttatctatctatctatctatctatctatctatctatctatctatctatctaatctaattatttttgagacacagtcttgctctgtcacctaggctggagtgcagtggagtgatctcggctcactgtagcctccgcctcccggattcaagtgactctcctgcttcagcctcccaactagctgggattacaggcacccgccaccatgtctggctaatttttttttttccctgagacagagtctcgctctgtcccccaggctggagtgcagtggcacaatctcagctcactgcaacctccgcctcccgggttcaagcgattctcctgcctcagcctcctgagtagctaggattacaggcatgcaccacgaagtctggctgatttttgtatttttagtagagatggggtttcaccatgttggccaggctggtctcgaactcctgacctcgtgatccgcccaacttggcctcccaaagtgctgggattacaggcttgagttaccacgcccggcctctgctaatttttgtatttttagtagaggtgaggtttcaccatgttggccaagctggtctggaacaatggacctcaagtgatctgcccacctcggcctcccaaagtgctgggattacaggcgtgagccaccatgcccagccaggaagtgaatagtttaaaatgttccacataaaaaactctggctacctaaatattcaagttcctccacattactcctgcactcaacatcttccctgaatctgccaagtgcacttgataggacactcaggggacagaggagaagaacacactgccttcctggtggttctctaaggcatgggaagcagaagaggctggagcactcttcctcctatgactggctggctagcctttcatttgtcctctttttcatttctattatagacagctttctgaaacatctaattgagggactataagggaggatattaatggtaatgtttcggcagtggggggtggctgttaaaaatgtatgctgaagtttcctgtttaaaaactggtaatacctttaagaagattttttaaagactagaaaaagttcggctgatttcagaaaatttagaaaattcaggaagtacaagaagataataagggttcttctatcacgaaaggggaagaggcctaaaaattccttcgcattgtaaattcaggaacctggtagcctctgagacatacataaatgtttaatgaaaactcagctagaaccacgggcattaaaaatactctgtgaaatacaaagtctagaaatagccccaactgtacctagaaatctactgtatgataacagtggtatctctaaatactgaggcatatatggactttaaaataatggtgttgggacaagcagaaaaggataaaattagaaccattcctcacaccatataaaagaataaatgcctaatggattagatatctaaatgcaaaaaaggcaactttacaggtactaaaacaaaacgcgggtgaatgcctccaaaatccaggtgtagaaaaaggttttcttgccatgtctcacaatccagacataataaaggatttatgaatgtgacctcatagatgtaaacatcttttgcagggcaataaataacgtgagccaagacaaatgacaaaccacgaggaaatatctgcaacatgtatcacagataaagggttaatgtctctaataaattataactcaaacttgaagagaaaaagaaagaccaaaagtcctatagaaaactaaaaaaggtatgaataaacagctcattacacacactccttaaacacatgaaaaaatgttcaactccattcataatgcaaaataaaacaacactgaaatatcacttctcacccactaggtttttagactggcaaaaaccttcaaaagcttgataatatactccattagtagactggggaaatgggtcctttctcacattactggtatgaatgcaaaatcgcatgacttattcttatggagggaatgtggcaatatctaacaaaactgcatacacttccaggaatttagaagatatacctcctacaatgcaaaaatatgcatgtacaagttattcattacagcattatttggaattgcaaaatactgcaaagtacctaaatgtctaagcataaaaaactggttgaatacgcaacagtacatacaatcaatgaactactaagcagttaccaaaaagaatgaagatctcaaagaaccgaaaatgattatggaaagatttccagtaaaatatgtgcaaaaagcaaagtgcaaaagaacaacttatgaagctggtatgcccaatcttgagtagggtgtgggagagaattgcaaacaaatcctgaaccccttagtaggcttgcttctgtagtagaatgagtgaagcaattctgaaaacacttagctgcatgatagcactgggtaaatcagtaaatgtgctgatgtttctggcagacagacataaaaatattagaataagggaagataaggaagaaccctctgaggatagactgaaattggagatacgggtttaggcttgtgatttctaaaataagtatgagtatatgtgttcatatttatgtatacacacacacacacacatatatatatacgtatatttatgcagggatagataattgtatctatccaggcacaaaattcccagctctgtctacagaaaggacgtagaagcagagacaccagagtagcaatgagcatatctattgtccagatcttagtttctaataccctactaaaaggaaccagggttcctcaaataagtggatgattccaggctcaagggagataaattataaaatgagtctaaaatattttgcaataccaagaagtaaaaaacttttaggcatgtcacagggaaataggaactagcttgaaaggactcccactgggaaaatctgggacaatgtgtgccctctaatttattagggggcagtaataaattctgaatcattgaaaaaaaaaatagcaatccatgagtctacatcaatacgtaagacaaggaaaggaaaggaaagaaaaactccgactctccactataaacctaaatttaaactgcttggcacagcatccaggatcctctatcatctgggtcccaatctgctttcctggcctatctttcactaggcagccaagctgcagagactatataggtttacctaatgaagttcatcgtccgtactctcccacatgcccgtcatcccaccagaagtttactggcccaaatacatcccacactgcccatttcaatgttaccgttcatgctaagaccctactgcccatctcctcctgctcaacatcactctcctccgggaatgttcccaatccctgtttactgttctttcctttccatgcttcccataaactctgcttttctgtctcatgaggactttaactcgttcatcttattttttataataaactgaaactaggagcagtgcatcaacaggagaatggataaactgggctatattcatacaacgaaatataattcagcaattaaaaaatgaattactgttacctccaacaacacggatgaatctcaaacattctaagtgaatgaagccttcacaggaaagggtgggtattttataaacccatttacatgaaattccagaaaaggctaaactaatcttcagagaaaaaaattcagaagaatggtgggtatgggagggtaggtagggattgactggtagaaaatgagggaattttctggggtaacgttaattccctgtgtctttataggagtatagttttgtcaaaacttctatcttggccaggtgtggtggttcacacttgtaatctcaacacttagggaggccaaggcaggaggattgcttgagcccaggagttcaagaacagcctgggcaatgtggagaaaccccgtctctaaaaaaaaaaaaaaaaaaaaaaatacaaaaaaaaaaaaaaaaaaaaaaatacaaaaaattagccaggcacagtggtggcatgcctgtagtcccagctatttgggaggctgaggtgggaggattgcttgagtctgggagtttgaggtttcagtgagccatgaccagcccactgcactccagcctgggtgacagagtgagaccctgtctcaaacaacaacaacaataacaacaaccacttcatatctcaacatcatgtggctattctacggacatggagattgactaattttagcattaacttcaagcaatgattttgaaggcacttactagaatacattggttgtatcctaaccacagattatggtatttttggccaacaagacccatgcatttgtaatgctcctctccataaacaactgactgctatgcaacagggactctgccagatgtgcttctgcagggttcttgtttctatggaacatttaagtttacaaagcattttcctgaacagtttctcaattaatttacaactttatttatttatttagagacggagtcttgctccgttgctcaggctggagtgtagtgatgtgatcttggtacactgtaacctccatctccatggttcaagtgattctcatgcctcagcctcccagctaatttttgtatctttagtagaaacagggtttcaccatgttggccaggctggtcttgaaatcctgacctcaggagatctgcctgcctcggcctcccaaagtgctgggattacaggcgtgagccaccgcacccaccctacagcatatttcttaattgctaatctgtatttctgctctcaagtaagtcttttgcttcctaggagaggctaatggttattgggcatcctgcctgagaaagctctcagatatatgtggaattagtttatttcatataatgtttctgtatctatatgtatgtaagacctgccatcctctaataaaaataaaagctgtgattatatcccatataacttaactacggcagttttaaataaaagttttaattatacattaaaaaccagatatatgtaacactgcctttacaaatgtgattctttatatatttggaaggtactgctgtgcatgtgtgtgtatgtgcatgcgtgtgtgtagcactctcaatacctgcatgttgatgaggcattcttttattaactgattttaaaagtcaaaaggtaaaatgagaggcaaaacaatctcccatttgtatgacctcattttgcatacagatttataatgtacaaagtgagctagtttataatgaataagaagtggacatttaaatccactgtaagaagtggtgattaattaaaaaataaaatgtcacagacacaacttggtatgttaaaattgaacattaaactttgattagtgttttgttaaaagctaagtcgctgtcaactatccatcaaattccacaagggtgaacatctccagtactttttccttttagtagaaagaaatgtttgcttatagaaaggccgtattttcaaacccctacaaatacctttttccatgaagcaataacaaaaatctagctgctacatgaacatattccccattttaaattagggtattatttacatgcaatggaattcacttattttaaatgtacagtttggttaactttgggaattgcttataaccatgtaactattactacaattgagatatagaacaataccctctccctaaaaagattcctcgtgtcactctgcactcaatccacattgtcacagcaactattaatctgcttatagtcctatttatatagttttgccttttccagaagttcatgtgaatgaaatcatacaatatttagtcttttgtttgactcttttcacttagcataatactttgagagtcagtcacatggctgttagtattagtactttatttcatagtatggctggatcacaatttattcatttaccagttgatggacatttgggctgcttccaactatttgtcattacaaataatgctggtataaacatctgggtaaaagctagcttttattattaaaaacataagtttttatttttcaaatataaatacctagaaggatttctgggtgatatataaaaatacatttgcaatttatgtttaactttacaggaaactgccaaactatttattggccatttgtatatcttttttgaagaatctgttgaaatgttttgacctcatcccccttttcaaaaaactgggttgttttctgaattgccgagtatatattataagagtacatatgatcatgatacaactattttgtatgtagatacaactacattattagatacgcagtttgaaaatttttggcccggcatgatggctcatgcctgtaatcctagcactttgggaggccaaggtgggcggatcgcttgagctcaggagttcaagaccagcctgggcaacatggtgaatccccacctctaaaagaaaaaaaggaaaagaaatttttttccacagtgtgtgccttctcttcacagtttcttaatagtatcttttgaagaaaagaatatttaattttgactaagtccaatttatcaacatttttcttttatggctcatgcttttgttgtcatatctaagaaatctctgcctaatgcaagatactaagatctcctttcatttttttcttctaccagtggttatcattttagttcttccatttagttctatgagtcgcttcaagttcattttaaatgtggtgtaacataagaacagaaatgtggtttctggcatagttacccagttgtttcagtactgtatgtagacaaagccttccttcgcctactggattaccagcacctgtgtcaggaatttttgttttttccaaattctcaacagtcattagcttcaagattcagaaatgagaaattcagaattcccaaatcataaaatattctgcatttttcatagcattgtgttacatgttgttgaataatgagttataaatagcaaatcacttttatgtgatacacttatactgaaagcttcaggggtcagttctataaagtaagatataataatatatgcacaggttattattatgaatgaatacactgtgagaaaagcacgtatttcaataacacataaaaataacctctacctgatatagacgtttgttaacagaaaacattaaaaacacagtagcaccaaatgaatgccaaatatcatttaaaaattgaaagatgccacaaatatttaaaagttattcttaaatgatactttaaaacacacaagtattaactaatatttgttttgtgaaaaatattccaaatgtagaaaagcttctttcattttatgctgaacattggtcaagagttggtcaaactcttcagagtggtgtccaaagccaactgcagttaggatttagactatatacggcttcatataagcccaattcctttcctagtgttgaaaatattttgtctgcttgccttgattttgctcttaaaattgatactgcttttcctaattcaaattttatatcagctgatttcacattaagagtattccacaatcatattcacacatcttctctttacatttctcctgtaaaagtatttacaaagaaccgtagcctacattaaatattcaaacactggaaaacaccagtgaacattattggattctatgaagataatgtaacatttggctatcctagcaaggttaacagcactacacaggaatcacgcttcaaagctaccaacttaagggctgctgccaaaacttacatcttccaacaagacttggaggattttgtaaagtatactcatgtgcaaaactcaatagatttttattgagaagaatgactcactattaatagcaggcagggccataaacatacacttgcaatatggtgacagtgacaagcaagaatgacgtgattggaatgtgaccccttctctcctacatgttgctgtcctggttctgaaatgacgaccttaatctctgactccatgtgtcgctgactgtgctcttgcctttgacctgatgctggataattcctttaaactagtaatgcccatgttggctgttaaaattttagttctcgcagaatatttccttttcctgatttcttgactcatttttctcacaatttggaataagagacaaatgtctctaaatgccaagaaggaattcctgcatggaaaaactatgggaaatcaactgatcacacatatgtggttgtattcttggactctctattctattttgtttcactatctgtctttccttacccagccccacactgtactactacagttttacagtaagttttcttttttttttttttaaactgatggggtctggctctctcacctgggctagagagcagtggtgcaatcacagctcaccgcagcctcaacctcccaggttcaagcgatcctcctacctctacctcctgagtagctgggactacaggcatgcactaccacacctgactaatttttaatttttttgtaaggatgggggtgtcttgctatgttgcctcaggctggttttgaacttctgggctcaactgatcctccctccttggtcccccaaagtgccggtattataggcgtgaaccatcatgcctggcctacagtaagtcttaaagacaggtagagcaagtcctttagttggctggaacgttcatgcgctgtataaaataacagtaccctttcattttaaagagctgctgtttgcaacattctcatatttggtaactgtatatgacccttttaagctggacacatgtacactcccattttgcagacaagaaacctcatcttcagggtaaatgacctcccccaggtactgcagctgggcaggtggctctgagattgcactccaagttcaatgttcttggcactgctttataaactcccatcttcctagggccagctctcctcactgtgccggtctcaacagaaaagagacccccgcaccatccccacggaggagccgaaacagccacttaccttgtcacattcattcctctgccctgttttattttcctcctcctactcgcctctgccttgcctcttatttatgtccttacttatctattctctctctctgtcactagaatgtacgttccatgagagcaggctcttacactgcttgtgctctccgtacctggcacagggcctggcatagagtaagtccttggccaaggtttgctgaatggataaaataaatgaaataagtgaaagctacctccctaaaagcaataatgcaagtgacaaacaacaaattgcttattttatcctgaattagaaataatatgaacatagtttacattccagtgtatgggcagcttctcctgctaggctgaatgaaagcacattccctactagatgtagctaagggattgagggaaggtcccactgtgcaaactacctcacacagcaaaatgaactggagagatccggtaagtgggagctagaaatgcctttttattgtgttcacaaactttcatggtgaattcgaattccatgagcatgactgtttctgtgtttggggctcaatttaggtgggagaggggaggatgttggacaacctatgctcagttcagaagccaaaccctcggagatcactgataaaccaggattcttatttctaataaagaatttgagtcttggggccaggcgcagtggctcacacctgtaatccctgcactttgggaggccgaggtgggcagatcacttgaggtggagttcgagaccagcctggccaacatggtgaaacctcgtctctactaaacatacaaaaaacagccgggcatcatggtgtatgcctgtaatcccagctactcggaaggctgaggcaggagaactgctcgaacctgggaggcggaggttgcagtgagccaatatcgcaccattgtactccagcctgggggacacagtgagactctgtctcaaaaaaaaaaaaaaaaaaaaaaaaaaaagagtctgtaaacaaacttaacattaaataaggtctgaatggtagctgtctggtaataaggacatctcttgtggaataggggtgtgtgtgtgggggtgtgtgtgtgggtgtgtgtgtgtgtgtgagagagagagacagagaaaacatgaatgcattgtgtatctgctccatcctagacataaagcttacttgtgaatacgaggcttaagaaaaaaattagttcaacattacaaagaatcaatagcattcaataagaaatacttttcacaagaaactattttgaatatttcaaacaatcccctattgtcaactcactttaacacagaaaagattgatgcaaacatgaaagatactacattaataataatttctaaatgtaaaatatattatcaatatacaattagttggacctgaatttagaacatctgaaattttcagaggctaggatcaaatttacttttgtactaaaatttaccttttgacttcaatcaaaggacttactaatcaaattagtaacataatcaaggctataagaaaaacaaaacatcatccctgcaaaccaaaaggccaactatttcagaaaataaactactttttaaaaatttccaggaagttaaacatgagcgattgaacacactatttatctgcagagagaagataacacctatggaggaaaagagaacaggagaggcagcatcagagaatggggtatcagctcaccttgcaggcactctctttgtagaggaaaagcagggagaagagtggcaaagagctctgcatagaggcagaaacagaaatctgagtgctctacaaaaggcagattcacccaattaagccatgcaaaatctcagcacaaccaggccctagattcctaaaacgagcaggtgatgaggactggagccatgtcaggagggagcaaggctgtaataggatcccctaccccagggaagccagggcactggtatcaccccaggccagtaggagctagataggaggtttatactctggagaaagcgatctccgcaggctcagcggcaccaggtacaatggtgaagagtgacagtgaggcgaaatgagctgacgaaatggggtagccatcccccacataccgaggagtgaggctgtccagctcccttctgccaatctgtacccagagcacagcagttaggtttgtatcccccaagctgaaaatcagagcatcaatctctaaaaaaaactgaaaccttacagctaattcatatttaacgttgaaagattgaaagctttcctcctaagatcaggaataagataaagatgtcagctctcacaacttctattcaacaatgtactagaggtcctagccagagaaataaaggcaagagaaagaaaatgtgtatgggaaaatttgtactggggagataaatgcaaatgtctttatttgtagatagaatttctcaaacgaaaaatatccaatactctacaataaattattagaactgataagtgagtaagtaaggttggtttaagaatacaaggtcaaaattaaaaagctattatatttctttatattagcaataaatgactggaagtggaactttaaaaatatatgacttacaatagatcaaaaggtaaaatactaagggacaactccagtatagcatatgcaaaatttgcatgctgaaaactataatacactgatgagagaaatcaaagaaagcccaagtaagtgaaaagatacactacattcatgggttggaagactcaatgtagttaagatgttaattctcctcaaaatggtttacaggttcaacacaattccaatcaaagagctagcagactttttgtagaaactgacaaactgactaaaacttttgtggaaaagtgaatagaataaacttttatatagaaaagacaagattaaaggtacaatatttgatttcaaggctcactacaaagctacagtaatcaagacagtatggtattggtgaaagaacagacatatagatcaatggaatagaatagtgtccagaaatagacccatacgtatatgaccaaatgatttttgactaaggagttgtaattcagtaatttacttttcataaaatagtgctggaataattgcatatctatatgcaaaaaataaactcatacccatgcctcataaccgtatataaaaattaacttgaaatagatcatatatctaatataaaactgagaataattaaaaactgctaaaaaacatgagaaaatctctgtgaccttatctaggcagagttctcatgtagatataagaagcgtaagccataaaggaactgaatcagcctcagagaaaagacatattaattataaagccaatttttcacctcaacatcctacacagaaagaccatcaataagatttgcctccacacccagagcttcttatcaatttttagttcattcttaaaaaataatggatggccaagaacagccaaatatttaaagaaagcttccaacatgacagacaaaaaccaaaacagaccaatatacagacagaaataaaggaactctgaggaaacaagcacagagtagggagctgaaggaaactttacaaactacagccagtccttgctttgcacgtagtacaggatcataaaaacatctggacaacggaagggtgagtattctacactcgtactcctttgtaagtttgaatcatcttccaaagggttgtcctttgcactctaaaggtgttctacactcaccttgaaatcaaagaaaaatggatttttctgtgacctttagaaactttcgtcaaaacattattaagtctctgactctgggttaaaaatagagaaacaaacaaacatacaaaaggtaaagccacaacatttagtacactgcaatttaaagcatcagaaaccactgagaattaaagtgttttatttctttgtataaaacttatgtctatataatgatatagatcaatgactaaataacaaataagagacaaatctcttgttcagaataattacagacactcctcccccaaggaggtggaacataactccccaccacttagacttgggctgtgtacagtgacttcctttcaaacagcagagtgtggaaagagagagaacagtaacttcatgtggagagatctggcaaacaccacctcaacccaggtgatgaaggttaacatcccaagtgagaaatcacattgacagcatgttcccttgatatgaagtgatgaggatggcacttcatcacgggtcttccatccaaaacccataaccttagtctaaccactagaaaaatatcagacaaactcaagttggaggacattccatagattagctggccaatttcatcctgaaactgtcaaggtaatcaaaaacaaggagagtcagagaaaccatcgtggtctaaagaagcctatggagatatgatggccaaatataatatggtatcctagatgagatcctgaaactgaaacagaaaaaggacattaggtaaaaaccgaggaaatgtgaataaagtatgagcttttgttaaaaacaaaaaaacttattcagggtagtttaaacagtgtgtgccttcttcttgccatgtaacttatgatatgcagtgagtgtttcttctatgcctgggtgaactgttgtactcctttgtaagtgtgaatcagcttccagtgggttatcctttgcgctttcaatgtagtgaaatatctctgagagctcctttaatgtgaaagtttgtgctggcgttacttcttctgggacatcttcatcctttttgtcacaaccactttcctcatttatgctgataagttgccttcgttaagttcctctggctgcagatttacagtaactcaaatggcagcagtgtcaacattcccgtggtcagctaattcttctttataattctacttgttttgatttgaatttcacttccaacattatcacttattggttccttatgacactttcatcttggttgatcaattctctcttttgattatccatttgaaaagaatgttgcctgggtttatcactgagaaacaaggagacaacataatgacatgttttgctgtctgagtgaatagaataatgaatgtgcagacacacagactctgaaagaagtgacctgattggtgacagattaggatgtgcatctgttttctacacagggatgagtggactgaagagctagtagtgaagtttatactttattcaattactcacagttaacacatcgtagtcactgaaattggaatcatattattgggggactggtgttatttaactaacctggtgactgaaatccatgcatatcagaaccatgcacagagaattacttgaaaaattaatgtccttatagacataaaagataattctacatccaacaaggaagagctgtatgcattctttcaaaggaatattgtgaagacaagaattcttagaaattaaaataggagttgaaagaaaaaaaaatccaatgaaagtattgaagggggaaagtcagagaaatgtccaagaaatgaacaaatagatgaaagacaatagaagggaacaaacaaagacaaaaacattagaggataaatccaggaaaccgacatttaaccacgggagttccagaaagaaagaagagagaaatgaaagaaaaaaactgtcaaggaaataaaacaatatatttcccacaaaataaaagacacaagtcacaaatcacaagtcttcagtctgtaacagcccacagggagtacccagcataacacttccaaggcccattactgtggaatttcaaaacactgggagagaaaaaagaatattctcgaaaattccagaaaggcccagattgagagacagagagagaagaagaagaagaagaagaaaagaaaaaagaggctctataaaaaggatcttgaataaaactgacattagatttctggatagcatgtttgaatgcaaagacacaaaagacactggagcaacttccattccagccaagatggaataacatagactgatttacctacccagccaaaacaaccaaaagaatcagacaaaatacatgaaacaatggttctgaaggcactggacattgggcaaggaagcacagtgatccctgagagacaggaaactaacgaggtgaacccagtgactgccccagtttactggttagagaaccctgggtatctgcacaggaattcctcgatgattcagcagaggactgatcagcacataatgggtgagcaattccccagggctggggaaagaaccatccaaaaggattcaagggaacaatatatggtgctcacacagggctgagaacaacgcctgttcccaccagctaacttgggaaaacacatacatcacagcactggggagactagtttggaaggtcttaggcaatgaacactgctccagacccagcaaactacaaaagtaagacctgaaaaaatcaaactgattccaaatatctcaacgacatactggaaacaaagctcaagaacatttataggaatacaaaaatatctagtacaccacaaggtaaaatttataatatatggtaaaatttataatataaagactaccaggtttccttcctgtaggagatagcttaaaaaagaaaaaagtaaaataacaaagactatcaggtatgcaaaaaggcagaaaaacacaacccacaataacagtaatcaatgaactgaaagtgatgtggaactgatacacatgttagaattaacagagtaggacactgaagggtatttataactgcactccatatgttgaaaatgataagctacaaaccaaacagaacttctagaaatgaaaattacaatgtctgagataaagacccagcaatagtaactatccaaaataaaacacagagaaaaagaattttaaaaattaaagagagcatctgtgacctagaggacaacttcaagcacctcaatatacatgagtaattggagtccctaaaagacaaaatgagagcgggaaaaagaaaaaaaatctttcaaaataatggttgaaaaaagtccaaacttttttttttggggggggggggacgacaaggtctcactctgtcacccaggctggagtgctgtgacacaatcacagctcactgcagccttgacctccctaggctcaagtgatcctcccacttcagccaccctagtaactgggactactggcatgtgccaccacgtccagctaatttttttgtgtgtgtatttttttgaagagacagggttttgccatattgcccaggcaggtcgtgaactcttaggttcaagagatccacctgccccggcctcccaaagtgctaggattacaggcatgagccactgcacccagcccaacatgtccaaacttgatgaaagctataaatccagaaatccaagaagctcagtaaatcccaagctgattagaaacttgaagaaaacattaccagggcacatcataaccaaattactcaaaactcatgataaagaagaacttgtaaaaagtagccacagagaaagttgtattacatacagagaaaaaatatggggatgacaacagatttctgtcgagaaataatgcaagtgagaagaaagtggagcagtatcttaaaatgaatgaaagaaaaaaactctgtccatttagaattctatacccagcaaaaatatctttcaaaaatgaaggtgaggccaggtgtggtggctcacgcctgtaatcccagcattttgggaggctgaagcaggcagatcacctgaggtaaggagttcaagaccagactggccaacatggcaaaaccccatctctactaaaatatacaaaaattagccaggcgtggtggcgcacacctgtaatcccagctactgagaggctgaggcaagggaattgcttgaacccaggaggcagaggttgcagtgagctgaggttgcgccactgcactccagcctgggcaacagaggaagattctgtttggaaaaataaaagtaaaaaaaaaaaggtgaaataaagacatttttatacatacaaaagaacttgggaggctgaggcaggaccacttgagcccaggaattggagaccagtctgggcaacatagtgatacctcatctctaaagaaatgaaacaaacaaaaaagctgaaagagttcatcaccagcaggtctttgccataagacatggttgactccttcaggcaaaagggaaatgataacagatggaaatatgtatagaactacacaaaggaatgaggaaatacttacatgggtaaatagataagatttcttttccttttcttttttttaaatgagataggatcttgctctctgttacgtaggctggagtgcagtggtgtgaacacagctcactgcagcttcaacctcctgggctcaagggatcctcctgcctcagcttcccgagtagctgggactacaggcatgtgacactaagctcgggtgccaccaagctcggctaattttttggctttttgtagagacagagtctttccacattgcccaggctggtctcgaactctgggctcaagtgatcctcccaatgtggtctcccaaagtgctgggattacaggcgtgagccaatgcacccagcgtaagatttcttattacttaattcttttagaaaatcaccgactaaataagaaatataacaatgttgcatgctgttaataacatataaatgttattaacactaatagcacaaaggttgggagctgggaaatttaagtatattactgtaagattcttatgctatatgtgaattggtataacttgaaggaagactatgataggttaaaagaaaatattatatatcctaattcaatcccaaccaaaattttaccagatgcttttatgtaaatttataagctgatactgaagttcatagggaaatacaaaggatctagaatagccaaaacaattatgaaaaagaagaccaaagagaacaaagttggaggaaggctgagggtggggaaaggaagcaacctggagtgggtgagagcaacagagctgaatccttacctatcctatttgtaagtcaaaagataaacagaaaaatcaagaagtatggatggagctaaaggccattatccttagcaaactcacacagaaacagaaaatcaaatactgcatgttctcacttataagtaggcactttgttcctccaaaatggacacaaagcggagaatgacaggcactagggcctacttaagggtggagggtgggaggaggatcagaaaaaagtaactattgcgtaccaggcttagtacctgggtgacgaaataatctgtacaacaaacttctgtgatacaaatttacctatataacaaatctgcacatgtactccagaacctaaaataaaagttaaaaaaaatgaagaagtagcagtaagtacattatttgagaaaataaatatcaaaagaaagaattgaaagtggttgtctctgagggacaggatgagggtagcagaggactgccattttttattataaactttttttgtactatttggcttttaaagacaatgttcatagctttcattgaaaatatttttttttaaatgtcaagggcttcacaaagattcactcaatatgtgaaaaatcactactgcgatgttaagtcatgacttgtctttaaagggtatacagaactcagctctgttacgatttggctttatgaccttgaatatgacagcttctctgagcctccagtcctcttttgtaaatttgtaacgtgacagaggatggaccagatcacttccaagttccttctggctccacaagtccatgtttatcaggtaacatttttgcttacacagttacagataccacccacccattccttaaaagaatacattacatttcttcaaaaatgtcctcccatctatcctcacctccatccatctgagttactgtggtattactacattccacaatcattaacatttgcagatagaaatgacacaaaagaaaacattcaaagccagttacctaaacaacaaactttatatcttaaccctgtatgtttctgaagatgttccatctctttggaaactgtcatttttggttccttccggctttcctataaacccactaacactaatttgagaagaaaagaaaatcccctaatggcatctgggcagggtcaaatttggaagtatactactccttcacaaacagtgaccaaaaaaaagaggtaggtgcctggaaggatccacctactcctctctcctctccgcttgtgcaccccgcttttcctgatgcccctgcaggcaaatgaccagaaataagaggaagccatcaaccatgtggagaagtctattctaaattctcacagtttcattatgtcattaacttagcaatcctaaatggacattcatgtcagatttttaggcaaattccaaatgaaggcatcattagcactaacaatttaatgtgatgaaggaacagggtatgatggcattaccagaaggagaagaaatggggggcccacctgataggctgctcatcacatggagaatgtcatttcagcccccctcagaacaaggaatcacctaccaaaagctgtaacatcaagaaacacaatgcttcttgccccttgatttagtttgtgaagactcttccggggttaatttgcaattatagcaaactagaaactaatctgccaagaattcggagtcattaatttacgaagatgaaccaatgtaccacatggtcattcacaagaattccccaattctctttatcaaatagatgacacctaatgtaatactcagaaaacagtggtgtgaatactgatttctgcagcattgcatgatattgattaccttttaaattattttcccttaaaaaatggcatgaaaagtcttcagacctaatattccaaggcatgtacatactcctaccttcaggtggctctttcagtctgaacaaaaggtaaggcaatacaaataaggtagattatggtgcaattatcaaaagaatgtcattcctctctgccttactgtaagcaaagcaattgaaaacattcctaacacgactttatactgttaaaagaaagaaaacagtctgcatggccttctgagcaggacagtgagtgggaagacatgttccaagtgtggtacaggatctcctgctcattcatttatttaaacgtttttccaagtggccacaaggtattacttgctaggtgcgggaacactaagaagaatacgtgacaatccctgactttttcttttcacttcttacaagagtcccaaaggcaaagaattcccaaggactctgggtggcacagaaggcatctcacaaggcacttctagtcgaagggaaggatcataaatggatatcttaggagggagcaggcattttgtaaagagcatgaatgggatttgggaagagagagaggagggcttgaatttattgattggttttgtgactctgagcaagttcctcaattaaaaaatgggttactgtgaagattaagaaacaaaacaaaatagaaaagtgtgtgttatggtgcctggcacatgagagactctgtaaatgccagtgccttctctgtcacctccctttcctatggtgggaaaggtggacagtcggtccatgtttttagagaagacactgatgtgggtcttcagagagaagaccaatgaaaaacatcagaaaaagaggagggaaagagaaggaagagcagtaaggaggcacaaggagcaagaatagcttgtataggatggtccccagtgttgggcagcaaggaggaaagtgttccagcagccttgctgatgggcaggtaagccatcagccacatgggcattagctaattattctgttcggaacctgtggatcactgagaaccacctcaactgccctactctattggaaatgtacacaagtttctagtttcacagttctactcctccccaacattttattatgaaaacttcaaatatatagaaagtttaaagaactatacagtacaggcacagtgatgtgtgactgcaatcctagctgcttgggaggctgaggtgggaggatcgcttgagcccaggaataggagaccagctggggcaacacagcaagatcccattactaaatagatagatagatagatagatagatagatagatagatagatagataaaataaaataaagataaaacatttgaaacactaaaacaaacaaacaaagaaataaaaaaaacacacataaaaaaacgacctaaaaaaacgggtctggtacagtggctcacacctgtaatcccagcactttgggaggtcgaggtgggtgggtcatctgaggttaggaattcaagaccagcctggccaacatggtgaaactcggtctctactaaaaatacaaaattagccaggtgtggtggcacatgcctataatcctagctacttgggaggctgaggcaggagaatcgcttgaacccgggaggcggaggttgccatgagccaagatcgcaccaggaggcagaggttgcagcgagccaagatcgcaccactgcactccagcctgggcaacaaaagcaaaactccatcaaaacaaacaaaactatagtaaacacccatatacccatcacagatttgagtccttttgcatttgggaaaaagaggcacaaaagggagattctagaaaattctcattttgcaaacctttggcttctgcactatcagcaagctgaatgaaatgaaaaatctttgcttcagagattcttgaatggccaaaaaggaggcccctcagatctggagatcgtatttaaacatggaaccacctatcagtacaaggacaaacttggctttgggccacagcagtcatttttcattcatccaccaacctcccctaaataaacacaaacatgctgcagtttctgctggcttatgatgtactagcagaatttttaaaaagcataaagtgtcaaaaaaaaaaaaaagaactacgaggaaaatgttaaggatttctacatctggcaattaaaatacaggatttatacattttatgctttatttccgctaacaccactataaattatacaggactaatcctaaatgcacatgatatgggcaactcaaacagaaaatctgttttgcatttaggtaacagacatggaaaaaatagtatttcactttcctaacatctaagtatgctgagggcaatttgtttcaattattagcaccttatactatcacaaaaaattatactattacatgaagataagtactcaataatataacacattgttagaaacatagatgataatgagacttttaattatggttataacatgaaggtatagaaagaaaacaattttcaaatattactgctattatgaaacatgaaagcgttctaacacaacaaaggtcatataagtataaggtgatgttaaacttagcttcatgttatttaaaataaaatcctgagatgacacagtgctttaatgtgtgaggtgaaagcaggctttcagtgctgagttccaaatttctgcatacaggagcctttaaatggaaatactgaattttattggagacactgagaaacctttctatgttttcaaatttaaagaaagctaagtcattgctaaaatctcctaaactttaatgaaataattacaaatttaaaaaaactatagaaatcttagagtttggatgattattattattattattattattattattattatttgagacagggtctcactcagtcaccctcggccagagtgcagtggtacaatctcagctcactgcagcctcgacttcctcagctcaagtaatcctcccacctcagcctcccgccacagctgggactacaggggcacaccaacacacccggctaacttttgtaatttttgtagagacagggtttcgccatgttgtccaggctgctcttgaactcctgagcccaagtgatctgcccatctcagcattccaaagggctgggattataggcatgaggcatctggcctggctgagtttgaattatttttaaaaaatacatatagatattttctttgctctgttgcccagggtcttgctctgttgccatggcataatcacggctcatcactgcctcaaactccttagcacaagcaatcctcccacctcagcctcctgagtagctaggtttacaggcatgagccaccatgcctaattttttgatttttgttgttgttgttgttagagatgggatcttgctatgttgcccaggctggtctttaagctgtccttaagcaatcctcccatctcatcctcccaaagggctaggattacaggtatgagctaccatgcccagctgatacaggtaatttttaataaacacaattgttctgcttccccagctgtgcttttgtcaaagtctgtagagttgacacttcacactctcactcgattaaagcagaccttcatctaaaaatcaatccatccatttgccagatgtgttacagcccatacaacaggtgagacgagaaaggccagatctaaaaggcattttaataaataaagcataaaatagaaaagcagtaactgaaaattatgaactcaaatgtgataactcatattatatgataattcactcatgaattatcaataattcataattctctatttacattttttaagtattctaggtttcacatcagcattctctccattctcaaccatcaaaagaaaggtttcatgtaaaattctactattaaaatagtattccaagttgtctgaatccctttaaaatttttttaaattgcggtaaagtacacataaaatttagtgtcttaaccattttaaacgtacagttctgcagcattaagtccactcacactgctgggcaaccaatctcctgtagtactgaatcacattaaacaactccccattcccacctctcctcaggtgggggcaatcaccgctctactttctgtctctatgaatctgacttactctaagaacctcatataagtgaaatcatctggtgttttgtctttttgtgatgggcttatttcattttgcataatgtcctcaaggtgcttttatagctaaggagcagaatttacacctatatctttatcttaaccaaattacatttttacaatttgcttgaagcaaattgaagcatgtattagaatctccttcctttttaaggctgattaatattccactgtaagcatatgccacattttgcttatccaaattgtccacatctctttatgtgatgctactctcaggaatcttgttgaactatcccctctcaaagaaagcaaccgtgtcctgacctactggtccaagagatgtcaaaggaaggagacaaactacattcattcgtctttcctggatacccaaccagacagatatgccagaggggacatctgttagaggtgtaccacatctttattaaaaaccaagttttatgtctttgtgtacattacatggtaaaatcaattttcctggttaatcattctattttattagtaactgcacactttaaaattctgcattttacattaacgagactctagttttatgctgaatatttacttgaatattttaaaatactcttttgagaacaggctgatcctttcttacaagtgtgcagctggtaaggtgcaaagtagctgaattcagagggaggaatgagtgggggtggtggaaattcttccttacttattaaagtaaataatttagaacaggtgttaaaggtctctaccacttttccagtctgaaattagcatagccctttaaaagccaactagacctagccaaaactggcaaagaggagggaaaggtggtggcgggttagcaggaaaagctctcgatttgctgctagaacatgaaggcacaaaaaacatggcacctgccaaaagcaaatcaatgattctagtaataagagcaatgtatttaaagttctgagagaaaacagttttgggatctagaattctacatccagcaacattatacatgcaaaacaatataacatttaagaaaattacttccctcaaaaaagtccacacaaaaaccgctgggatggctgaaagtttcttctgggcagcaaagttttaatgacataggaatacactttcttctcaatgtcccatttatgcaactttttttctctacagaggataacatttatacaaccataatattatacacgctgcatcctgattgtcatctcttgggatcaacttataaagagggcacaaaagtatagatacaaaaagtagtaaatattataaataataactaatcaaagtgagaagagggcagaaagagacggaaggcagaatatacatactaaattccaaatcttttatagtagtaatcaggatacattgttcaaagttggtaagtcaagaaatggaggtatttaaaggaataacagaaaccaccaaaagaatataacaggagctgccactgggaagagaagctgcgagtgaggaatgaagattttcctccttcattttacactctagtgtactacacgaatttttaaaaattatgtgcatttatcatttcagtggtttcaaaggtgtcatgggaaacattttctctgctaaaatatacttaacttataagatctacattgaatttgccaacatttactctgcccaaatataagagagattttgctgtggcggctagactaggtaaatctacagtcctttccaaaagctaaggctctatcccaagggataagcaaattgtaaaaatataatttggttaagataaagatagagatgtaaattctgctccttagctatagaacctagagcaaacaagagctaaacaacaggaaatttccccagaaaaagcaagactagggacagaagaggcagttagagcagaacggaggtgtcccaagaggcccagggcaagagagaagcaccaaggaagagtcaacacagagcttcctggactgcgtgagacagccagctgccataagggtcaaaggggccactgcttgcgctgtagacacacattttgaaatagcagtggacagttgtgggtctcaaggtgagaggcacccactcaaagtgatgaatgtctaagcacagggccaagacaaagacggcaaaacgggctgagtacacattcttctgccacagtgctagtagtttccaaccattttgttgaaaccatgagaaggaccttctaaaaacttctagtatatagctggtaggtggaaatttagagggcggcctccactaaaagggccaatgattcttttttttcttttctgagtctcattttgtcacccaggctggagtgcagtggtgggatcatggctcactggagcctcgactttctgagctcaagccattgtaccacctcaacctcctgagtatctgggactataggcatgggccaccatgcctggctaatttttgtttgtttgtttgtttgttttttggagatggggtcttgtcatgttgcccaggctggtctcgagcttctgaactcaagcaatcctccagccttgacctcccaaagtgctggggttacaggcatgcgccactgtgctcagccaatgatctttttatttgacatgtctttattattgtagcgtcataaagagctttcataggttcacctgtgacactgatttactgtatgttcctaaactaaaaattccactataaggattttcaaaactctaatcttcaggtttagaagagactgccatttgctatttgagagaatcaaagggtctcacgagtttttatcaatttccatgtcatgccctacacactgtgcacaatataaaagcatttggaatttaagagccagaagggacgtcagcattctttccaccaaaatgcctcatttaagatgagaaaacagaggcacacgctgggctcttgatgggtatttactgaagggaagagagaatgaagagtcttttccgaggtgctaggtggtggcagagcctaagctggaacccttggcttctggctgcctgataagtcagttctctgtccactctgccctatggcttctgttgtctctaaggatttttcagtaggaagacagaaaacacttgctccacaagcccatttatgaataaatgtgtaagcactttgacaaggcaatgggtcctggaatatgatctggtgaattagaattctccttcctaaagggctttttcctcaccttctaatgtaatacatatattcagttactttcagaaaccactagctgcaggtgaaaaccatgtggaatccaaaaaccacagctttgatatatgcattagcatttcctacctagcaggaattcggagagctactcaattttcaaggaaggctgaaatttagtctcatagaaaggaaaggctagagggaagagactggccaatgggattttcccatcagttgagataaaccaaagagcaagtaaccaaagggcatgactgattaaaatctctatcagcacaaagtggctttagaaaatcattccctttaattagagaacattacagtattaataaaatgggaatagtaatagcacctatctttcaggaaagttgcgagtgttggtgttggcttatggggactgagtacctattagtgagatcttacatgtttcagcatccactgtagaggagtattctccaaacactatgctaccctgtatttcttcagatcccacaccaccaaaccaaatcttcctccctctcaaagcaaactatgttcagtccagtttctccagaacccaagccctctcttttttccggttaactataaaatgcttgaatattctggacactgaatctattacaggaaagaaaagaagcacactgctacaataccagtgtaaacagcaaaagaaatggatgctcatctctagcagcactgctaatagccacgtgtagaagctcgactgctctgaccagctctgccaagggctcagagtcaattctctaaagcaaatagaagtgagtcacagagcagtgcctgtcttcctctcgaccatagtgccgccctccaaatcttaatcgtacctttctaattatggatgcctgaatttttacatttatatctatgccatttcccccatactttaatcccttattttatttaagagactaataacagtttaaagaaaaagaaagaaaatgaataaaagcactaatgtatccatggggtttacacaatatgtagaagtaaaatataagacaaaagatcgcaaaggattggggaagggagtaattggaaatatactgttaagagtctcacaatgttcatgaagtagtacattttttacttgaagacagtcaaaaacaaaaagaaaataaaaataaaagacagactgatacttgaaagatgcatattataatcttagagtagtgcttggccaatagaaatataatgtgaaccagatatataattaaaaatgttcaaatatctaccatttaaaaaggaaaaagaagtcaaattaatttaatatttttaacctcatatatcaaaaatattatcaacatataatctgcaggtaaacaatgactaatgtagtttacattcttcaaaatctggtgtgtagttatattcacaacccatctcattttggactagcaacatttcaagcactcaatagccatgtggttaatggctaccatcttggacagtataattccagagcaagggtcaacttttctctaaagggccacagagtaaacattttgagttctgggggccataaggtctctgtcataactacccacctttgccatggtaactcaaaagtagccacaggcaatatgtaaatgaatggggggctgggcacagtggctcgtgcctgtaagcccagcactttgagaggcggaggtgggaggatcacttgaagcaaagagttcaagaccagcctgggtaacatagcgagaccccatctctattaaaaaattatttaaataaaacaaaattaaaaaataaatgaatgggcaaggctgtgttccaacagaacttcataaaaacatgtgagccacgtgggccggatttggtttgagagctgtagtttaccaaccaccaatctggaacaacgactttaaaaaacaacacaaagaggtataagcaaaaagtcaatagagaagataaaacaggatgataaaatatcagcaaatactaaataatacataattcaaccaaaaggcagtagaataagaggaacagagggacacagaacaaacaggacaaacaggaaacaaaccacaagatgggaggcagacctgtcctcaacattaattcaatataaatggcagagattgccagaagcaagagccagctatatgctatttataagaaacatactttcattgtaaagacaaaccagttaccagtaaaagactgaacaaaaatatacgatgcaaacgctaagtataagaaaataggcaaggtgtggtggctcatacctgtaatcccagcactttgggaggtcaaggcaggtggatcatttgaggtcaggagttcgagaccagcctggccaacagagcgaaacctggtctctactaaaaatgcaaaaatttagctgagtgtgatggcacatgcctataatcccagctactcgggagcctgaggcaggagaatctcctgaaccagggagttggaggttacagtgagccaagattgcaccactgcactccagcctggcaacagagcgagagttcgtctcaaaaaaaaaaaaaacataaccctgataccaaaactcgacaaagactgaaaattacaggctgggcgcgatggctcacagctgtaatcccagcactttgggaggccaaggcgggtggatcacgaggtcaggagttcgagaccatcctggccaacatggtgaaacctcatctctactaaaaatcgaaaaaaaattagctgggtatggtggtgcatgcctgtaatcccagctactcgggaggctgaggcaggaaaattgcttgaaccagggagttggaggttgcagtgagccgagattgcgccactgcactccagcctggcaacacagcgagactccgtcggaaagggaaaagggaaaagggaaaagggggaagggaagggaagagaagggaaaggaagggaagggaagggaagaaaattacagtctaatattcctcatgaacagagatgcaaaaaatatttaacacaatatcagcaaccaaatccaacaacatattaaaaggataatacttcatagccaagtgggatttcttttaggcatacaaatctgattaaacattcaagtatcaattagtataaatcaaaatattaacaaaataaaggatggccaggtgcacagctcccacgtgtaatcccagcactttgggaggtgggaggatctcttgaggtcaaaggttcaagaccagcctgagtaacatagtgagactcttgtctctacaaaaataaaaaaattagccaagtgtggtggtgcacacctatagtcccagctactcaggaggctgaggtgggatgatcccttgagcccaggagttcaaggctgccgtgagctatgattatgccacagcactctagcctgggcaacagaccctgtctcagaaatattaaaaataaataaataaaagacaaaacccataagacaagttttaaagacacagaaagagcacctgaaaagacttaatatccatttgtgatgttgaatgatttcttaacgtactagaaatggaaaggaacttcctaaacctgaaaaataatgtatatgaacaacctaaaatcttacttaatggggaaacattgaacttctcctccctaatactggaaacaaggcagggatatccactctctctatttctacttaaccactgactagctaaaggtgctagtcagtgcaataaggcaagaaaaataaataaaagacataaagactggaaaagatgtaaaacttgttaacagcatacaacataattgtgcacatagaaaaccttatggaatattttaaaaaatcctatcagaacaaataagtgaatttaaaaaggttgcaaaatatgaagtcaatatataacaatgaattatatttcttttttttgagatgaagtctcgctcttgtcccccaggctgaagtgcaatggcgtgatctcggctcactgcaacctccgcctcccgggttcaagtgattctcctgccctcagcctcctgagtaggcttataggcacctgccaccacggccagctaattctcatattttaagtagagacagtgtttggccaggctggtcttgaactcctgacctcaggtcatctgcccgccttggcctcctaaagtgctgggattataggcgggagccactatgcccggcaacaatgaattgtatttctatacaaaaggagcaaacggtttgaaaatgacatttaagaaacaattccaggccaggcctggtggctcatacctataatactaacactttaggaggccaaggtaggaggttgacttgaacccaggagttcgagaccagcttgggcaacacagtaaaaccttgtctctacaaaaaaatttttaaaaattagccgggagtgattgcaagtggctgtagtcccagctatttgggtggctgaggcaggagactcctagggcccaagaggtcaaggctgcagtgagctgtgatcatgctactgtactctaccctggatgacagagtgagacccccatctctattaaaaaaaaaaaacttaggaagaaaactaacataaaatatacaagatcgccacagtaaaaactaaaaaataggcttactgaagaaactggcaagattattctaaaatttatatagaatgcaaaagatctagaatggccaaagaaatctgaaaaagaacaatgttagagggtatatgctttctggttttaagacactataaaccaacagtaataagatagtgtggtactggcataaggaaaaacataactgactggaagtgaagagagcagaaacagacctagacatacacgatcagttgattcttgacaaaggtagtgagtcaaaccaatgaaggaagaaaactcttttaaacaaattgttaaaatgttgttggaagaatcagatagtcatatggaaaaaaataaaccctgatttccatatcttactccacatacacaattaatttgaaatgggtcatgacctaaatgtaaaagttaaaattacaaaccttctaccaaaaaaaaaaaaaaaagagacaatcactgcaaccttagggtagacaaagattttgggggaggaggggattcactaacaataaacgggaaaaaacttaataaacaagactttatgaaaattaaaagtatttggctgggtctggtggctcacatctgtaatccaagcactttgggaggccgaggctgccggatcacttgaggccaggagttcgaggccagcctgggcaacatggcgaaaccctgtctctactaaaaaaacaaaaattacgcgggcgtggtggcgcacatctgtaatctactcaggaagttgaggcacgagaatcacttgaacctgagaggcagaggttgcagtgagctgagattgcaccactgtactccagcctagacaacaaagcaagactctgtctcaaaagaaaagaagaacaaatcaaaaatatatgctcatttacaaacatcacaaagaaatgaataggtaaaccacagaattgaaaaaatacacgtgcagcaaaaatatctgacaaaggctatgtatccagactacatacaagaactataagtgaatagcgaaaagacaaacaacccaattttaaaaggggcaagagacttaaaaagccacctcattggtcaacaagaacattaaatggtcgtcaatatcattagtcatgagagaaatgcaaattaaaaccacaatgcaatactgtctcattccatctaagatgactaaagttaaaagattgacagtcaggtgcagtggctcacgcctgtaatcccaacactttgggaggccgaggcaggcggatcacttgaggtcaggagttcaagaccagcctggccaaagtggcaaaacatcgtctctactaaaaatacaaaaattaaccgggtgtggtggtgcacatctgtagtcgcagcttctcgggaagcggaggcccgtgaatcacttaatcccaggagagaggctgcagtgagccaagatcgcaccactgcactccagcctgggaaaaagagcaagacctgcctcaaaaaataaataaataaataaataaataaataaataacataaaagattgacggcatgaaatgctgacaaggatgtggagcaactgaaactcacacaataaaatggcatatcaaacttgtactataaaatgctatatccactttgaagagctgttgctttgttcttataaagtttaacacaaacttatcctaaaaatcaataattctactcctacatatgcagacaaaaaaattatcttactgaaacattcacagcagccttactgataatagctccaaactagaaacaattcaaatgtccaacatcaagagaatgggggtaaaataaatgctgcatatttacataattaaatactcaacgattaaaaaactgctgagatgcaatagcaaggatgaattttaaaaatatattaagcaaaaaagttaaacacaatgccaaacaactctattttttataaattccaagaataggtgaaactaatcttagagtggtaaaaatttaaaaatggttgcttagggtcatgggaattgtagtgggaatttgggattgtttgaaaacagacacaaggaaattcaagggaaatagaaatgttctatatcttgctttggttggagattatatgagtgtatccaactgttaaaactctttgaactaaacatttatgatctctgcattttattttattttaatcatacctcaatttttttaatctctaaaaaaccatttttaaagtacagagggcaatctgaaatattaacagtgattgcttctgggtgttgggattatggctaatttttttctcttgttaattcacattgttctaaacttcacaattttctataatgaacatatgtatgtacacatttttcccattttctatacctgtgttttgtagtttcacaaagataccaaatgttgccagcatttatcttctgcagggaggattatgggtgataaaaggaagtgtgagtcaagcattctttctacagtaggcacctggttcagtatctacaggacctgaaagctcaggagatcaggcagaggcagcagtactgagaagagcaagggatcagacacacacaagttcacttctaatcctggttcttgcacagaactggtgaacaagacacaaagcctccatctcctcaaccctaaaatgggagtaagacatatcctgggccaggcacagtggttcacacctgtaattccagcactttgggaggccaaggcaagagcatcacttgcatccaggaatttgagaccagcatgggcaatagagcgagacctcatctctacaaaaaatcaaaattagccaggtgtggtggtgcgtacctgtagtgccagctactcaggttgaggttggaggatcacttgagcccaggaggtcgaagctgcagcaagctgtgattgtgccactgcactccagcctgggcaacagaatgagaccctgtctcaaaaaaaaaaaaaattcctgtctacctcaaagaggttttgtgagggttaaccaaaatggctatggtctataaagcagtctctaaaatacaggaaattcaggtcatagtcacttctgatatgatgtgaaaagttgaaaggccatctttcccaaaagtcagatttagtacttacaaacctatgagaagcaacaagaaaagccattgctagaactctggccttttaaattaacagctgagagctcttacctattgttgcggtaatagtgattctgcagggtgtagggtatgcactgggggtttaaccgtttgctgtcagcctccttccagctatcttcagtccactttcttttgatctgcttctcttcctgttttctccccatatattcagcataggtttggatccgatagctttctgcatatttgctggtattgacagctacaaggaaaagaaaaaaaaataaaatgcttacaaaagtctggcctagccccaaagatgacacttttgaaatgtggcctaaggtggtcaaaggagccccatcaggcctgaggtctgacccttggctctgccacctggaagacaaatgaccttgggtacacctgcaaactctccaagtctgagttttctcacctggaaaaaaaagccattgctccccaatctcattttcagtgtgaaagtactttgtaaactgtaaagaaccggtaatgatataagtaaaatattaattttcaaaatatttgcagccaacattactatttggatattattcattttcagagtaacaaaatgaaaataaacaaaaccactaagggaaaactataaaccctcactattttcctaaaataaaatgacaacaaaaagcaatattgccagtggtggcgattactgtgtcacacactgaagatctccggtatgtctgtgtgcagtgttttacatgcattatatctaatcttcatagtacgcttgcaagagaggaaatgtttttactggtgagaaagcaggatcacagaggtcagggttttgctgcagaccatccctgggtgaatggcagggataagatgcaaaaccaggttcctcaaaccctaataccagggtccttcttattactctgcatctattggaggtgctttattattttcattttattaatttttttaaatgatcaggctttattacctgttctgttacaatgagttttaaacaaatttgtacacccacatgtcatccatcacgcaaattaagataaagaacatccccctcaccctcatgcctgtttttagacagactcccacccctccttcactggacgaaggcgcctcagatgtgtagtacaattatggcattatcttcctcaacttgaaaactttgctgtcaccactgctatcatcagggcttaattttgccttctcttgagctacctataactggaattacactacatatgcatttttttgtatttatcttatttcaatagttttgggggaacaggtggtgtttggttgcatggaaaagttcttcagtgacgatttctgagttttggtgcatccatcagctgagcagtgtacactgcacccagtgtgcagtcttttatccctcaccccctcctgtccttcccctggagtcccaaagtccattacatcattcttatgcctttgcttcctcataacttagctcctatgcactctgcaaatttaagacagctgcacaatacttaggacatgcctctgctccttctgccttaaagactgctaattctccgtaatgcgcctctggctggcagcagtacttgaacactggggcttaatccccccttggtgttaatgcttcagactaaggccaggtcagttgtgttctgatcccatgctgccccctcttctgaggctgctgtggatggatcacgatggcggcatgggagtgaggatcaatggtggcctcttggtgcccatttgctacttctggcttccagtttaggcatatgcgttcctagcccactatcactgccaacaactattacccacactggcagtgagaccatcagagcctggccacgctgttcagggcagtctttgtacctggtagctgcaaagcgccatgatgtcagaaacagaatctgtctacttgcacctagaaaacccctggatatggaatagttctcaataaaaatgatgtgactgaatgcagagcagaatgcagtgctggtgacgagcatgcaggctgtgggcacgtcggcactggacaagggactccagtttaccagggaccttaaaacagagggaaagacaactgtatgagaggcagatgtcccacatccggcacctgacacattttaatcttcaactaggccagacttcactaaaacttagtgcaacaaaggtttccggaatgtcatgccctaaatatttagtcatctaaaaaacagaacaaaacaggaaaaaactctacttcttcagaaaacacaaatttttactaagaagtttgtgtacttttaaaatattcactcaagagttaaagagaaaaagaaaaaaaaaaccctcaaagtattagggaggcagggcacagtggctcacacttgtaatcccagcactttgggaggccaaggcgggaggataacttgagcctatgtagttgaagaccaacctgggcaacactgtgagacccccgtctctaaaaagaaagtgctagagaatgttcatattatacaatgtctcccaaagaagtggagtgggttactgaaatgtgagctgaaaacagcacactctgcctcactcaggagataagcggtgaaagcaggcagttctggagatgtgctattgagtaaagttactcatatcagagagccacagaaataggatcctttcctgaaaatcttattccttggaacagttatttttcttactttgaatgtgtcatatttctgttatttttcactcatttacccagcctcccaacaattcatatccaataaccattgtccacccattcttccatgtggtaactgcttactgagtgtttttgtcccaggaactatgtcaggtatttggtaaatcaagacacaatctccaccctctcttaaaggtcaccctgtcacataccagatttatgtagtggtgatttcgctgtaagcttgtcactccctaagcttgtgacagattaaaatatgttcatctatcaatgtggacatatgagaacccattggttctaccatcattattctgtaccaattgttaaccaatgagcattctcctggattttcttctatttcaattcttttttttttttaagaaagttctttatttttattaatatatttatttatttgagacagtcttgctctgccgcctacgctggagtatagtggcgccatctaggctcattgcaacctccgcctcccgggttcaagtgattctcgtgcctcagcctcctgaatagcttaaactataggcgtgcgccacgacgcctggctaatttttgtaattttcacagagacagggtttcaccgtgttggccaggctggtctcgaactcctgagctcaagtgattcgcctgcctcggcctctcaaagtgctgggattatgggcgtgagccaccgtgcctggcctggctattgcgttctttaatctaaaaggtttattttgatttgcaagcacacccaaaagggatgacatctgcaataatccctctgttgccaggtgtggtcgctcatgcctacagtcccagcactctgggaggccaaggcaggaggactgcttgagcccaggggttcgagaccagcctggacaatggggcaaaaccccattctccacacacacacaaaaaaaaccacaaaaattagccagatgtggtggcttcagactatagtctcagttattagggaggctgaggtgagaggattgactgagcccaggaagtcaagtctgcagtgagccacgattgcaccattgtactcactccagcttgggcaacacagcaagaccctatctcgaaaaaaatccttctctcaagtttaatttggattaccaagtaggagaggaggcttgggtcaatattccccatgaaagcaaaggtgatgacagggtcacaggcgagctgagttaatctatttaatgatatctgatagttttcaataattcagctcccagctgatagacaaatgttacaaacaactccctaaccatggcgaggggatttatctgagcacatttggaatttaggatcacttaaaaggggaaataaataacagtccgcttttcactgctggcctccacgtggcaataatttaccagcattccttgagtcccagcagctttgcagctctcggcctttaatctagaagccaagctctggctcaaagccacgcctctaatggatgaatcagcaaaatgaattggctgtcaactgtgtcctccagctattccagctcgcctgtcagaagcagcatgtagcaggctgctgggtaaaactaaccttttccaaatttgtcagggaaatgattcaaggcaatctatcggtcttgccactttgtgaaagccactggggaaccaaatgtgctaagagtcctccctgtttccctggaggtgagtgggagcagttccctcacataagagtctcaaacactccggcttcactgtgcccaagaacagcacggtccggggtggtccagtctgatcccaaccggcccacccggggcatccggtggaagtcttcgccggaggatccgaaggcagcatcaacgcggttgtctcttgacactgcacacagcatagcatttaatcttcggatgttctagtcaccacacaaataaagagactgagcatcggagaaactaaacagcttgcctgaggtcttgtaggtaagcaacaaagctggcttgaaaccaggatgtggcatttatatatacattttaacaatgttaatactgccacatgcctgctgtgtatttatatgcattttgtttatgtaggttgacaattagcttataaaatgcttcctgtattaaggaattacttaaaatgtttagactttattgttttttaaagaactttccactactgtcaagcaaagactttccaactaagttgatgcattatgtttatgaagaggaagacaacataagatgtagattccttcctaaattgacttatagatttactgcaactccagcaaaaatattccaacattttattttattttttaaacaacttctgtggaacagggctaactcataggcagtgtgcccagagttggcctccaacattttaattaaatattgaaaaaaattaaaagtaagaaaaaaaaatctcggtagaaaacaacagtggttgtgagagcctggggctggtgctggggctggaacgggagaggaagttgactacaaagaaggggagggcattttgaaggtgacagaactattttatatcctgattgcagtgctgattacattactgcatgcatttgctgaggcacagaactgtacaccaaagacggtcactttattatacatcaattaaacctcagttattctgggaaacctgaaagatgaattctaaaattagaataaaagggccaacaatagctgggacatttctaaaaaagaatgggaagggggacttgctttactaggtaaaaaagcttattgtaaagctataggaattgagacagtggagtaatggtgctgagataaactgaccaatggtacagaattctaagagcctagaaaaacacgtatatatctgtgaaactttgatttttgacagaactgcctggaaaaggaaaagctggaaaaattgtttatccatgggggggaaaaaaaaagaaattggattcttagtcacaccatgccgaaaaattcactccagatggatgaagagctgaaatgtcaaaagcaaactctgagaatttgaaaaggaaatataagtgagtatctttctgagcttgaagtagggaagaatttacaaagatagaaaaaaggacaggcataaaagaaaagatcaataagtttggctacattaatattaaagcctttgtccatcagaagacactttaaagagaagaaagacaatctataaactggaagaagatatctgtaagacattcaactgacaggattagcactagaatatataaaaatagccacaaactagtgaggaaacaactgcagaaaagtgggcacaaggcatgagaagcacggtcaccgcacagaagggaggtgtgtgaggccagtggacatatgcagagatgctcggccacagacaaaggcaaatcatgactatgatgagacatgattctatacctactgcgttggcaaaaattataaaaaacattgataatacaactattgggaaggtgtggagcaacaggatccccagtggttgtacgaccattttggaaaacaagttagtgttctcacttaaagatgatcattctcacttcctatgaccctgcaatttcactcacgaataataagagatcaatacaatagtttccaaaaaaaaaaaactgttcataatagctaaaaagaaagagaaagagggctccaaatccttatccttgggtaaatggacaaatctgcagtatattcacaaaatggaatattgtctaagagaaaatatgagtgaactacagctacgcagaataaaatggatgaatctcagtgatgtaacggtgaatgataaatgcaatccccctcacgccccgcaacacacatacatacacacatggcgggggtgtgtatgagagggagaacaaaaaatagcaagaagatgatcagcacaaacttcagtagaatagctggtactggaagggaatcaggagaactagagaggagaagagcaataggtagatgtaatttattagtaatgttttaattctttggttgagtggtggtttcacagatgtgcattacattttaaacaaacaaaatttctagcacgcctgtaatcccagctactcgggaggctgaggcaggagaatcgcttgaacatgtgaggcagaggttgcagtgagccgagatcgtgccactgcactccagcctggcgacagagagagactcaaaaaaaaaaaaaaaaaaaaaaaaattctagcttttccattgttttaccctgtccaactactaaaggccatttccaatacaatctgcttaagtgagaaggtctctttaagattagctcaaacttactcctgtttcaatgtcttcggtcacatggaagtggagcccctgagtgggacacatgtggtgtaaatgcgtactgcaactcagatgccagacttcagccttgctcggtggctaagggcatttttgcagtctgcttcttagagggttgaaaccagtttattgtagcaactgtttgtgggtggggagagtgtactaggaaactgctgaagcagttacacaccattagtcctgcattttttgccatggccactctcagcaaacatcaagttctcaatgtctaagggaattgcctatattcgtattaacccaatggttacaacaaagagggctggacatggtggctcatgcctataatcccagcactttgggaggccaaggctggcggatcacttgagtccagcagttcaagaccagcctgggtaacatggtgaaaccctgtctctacttaaatacgaagattagccaggcatgcctgtagtcccagatacttggaggggtgaggctggaggattgtttgagcccgggatgtggaggttgcagtgaactgagatcgtgccattgcactccagccaagttgacaaagtgagaccctgtctcaaataaataaataaataaataaaaataaaacaaagaaagagaactatttattggctatttcctctgttagcacagaaaatcctgtcagcattatcctggctttatagataaggacactgagactcataaaaagggactggcccaaggtcccaaagattacatgtgtaggctgggaccccaaccaaagcctacattctttccacgacaccacatgcactggaaggcacccggtttgtgtcatgcagagttaacacaggcatacatctgtctgcaaggaagcagtgtgtccatctctccacccaacagccttgtgcaaacgctggaaggagtccctgtgtgataacctggtgtgttactccacaatcagaagtgatgtgtgccaagagtggcctctgcctacttcacaggcccaaatcctactcctctaatgccagtgtgtgccttaatgtcaaagacgccctctctgacaccctttaagatggcctctccttattcccctcagagcacccaccagcgtgaggccctaaatcaccacattgtcattcaggattgtcaccccaagcctggatgacactaaaggttgctttgtgtttgtttgcttatttaaatatgaatatattaaatacaaaagttttttcatattccataaagtttgatcaagtttaaatttacaacagatggacagcctctccaatttaccagataagagaatggagggttttatcagattttgcaaaagggcaagctttaaaaatctttaaagaaagatattaaaaatcaaggaaaacagaaacacccaaccctaatggtcattatgaacattttcctgtgttcagaaaaatgatctcagatgtatttccccttaacccatctaaggaactaggcagatactaagttggaaacaggaatcagtgatctaacagaaacatggtaaaatgaaggtatttccaacatgcccaaagaagtaaaaatggggaggcaagcccagaaaatgacagccttcctttccaccctctctagtccatccttaccctgctgacatgatccattctattctgttaaacccttcggcatccaagataaagtgcaaacttgctggtacacccaactggtgtaccagcaagtttgcctcaataataacccagctctgtccagccctctcatctcaattctgttttcccacatttagctgttgtcttctgaacaggaccaggtgctctctgagggaagggattatacattattcatttctgtagcacctagggtttatcatagtagttttccaggaattcaacatatgatcataggaagaaacaaaacttcaggccaggcatagtggctcatgcctgtaagccctgcaccttgagaggcccaggtgggaggatcgcttaagcccaggaatttgagaccagcctggacaacatagtgtgacccccatctctacaacataaaacataaaaataaattagctgggtgtggtggtgcacacctatagtcccagctactcagaaggctgaagtgggaggatcacttgagccagcaaggttgaggctgcagtaagccaagactgcaccactatattccagcctgcgcaagagagtaagaccctatctcaaaaaaaaaggaaaataaataagtaaacaaataaatgaatgaatgaataaaaaacagcttttatgtctgctggcagcctgtctccactcaagagaaaaaacaagccagaatgaggatacaaacttatacatttttcagttaaaaatcccatgttgaagcctggtatgtgaaaaaagtgcctggactggaaactggaggccctggctctggctcgaacgggtagttttgcctgggcaggaaacaggccaccgtcactgatagcagaggctaacccacctgcctgctcacacccttgggagccagagcttgggattccttgtccttcatgcttcctttcatatcgtgggtgtttctccaacaaaggctaattatgttttttaaaaagtcctgaggctgaaagagtagaaactagggcagtgaaagagatctgagccccgtaaaggggacagacaaaactagggaagatagtggaggacggcattccttcctctctgctttctcagggcctccatggcagcgcctgacccatgagatgcactcaggaaaggaaaggaaatgaatcaaggaaaggaagcaggctcagagggctatgcttacagagacacagagtgcagaggaacctgggagagccgtgaggtgtttacagacagcttccacagatcccaccgcctggaccctcaccatggtgagggcaggtgctgttatcagtgcttcactgacgaggcagagagaaagttccatcggcacccaactaggatgtagcagaacagggcagagtgtgatcttggttctgttacctagagcaagtcaggccctctactctgctacctccccatccttcccctcaattaaatatggacaggcatgcacactggccactgttcccatgtgtcacttcactttacagttctccaattgaggccacggaagcagcaaagaaaacagtctttacaaactagacatgaaaataatggtgatgtttaattatttaaaacctacccaaacggaagccacaaagtcaaatgggaaaaccacaggctctgaggccacacaggcctgggttagaatcctgcccaaaccttaagttgtgtggggtgagttacctgcctccctggacttctctttccttatccataaaacagacatctccacctaccttacaaagcttttatcacagggcctgagacacagtgggtgcttaattaacaaggttactgctgttaaatcacaaatatataattcagacaaaaagaactttgccaaagccaatataagacattccattgctctgcatattctcaaacaacaataaaaaaaaagaaaccattatttaaaagtctgaactataaatttcaaaattttccgagaccaaaattagttaattgattttctcccaactctcctgaaaccacctgttaaaacattcatctcattcattcatttattatttatttatttttgagacagggtctctcgctctgttccccaggctggagtgcagtggtgcaatcacggctcactgtagcctcgagtttctgggctcaagcaatcctcccacctcagcctcctgagtagctgggactacaggtgcatgctacaacacctggctgatttttgtattttctgtaaagacaaggttttgccatgttgtccaggctgttctcaaactcctgggcacaagcgatccacccatgttggcctctcaaagggctgaaattacaggcatgaaccactgtgcccagccatctcattcaataaacactggcactgggtactgggatgcagcagtgggaagcagagattccctgatcctaagaagcctgcaatctgaaggaagagtaaaggaggcgaaaagactggtagagcaacaccaagtaggcaggtatctaggtgggaaatgataatctcaacatgagcaggggcagcagcaaaggcgacaataaatacaagctattaacaggctgactgagaggtggaagagctactgcttaggctgtaagttcctatggcccaagccaattgcctcagcattgaatgaatgatgtcactaaggaaccctgctttgattagccagcctggtgtttttctttttcttcttcatggtttcaggctgaaaagtcagtcaaaaattattaaagccaccatttactaagtacttactataatgcttgtaaagaactatgctaactactttccaaacaaatacagttgaccctcgaacaatctgtgtttgaactgcatgggtccgcctatatgcagattatttttcaacccaacacatcttgaaaacacagtctctgagggatttgaaacctgcctacacggagggcctctcatacccacacgttctgcaggactgactgggggacctgagtacgtgagaattttggtatactcaggggtcctggaaccagtctctcatggacattaatgaacgcctgtatatttcaatctcacttgttcatttattcatctatccattcattcatgaacaaactatcttctaaaactaggcaactgaggctgagagtgaaatcagagagacaaagcccagtactcaaggagagaaagagagcacagaccatcacccacgggctgagggttagaaaaggagcttgctctggagtttcccatggggaaatgaccacacctggggctcagaaaaatttccctaaggaaaagacactcaggtctttcttgagacttgagggttgggagagcaggtagtgtagaaattctggaggtggggaactgtgatccaggcagaaggaatatgatgaggtgactcatctgagagaggaacacagtctagactaaggatgaatgaccgtaatagtgaatcctaaggaggaagcaggagaagggccggcggtgcagccggaacgatgcgcagaggagcgccacactgaggagttcagtcaggagggccttgtggtcagatctcctcctcctgacaaagattccgggagatcagcaggacgccagggtaataaatatggagagaaagggcggtggcttgttaggatggaagaggtggggacacagagaaactacacagttctccgagtcctagcctgggcagtgcagggttgtgccatctgggaccagggaacaagatagtgggaacacaggaatggggtagatggtggctttgaagtacctgggaaacatcggtggaaatgtgggatgggcagagagaatacatttgggaatcactggcatgaaggtggtgtgagccctgagaaagaatggaattgctgaggagaaggtgcagagtaaacacagaagcctccagactgaacttaggagcaccggcctttaatcctcgtatggatggggagggcagtcatgaaagcctgggaagctgtggcctgaaaaggagaagggcaaacctagggatttaagaaaacattgcttcaaggaggaagaagaggccaggcatggtggctcatgcccgtagtcgccagcactttgggaggacaaggcgagaggatcactcgagttcacgggtttgaggccagcctaggcaacacatacccctcaatgtccactaaaaaaaaaaattagctaggcatggtggtgcgcacctgtagtcccagctactcaggaggatcgtgagcccaggagtttgaggctgtagtgagctatgaccacaccactgcattccacattccagcctggaccacagaacaagactctgtctccaaaaaacagaggtcagagtactgagcactcaggcaaggtgagaagactgcctggtgggtgtggcaaaggggtcagagggtcttcagtaagaacaggctctgtggtgtggggaccacagcgagaggagagtgagcgaggaaccacggtaagggtggtgactgcagacgcctcgaattccgaaaaggaaggaaagatttgggagaagaggcgagctggggttgtgggagttcttttgaacaggtggaaggaattctgcccatgggtgggcatggataaaatgtagcacaaggcccctgagaagggacttggagcacatggtggggacacatgtctgacagaggcacagaaggagggaggtgtgtgcgcggacagctttgtgaatctgggggcaggaagtcgcacctggaagttcactgtttcctctgaagaggggtcgaggtcaggggaggggagggatcttcccaaaagcaccagggctggaacctgggaagacaggaagagcagaagaggccatggagctggtacctgataaggtccctgccagagatgtgaccttccaactagtgctaacaatctgcccaatgctcttttcctcctcaaaaccaccccacaaagtgggtaacaattctccttccatggccaggcaaacaggggccgagagaggttgagtggcctgctgaagatggcgattctgacagcagggctggggtgtgaagcccgagctccctgaccctgacgcatgcttctgatgacaactttaacctgcccctcaaagcagtcaacaaagcctctgcgctcacacccagcccaacacaaaaaagggctttcccaagtgctgacacagcagcttaaaaagtgggtagtgaagtgcagaaggtaagaaggaatttatgatggcatcaagtagaagcagatgggagtttggcaaaaagtttagaactattacttaaagaaaaaaaaagaagaaacccttctttttttaaaagatgaaacacaacttaaaatagacttgggaagcaattccatacttaacagtcttgaggaagttgacagacagctgaaagacctaagcaatttacaacattcttcacacttcatggcagaaaattaagattgatgtctcaactacacaagaataatttaaggtaaaatcaaagatctgctagatcatgtgaaatggcagatcctaaacgtcaagaactctgaataaattccactccagggaagactaaatagtacacggcttagttaatactatatctttaaggtctgcttattacatattacaaagaagtacaaacagataccaatcatggtttatagggaggttactaagcaccaggttctctactatctctaatcctaatacattattctatatcctaaaacattaatctattttcttccatctttaatcctacccctgtaaagcagtcttattttgaatacgacagaacagtgcctgagacatgttaaaataacttgcctgatgtcaccgtgctggactgccgtgcacagccagtatttaacccgttgttgacgccccttcccctgcctgagggattcccaatttaatgccagcatacagcctgcaataggttttaaattgcaacagtatcactaaacaatacctacttttactacatgaaacccactctcatacgtccttttcttcgactttctcccctcttttttttaaatgctggtatctaccagcattgatttcctgacccactaaacaagccctgcctgacctgaactctataacacaacacagctcattgacacccaccattcaaaacagcatttctatgtgacaatgtgctttgtgttctaaaaggttaatcaacaaaagaacgtttaggacacaatctcttcacagcctgcgtgtaactgaagcactggctggaggtagtggctgcatctacagattcaagttgggtcctttcacctggactagttctcaggaacttcagatgccaggtacaaatatatacctaataggcacacacaccacctgcatcaagacaacacttttggacctagctaactttggcaacttgttgggctgtttatgaagtattaaatctgccacaacattagtgatacggtgataaagcacagtgctccatgtttcttctacttcccatagccacatacgcaaacagcctgacagagcagcacatattttaaggcttacaggtttcagtggttgaaaagcttagtctgtttgtgtataagctaatataggagctgctgggctgcactatttacactttcattaagggctgcactatttacactttcattaactgtgtctctgtggatgttttgaagtggttttcatctgataaaagaatttactggccgggtgcggtggctcacacctgtaaccccagtactttgggaggccaaggcaggtggatcacaaggacatgagagcaagagaccatcctggccaacatgatgaaaccctgtttctactaaaaatacagaaatgagctgggtgtggtggcatgtgcctgtaatcccagctactcagaaggctgaggcaggagaatggcttgaaccagggagtcggaggttgcagtgagccaagatggtgccactgcactccagcctggcaatagagagagactccatctcaaaaaaaaaaaaaaaaaaaaagaatttacttatacctcatgactcagcttattcattaacccagtgaaaccccggaggagaggaggggaactggagagagaaagagaatgatgggcagccaggcagagctgagctagctcacctgcgaggtgagtcatggcccctgggagggagggtgtctgtcaccaaaagcagcctctcccaacctattagagagtcacagaaattccgtatcaatagtaaatgggacaattttgtctctggttccctttaaccgtcccttgccatgctcctagcattggaagcactcagcactttcctgatggtgccaggatgctgcgctatgaacatgagtcctcttcctaggcctgcctctcacctcttcccacctgctagccctgcaatccacctacagatgcagagcagctccaggacacatcatacacgatctgtcaccaccaagaaggtttgaaaaaatgccaacaccacctccttgaacaccaggccagctcctccgtgccttcatggagccctgtgcctgtgcttcccatcctctgtggagagagaacagtttattttaaaggaagggaatgaaatcctctctccagactatgggttgccttgggacgatgaaatttacttgttgtaactggcaatatttgacttcgaaaaagagttacacttctccaaaagggaaatggataaagaatgaggatgttatttttattttccacatcaattttacgctttgccttgatgagatgatgtgctcaatgactaatttatttcattggtgagttctgtctagaccctacacgctgaaaccctgaaggtcaccaaatgtccccaaatggtggcgcaaatctgagtaagaattgttttgattttgaagtcccatcctgcctgggcatttaacacaatgattctacacttgtattgttgtttctgcttttaaatgaccacatcacttccttgtggatttgggatcttaggaggactattccagctctttattttctttttccttaagtaagctgcttccctgttacgggggctgttgctgctgacaccagacctaaagacagcattcaggtctgaactggagcaggttaggctgctaggagaggaagcatgctgagtgacattactcttgagtctaacacaggtaatacagggggatgggagaaggagaaagtagggagagggagagagcgggacagagagaggaagtggaaggagacagtgagcctgcaggggaatcagggagagcgaacttttcccatttgctgaggaactgcttttattaatagaaggtggcaactcccaaaattcaaagaagtaacaagttcttcaccactcctggacattaaaaggatctgtgaaattctttgccagcaggagaatacgatttttaaaaaagtgatattgacattgttcagctttccagactcaagtcattaaatctctaaattgttctaaatattcattttgctttctacattctaaaagtgtagagcttttttgtctatttaaacattcattgtaaaaaccaactggttagataaaaaagtcaagccaaaagagagaaatgtaaaaaactaaaacaagccaggtgcagtggcacgtgcctgtaatcccagctactcaggaggaggaggcaggaggatcacttgagcccaggagttcaagtccagcctgggaaacaaagggaaccctgtctccaaaaaatgttttaaataaaaacaatattaatacaatggcaagtgtgatattatcacatgccaaagtatttttgaatattttataacattgtattttaaaattctcaatgacctgagagtttcctacaatgtcaaaatactcaacacaaattaggaaactgaaaaacaacttctgaaagtcaggtatacagagagaagaacacagaatgctttttttcattctttgttttttgagacagtctcactctgtcactcaggctggagtgtagtagcacaaccacggttcactgcagcctcaacttcccaggctcaagcaatcctcccacctcagcctctcaaggaactgggactacaggagcttgccaccatgtccgggtaatttaaaaattttttttgtagaggtgggatcttgctacattgccagggctggtcttgaactcctgggcttaaggaattctcctgcctcagcctcccaaagtgctgggattacaggcatgagctgctgtgcccaggctagaatggtttctgtaaactttatcttttactttttttgttttgttttgtttttttaagacagggtctcactatgttacccaggctggagtgcagtggctattcacaggtgtgaccatagctcactggagcctcaaactcctggactcaagcaaccctcccgagcagccagggctataggcacgtgccaccaagcctgcctacacttgtggattttataaagtactctctacatttctttccctagaaaaaaatattaccaccctttagattctaattctaaagtgctacatctaatacctctaacataagtaaagtctcattttaaagcatgtccaatgaataaatttgcttctactgcctttgcatatgctaagattttgatggaggaaaaaaaaagtacctgaaagcagctttcatggaacccagctataaagctccacaaaccccatttttccagtgagctcacagatagtaccctgtgccctatgtcagcttagggcagcagttagaggcctttaccaacagaaaagaaaaagcctagcttgcttctaaggctacatacatccagatctgttccaccaaaatcaaatctgtggcaaggaggtccatggctacagattcttctgctatgaggcacccagggaaatagtccagaggtctgaattgcaaacaaaataattttaactaatataaaaaagaccatctgttcagtaactaattcccttgaggacatgatatggaagtcaactatccagcttccacctttacatagtatataaatgagaagagaaaagcgagcaggttgggtgcagtggctcacgtctgtatcttaacacttttggattatttgagcctgcccaggagttagagaccagcctgggcaaaacagtaaaaccccatctttacaaaaaaaaacaaaaaacaaacaaaaaaacaataataataataataataataataataattagtctggagtggtggtgtgcgcctatagtcccagctacttgggacgctgaggtgggaggatcacttgattgcgccactgcactccagcctgggacaaagcaagactgtccaaaaaaaaaaaaaaaaaaaaaaaaacagaaagaaaaagagaatgaatgttaaaatgtaggcagaggcatgaaaaatagaaaagaaagtcagcttgcagagccaagtttatatcttaccccaccctgatgtggttggccaacagctgatagagggcttttcggtaaagtaggtagaaacaaaccccaccaaccctcaggttaccaggcaatgtgccaccatgttattaaagccatcatggtgagagttcctgggcaggcagcccgctggaatgctgagtcatctgttcccccgctcacagctggccctcctccccagcacatgctctgcccacaagcacactctttggggaatgcattaggaagcagctacctgaatgtatcctgaaaatcacagacaaggcactaaacacacacccattggagcctgttctgtcacaactcaagccagagtgcaggcataaatcactgccgtttctggaaagagcacaggcacaccttgcactcagctctctagaggccttagctaaatgctgtttagattatttttaaaaaatgtggttttgactggttcaggatttaaaagagttaacaaacatcatatgagcagaaggcacaatggaatgagtgtgtacactctggggtagacagctctactactggaaggccacatgcctctctgggcaactgttttcttatctttgaactgagatgctttccacagttggcttcagggaaagcatctaagactggagtcacaacagagtattcacgcatggggcaaggggtggggacgctaaagctgaactttgcctttagttaaaattacccttgaaacttctttcttcacactggagaacatgcgtctctcagtgaagccaacacagctggtttttcctccagggtcagaacacactactgtttctcctctaggacatcagaggaagacgatggcttgcatgtgagcaccatgttattaaacacacatgtacacacatgtgtgaacacacatggtttataaccagcaggaagcttgctacaagaagagtgtgaaagttgatattcacaaggaaggggcagaatctacatctcccatttcatctccaactcactgggataaggataaatacttttgctgagtgaagtgacaagcaaaaccagtctcacaccctaaaaaataattagccacatcaagtacatttgaattcacacaagtttcaaaatgttatgatgtaactctacttggtacctagcaaatatacgatctaagcctctgtgcctgtcctctggtcacatgtacccaagctagttctctgaagacaaggaaggtgttttagctattctatacctccagtgatatttcttcaggagagaacagctaatacagctacttctctctgcttccgaacagccctgggcttgcaattactacaagccactgaagaaccacggcttaacttcttagggcatggattttaccagagatcagggaggaaaaattaaataattaatctggcaatttaaaacaaattaatattaaagtaaaatggacatattgcagaatagcatttttttaaattgtgagaatggtttaaataaaacataagacggtagagatatttcaccttctgcccccctcaccccgctgcgcccctgagtgctcctatccacgctgctttggtgttgtttgagaagaacctccccccacagaggcactgatactagctgaatggattctcctttctggggaatgagaacaccagaaaggaaaagagacttccaccttctcttcttggcagcaaggaggtgaatgtaatgtccacatgagggtagtttatacatgtcaatttgtattctaggtgcacaaacaacactcagagagctgtaaggagttctctgtggttagaagcaattctgaaaagagctgactcatatgagaaaagcgtaatgcagtatctatttcttttagcaaaggtgatagaaacgcacgtatcatgaatatgtcatgcaaggaaagatgagggcagcctaagctgagaaggtgttcaaataaatttcctgtttgaaagggattatgatactgctcttttccctacctacctgtggacacaacagaaaggtgggaatcctgtcctataaattcaggttctggccctcatttgccctacaagtatttcttagccaaggtgaagtggtcacccgtgcatctaccaaaatggtctggaccactgactgggcaggttttgagaagcatggtcacctgcctcagggtggtagctatcatttcctgagattatatcacaggtagtacacgctgccaatgctgtaggctctgttaccctcactttatacagaaaactgaagaccctgttgaatggcttgtccatagtcttgcagctggtataaggagaactggaatacaaattcaagatgtttcaatcatacaatgctgcaaggagctgatgtcaaggaagatacaaagtaatgaccacctactctgctagcagatggtggtaaattgttcttagaagcagtgaaccaagggcatgatatcaacagtccttgtgtgtgccttcttcagcagagaggtctactgactgtcagtgagtgttctgtctaaacgagaaggggcttagagaggatcatatcctttgacctagtaattcctcttttaggaaatcatcctatgaaaacaatctgaaatgaggactaatttttaatgcacaaggatacgtaaatttttaaattaaaaatgtcttcaaaacacaaacaaatgtttaatagtaggagaatagttaaataattatgctattcatattcattaaaaattatgtgaggttgagggaggccggcacggtggctcacacctgtaatcccagcacttttggcgaccgaggtgggtgaatcacgaggtcaggagttggagatcagcctggccaacatggtgaaaccctgtctctaataaaaatacaaaaaattatccgggcatggtggcatgagcctgtaatcccagctactcgggaggctgaggcaggaaaatagcttgaacccaggaggcggaggttgcagtgagcagagattgcgccattgcactccagcctgggtgacagagcaagactccgtctcaaaaaataaataaataaaataaataaaaattacgtgagggagaaagtagggagaggggagaaaaaatacgctttcaaagcaataataaccaaacaaaatataatcaataaattctctggctagctatttgggaaaaagtaacatgaatgcctctctcataggttataccattgactcaatcaacaaatatttgctgatcacctattttaagcattgagaaaaacttagaataaaaaaatctttgccctcctaagacaattcgttaagcagtacagtttcatatgggtattttcctatatgtatgttaagcctccatttaaaagttaaaataaaaagcctgacttcatggatcttacattctagtggtgagatatagacactaaacaaaaaagtaaaatatacagtgtacgtgcagtgctatggagaaaacaaaaagcaggcagtactgagatgtgggttgtgattttaaattaagtggtcagggaaagtcttactgataaagttaccacataacaatgcaagatgccaaatttcagataaattacatatcactgtttagtatatcatacaatatttggcacacagctattttaagtgaaatctggcaatcttacttactgaaaggcaagtgaacaaacctcattcctaataaattaaatgttaatgcttctgaataggacactaaagccagaaactataaaagaataaactgacagatatactatggaaaatgtaaagctttggttcggcaacataggctagattaagaatagctgggcacagtggcgcacgcctgtagtcccagctcctccagaggctgaggtgggaggacctcgagcccaggagttaaaggctgaagctggagggtgctataatcacacctgtgaatactgggtaacaaagcaagatctcgtctcttaaaacacacacacacacacacacacatacacacacaaaactgtacaacaaattgggacaagtatttgcaaaatacaaaactcaggattaatctaagcatcattttctcctataaaatgaggggagggggaagatacctgtggttcatacaattataaggatttcagaaccatgtcttgtacctaataaccaatggttcattaaatgtaataaataataatcatgatgtaggtgtacttataaatcagcaagaaaagcacacaattcacaaaataatatcaaccaattaaacttctgaaaataattctagtgtcagctttggcaacatgtgaactaaaatttgaatgacatccttgcacaaagaggtcacaaaattttaaaagcaatccattttttaaaaaaatcatcaatggacattaatgctgctggatgaaagattactgaggaacagggtttcacagtctcaaagtattactcacagagtacttatttattacaaagcaggaaggctacaatggaaaaatctgtgaccactatttacctaaatgatgtcaaaccagacatcagcaataagggaacaaactgataccatgtgcctctcagtgtgatgcactgaaaagagcacatcaactacgtggtactcccgccagaaacatttaatctgaatcttatcatgagacaatcagaaacatacacattgaaggacactgtaaaacaactgatctgaactcctcagaaaaatgtcaatcttgtgaaaataagaaacaggctggggaactattccagattaaaggagactaaagactaaagagccatgatgactaaaagtaacacaagactttgactggagcttggatccaaaaataaaaatagaaaaactgtaagggacattattaggacatttggggaaatttgattacagcatggacattagatcatatcaaaatcatatcagtgttaaatttcctgagtgtgataaatatattagggcaatatttttaaaaagcctgtgttcttaagagaaatacactaaaatacttctaagcaaactgttatgtctctgactctcaagtagtttagcaataaaaaacaaatacatgtatacatgttcacatatgtacatattatgcttgtgtatatatgtgtgtgtctgcagagagggagacagagcaaatatgatagaatgttgccaacttgtctataggtttgaaatttttcagaatcaaaagtgaagctgaatgcagtggcacgagcctttagttccagctacttgagaggctgaggcaggaggactgcctgagcccaggagttcaagtccagcttggccaatatagtgagatctcactgcctttaaaaaaagaaaaagagtgggagaaaatattaataaaaaataaaatgcatgaggtctaactccaaaaacaaacaaaaaaggaaagaaaatgcattctctctcagtagtaatcaaagaaatgccagtaagaatggttttgaaaaagacttaatgttggagaagcgtaactaatataaccttttttagagggtgatctgacaatctataagaaattctgggccaggcgtggtggctcatgcctataatcccagcactttgggaggccgaggcaggcggatcacctaaggtcaggagttcgagaccagcctgaccaacatggagaaaccccatctctactaaaaatacaaaattagctgggcgtggtggtgcatgcctgtaatcccagctactcgggaggctgaggcaggagaatcacttgaacctgggaggtggaggttgcggtgagctgagatggtgccactgcactccagcatgggcaacaagagggaaattcggtctcaaaaaaaaaaaagaagaaattctgattctgaaactttgttgaaaccagctctctgactctatcatgtaatcaacagaggccaagtgaaggccaggcgtggtggctcacacctgtaatcccagcattttgggaggccaaggtgggtgcatagcttgggcccaggagtatgagaccgacctggccaacatggcaaaaccgtctctattaaaaatacaaaaaaggcatggtggtgtgtgtctgtagtcccagctactcgggaggctgaggcgcaagaatcacttgaacctgggaggcagagattgcagtgagccaagattgcaccactgcactccagcctgggtgacagggggaaaaaaaaaagaggccaagtgaaattctagagacttttaatttcccatttgcagctctttctttcatacgaaattcctacgcccaaagaggtttgagagtaataaaaattgtagtaaaaatacaaaataaatgaaagatcctataataagaatactattgagtaaataaattatggcatatcaacttgatggcttatctaatgcagtcagttaaaatttaaaatgatttcacagagtttaaacaacctgagaacatttctcaactgttaatgagaaaagcaaatcttcaagtccatctatagtatgattacacctacataaaataatgaaaatgatactgtaagaaaatatgccagaatgttatcataattatttctgggtgattatgtttcattattgtgtgttttccaaattttctgtcataaatatgtacctgttttatttttataaatactttttatcctaaagtggcaggtcaatagacaaataacataggcaggcaggcaggcaggcagatagatagatagatagatacatggatagatacatagataagacagacaaataggcaggctgggcatggtgcctcacatctgtaatcccagcactttgagatgccaaggtagggggattgcttgaggccaggaattgaagaccagcctgggcagtagagtgagaccccctcatctctacaccataaaaaataatagtagcaaaataaattttttaaaaaataaataaaaataaaagataaaacgtgtagcattcctggactcagaacataatataagatttttgttattatagtgacctgatttagaggatctaaaaagtgagtgtggggaaatgcaggctcacattcccatagtgagacactctgtaataaccagagagaatttataaaaacgaaactttaaaataactataggcttaaggctaacagatatatcaaaaatatagaaatccctataatttctgaatgtatgcaaatcaacattgtaggctgacaatttccaacatttgatagaattttaaaattattcaatgttgtatgtggaaacttgaaaaaaaaaaaagataatttaaaaattattctcagggggcggggcatggtggctaacgcctataatcccagcactttgagaggctgatgtgggaggatcacttgaggccaggagttcaagactagcctgggcaacacagcaagacccagtctcttaatttaaaatatatatatatatataattcaaagtaagtggttctgagaataataaaattatcctgagaatccagaaggtaaaaaaattttttaaaaggtaaaatttccaaagaagcaattaaattataaataaataaaattattctgaaataattaaaataactcaggtgacgtcacccactgagactgactcttaagaaagacgcccctttgcaatgagaaaggtatctctctcctacaaggttacagtaggtaagatgtttttggcttatggtaaacagcttgtttgagaagttgcctaagaaaagtataaaccccgtgtcagctgtttgttagacttactcatcagcccctgatgtggcatccagacaccacctacccacccatagataatctcttggcaacatcaccactaagctggccctgctggctcacagaaagaacaaacagcgcacttaggagctactgagctggaggtgaagagaagggaaagaaatggggctttatttaacaagtgtgacttactgcatgattatttagtgattttttctttggctaacagtttattttaaatttttattgaaatggtaaagcagtttaataactaatcctttttcatgtgaaaggacctttggaagatgcaaattttaagccctaaaccccatccatcacataagatagataacaaattatgaagatcaattctcatcaacattcaaagtctacccaccaatattaaactctaacagttggtcaaatccaccaatttctaagagcacttgaaagatacttttatttacatattaactgcactaaacaagtactggggcaaagtgtaaaacttgcttcatataatcagtacatcctcaacccctggaaagctttccatgtttttctattcttcaaggaatacatctttggcactgaatttcttttagtagaaaaggaagataatgggtaagtgtccttgttattgctttggatccctcagaaatgggtttcgcaactcaccagagttggaaaacaaaaatgtgagggcctggttgattctaacatactcctaacaattatctttcggtggagaggactaaatcctcacccagagcaaacaaacaaaaacaccccaacagaacaatggcaaaaacaactggtaggatgttcccgttgagaaggattcccggatcacctaaagattcctcctgtcctctactgggtgttgctgccagggcatttcaggcatctttgcagcccgagactctcctcaaaggaaagaacagcaaaggctgggggaatatgttcatttgtgaagaaaaggaaaatgtcagggtcgttttcaaagcatggggtgattagttttgccaaaaaataagtcaacaaaaactgcagaaaaactgagtaaagctacatattctcctaactgtaaactgccatcaaggtggctcttttaatcattacatataaaatatccaatgtacccagtactgttatttttctatcattttggcgaattctagtgggaaaaaaatgaagaatggggaagctataaacttaggaataattaagtgcctacactgaaccacaaattatataggactttgtaaaaatttgtttaatccacaagtatggaagaaaaattaatctttatgatttaaaaaagaaaaaaactcagagactcaaagagaaagaaaataattacttagttaaaacaacaaataaggaaacccaaacttttagctggacttagtttcttaatctacccttctgcttttttgaagtccatgccagagaagtgtgttttgagcctagatctccatgctccagtcctcggctgccaacagcatgaggcccaggacagaagtcctgccacccccatctatgtgacatggtgttttgactttgccatgcaggcaatgcttatcacctagccaaacttactcttctgttacgctaaaccaggagggggaaagacaaggcaaaggaagaaaagacatctataaaaacagcagaaaatgtttctgaggcaatttttcttttcagaaaaaaactgagccacagaggaaaaaatattcaccaatgtcaaaagttctgaatgccacccaactataggattgctcaatcaaggtagtttctggatcatttctccttttaaagagccccatgaatacacaaaatcagatcaaaagttcttattcttccactatcacatctatgaaattatttcctttaaattatacattagtcttcccttgttaaaaaaatgtaagaaataaaaattaaaaactcactgctagcttaaagccttaagcactagcttgtttacctccatgagttgacacagggtgatgagtccaaggtctcattatcttttaaaggtcaaggatgagatagcttggcttgttcgatgaacacaaggctataccctcaacaccctgctcagaaatgaatgccactgtttgttcacaaaggacagggaaagagcgtctagacagattaacacaaatccattcccactgctgagaaaccccaaaccacatcctatttgatggctcattaaaaaaaaaaaattacttgggaagtgttcaggcagcagataaattcctacactagtcagaaagaacagctaatcaacaatacatcacacataatataagcttgactcaatgagctcaaatcatgacaaaaatatgagactgagacatacggttcttctctgcctcctaaattattgggtgtagcagtttcaagcagagatccatgtatacccgaaaggttaaatgcatccactatgttatggtatgttatgttatgttatgttatattttagacacagggtctcaccatctcacccagtctggagtagagtggcacgatcttcacttactgcagcctcgaactcctggcctcaagcaatcctcctgcctcagcctcccaagtagctgggactatgggtgtgtgccaccatgctcagctaatttttaaaatttctttgtagagatgaaggtctttctgtgttacctacgctggtcttgaactgtcctcagtctcagcctcccaaagcactgggattataggtgtgagtcaccaggcctggacattaaatacatctataacctacttcacaagtaattctgaaaagtctctagggtctaaaaataaagtgatttttttccttccttctggaagacataagttaaaaaggcattgtgtacaaaagtcagtatgacaaagaatttaatcttccactgtgtagctaagaattaccatttagttgagaactccttgacttgtcatgactgtgctaagtgttgtattaataatcgtcctggccgggcgtggtagttcacgcctgtaatcccaacattttgggaggctgaggcaggcagattgcttgaggtcaggagtttgagaccagcctagtgaacatgctgaaaccctgtctctactaaaaatacaaaaaattagctgggtgtggtggtgcacgcctgtagtcccgaggctgaggcacgagaattgtttgagcctgggacgtggaggttgcagtgagccaagatcacaccactgcacttcagcctgggcaacagagtgagactctctcaaaaaaagaaaaaaatcatctcacccaacctgatccatcctgtgaggtctgctctaaagacacctgggggaatggtgtgtctatgaggaggaggctcactgtcttgctccagatgtgcatgcaaagtattacttcagcttcgttttactcaggaggacacctgggctcagaaacctttgataagaaatcaagggtgggaccccagaaatccaagtgggaccttatgggactccaaaaatggagttctttccactctgccttattgcctctgatatgtttatccatacgtttctacagaatttgaccgttcaggtaaaatcagcaataaaagcaagcactcttcttgcacatttttaagcggtttttgttgtggtttttattttttaatcttacagctcaaataaatgtttctctaccagaagcacttaagaaatattatcattatttttgagatggagtctcgctctgtcacccaaactggagtgcagtggcgtgatcttggctcactgttgcaacctttacctccaggattcaagcgattctcgtacctcagcctcctgagtagctgggattacaggtgcgtgccaccacacctgactagtttttgtatttttagtagagacggggtttcaccatgttggccaggctggtctccaactcctgacctcaagtgatctgcccgcctcggcctcccaaagtgctgggattacaggcatgagccactgcgcctggccaaaaatattttcaaaacttcagcaaataaagtataattatcaaaaacaaaatcattaacgtaatataaactgctcatatataatacaaacatgaactatttactatatatattcattttacctgagctatgctttgttctctcaaaccattttgaagccatggcccatggattctaccagtaatgattagcgtttcgtgctgggagtcctataaaatcctgtcttcattacacataatgtaccatactttatgagttctggcccaacaggttaccttatggctaagaactggagctactttttagatagttcactaagagcaaaatctgtaactgggccagaaggctctgcacatggcctacctgtcttccagcttcctgctccctcccctgcccgcacaatactgcttggcactggccttctgccactcctggaacctgtcggcccttctccctgttgtggctgagcctttagaaaaggcgcttcatcatcgtggagcattcctgccactgtcacaaagctctcactgaccattctttcacttcttggagcaaaactctctttcttagagaagcctccctgactgccgcagacgaggtccgtttaccctgttctgccctctcaaagcactttctaccctttactggactaatttctgtctctcccactagactgcaaactccatgagggcagggcatctgttttgttcaccacagtatcctcagtaccaggtcagtgcccggcacacatgcattaattcaacaaacatttgagcactagtgcacataagggattgttgtaggcacaggggacatatcatgaacctcagattctagtcaaggaaacaagacaatggtgggggtatggacaaaaggaaacaatcagtgcttcagaaaaccagatagcaaggaaggggggatataagagtcactttatttatttaatttaatgtaatgtcattaattaatttatttttttgagatggagttttgctctgtcacccaggctggagtgcagaggcacaatctcggctcactgcaacctctgcctcccaggttcacaccattctcctgcctcagcctcctgagtagctgggactacaggtgcccaccaccatgcctggctagttttttttgtatttttagtagagacagggtttcaccgtgttagccaggatgatctcgatctcctgacctcatgatccacccgcctcagcctcccaaagtgctgggattacaggcatgagccaccacgcctggccaagagtcactttaaatgcagttgaaggcacaacatcattaagaaattctgaacaatcatttgatggaggtgaggtgagggagactgaatcactaaatatctgaggaaagatatttcctcagaaatatgccatacttgtaatataaaataccatacttaaaatatgccatattttatgagttctggcccaaaaggttaccttatggctatgaactggagtaactttttagatagttcactaagagcaaaatctgtaattcggccagaaggccctgtagcacgtggccagcttgtcttccagcttcccaagggagaagggaggaagcagtgagtgaaaaggccacctgaggacctgtggagtatggtctggaataagcaagcatatagcagacactccatggcataaataaggctgcacggggaagctacgttaaatcaagctgttaattatcacagatgccaaggtgaagctaagtttccatcatgtaacttctctgtggggagtaacacagtatgtggcccaaagaacaaacatctttacgaatcaacacttgcctgttccttattgttccctcaaccaaacttgccgttgtcactgtgtcactgtgctggttactcatttcttcaccaaattccagaacatatacttgtttttgtctcttactgatcagcctttgagatgggatcttgctatattgcccaggctggacttgaactcctgggctccacaatcctcctgcctcaatctcctgagtagctgggactataagcttgtgccaccactcctggctgctaactttttttaaacagatgtcccgaatataaacatgaattccacctcaggtagcaaattctacagtatattttgttgcagttttactggtttcactggcctaacaactgaccttaaacatatgtagatggaaatattttattgtcaatttaatgtttcctcagagattttagcagtaaaaagaaaggaaaacagccactagaggtaagtgaagaggactgcatttaaatcccataaagcagtggcagaaaaaattctccctacggccaatgaatgcatgacagaaggacacgcctaaaaaagagatgaaaagctgtacctaatattttgaaatcaactaaaagatttaagataataatatatgaaagaacattaaggctaggcatggtggcttgtacccataatcctagctactcgagaggctgaggcagggggattatttgagcccagggattcaaggccagcctgggcaatacagcaagaccctgtgtcttaattttttttttttttaaattagccaggcatactggcgcacatctgtagtcctagctactcaggaggctgaagcaggaggattgcttgaggccaggagattgaggctgcagtgagctatgatagcaccaatgcactccagcctaggttaacagatagatactcgactaaaaataaataagtaaattgatagatagacagacaaacagaatgaacattaaatcagaattaggaaatctcagaaatgaggtcacagtactcaagaaaacattaacactcaaaaaaaattagatataaaaaggaaaattgttttatgagggccaaattagaaaaaatacaagaataaaaaaacacaacttgccttaagagaaacagataattaaaagataaaaaattttaaaaccaaaaaagaattaaattagataattagaaattaaataaattaaaaatgacttgaaagaaagtgacacagatgatgggcaaagatccaaatagctataatagaagttttcatagacaaaaacaaaagcaagggaacagaacaacgctgaaaattacaactcaagaaaactttgctcagataaccaaaaaaggctcaatattgcatgctgaaaggctataccgcatacatctgcgaaaacggatccaaaacaactagtcaaaatatacatttcagtaaaactaggagacttaaaaaaaaattcagcgcatctggtcaaaaagagtaagtcaagaaaaaaaagtcagattgccatcacactttgagagaagcatttcaagccaaaataaaatggaacatatttaagattctcaaagaaagaacatttgaatcaagggttctttcatatataattttacacctagctgagcctactttcaagtacaaaggcttctgacaaactaacattcaagaactcagggagcacttttcccatgactcttccaaaaaaatgtagtagatgaccaaactcatggaacaaacatcatcgtaggaactgagagtgagaattaaatgtacacttacctgtaaaacagagactaaatgatggttataagcgttagcatagagtatacaatggctatttgctctgacaatgtaaatatggtataattattttaaaaagaaaaggacagaatgaagagggcacacaagaaggtagaataagagtgctgacttccttacagctaataaagggtatttttctaaatcagacacagaagagggaaggcagggaaaataagagattatagctaatttcaatattggtcatagtagggtaccaatagacaatgactaaaaagagacaagactgaagtactgtataacgttatttgtggcagactgtaaaatggcaaaaaaaatccttcctttttatgcatgccccttgcaatgtgacttttctgctcctgccatcaagaggtgcggtgtatttactgctccccttgaatttaagattggcatgagacctgctttggctgaaggtatattaacaagcataatgcaaactgaggcttgcagggtagcttgtgctgtcttgctgctgggaaccctttggtcaccatgtggacaagctggactagccatctacaggatgaggggccacatggggagaggctcccactgtcccagtaatcccagctgagacaccagaagtgtgactgacgtcatccaatcccagccagtctggcctagaccagaactgcctaggcaacctatggaattatgggaaacaggtaagtattgttttaaaccattatgtgttcaaaaaatgaggtttagaacgaggaggacatctgaaaaatagaatatgcttgacgactgccttataagtgaagagcccatatgcttatatgctaaaaaacagaatatgcctgaagattgccttataagtcaacagaaaataaaaggttattttttctttttttgagacagagttttgctcttgttgcccaggctagagtgcagtggcaaaatcttggctcattgcaacctctacctcccaggttcaagtgactctcgtaccttggcttcctgagtagctgggattacaggtgtgcgccaccacacccagctaatttttttgtatttttcatagtgatggggttggccaggctggtctcaaactcctggcctcaagtgatccacttcggcctcccaaagtgctgagattacaggcatgagccaccatgcctggccaaaaggatatattttcaaaccagatgttgagggggtgttatctaatttcaatattcctattagaaaaataatcgataatgaaaaacatggggagtggctatggtattacataatggcatatgtagcccttagaacaaaaatttaatttgctcttttttaaaaaaccctcaaaaataataaaaataatacaaattaaaagagatagagaataaataaaacagaccacagagaaagactacttcatatacccaggaggtcgaggctgcagtgagctgagatcacaccactacactccagcctaggcaacagagtaagaccctgtctcaaaaaaaaaaaaaaaaaaaaaaaaagactactcatattaaagaattgcatacatacatatgtaatatgaaacaatgacagagccaaggccaaacatattggctataccaatacatttaaatgggcttaatttatgtgttaaaatttaaaaaaaaaaattcagattggctagcaaagcaaaatcccacactatgccatattactactgtcgtactactatgcagtaatctcctgaatggcttgtaaaataaaaaaagcaaagtagaaaaaagtaaatatagcagattacaatttacctaagaaacagaagaatataaatatgtatacttatgtttttatgttaagaaaaacaatggaaggatgaagcaaaacaaaaattacttttaaatagttactcattaaggtggggagagaacaggatggaggagacaggaattaaaatctagacttttttcaatatagtacaccttgtcttttaaatttgactttggaactacgacaatattttaaataattacagaacagttatatttttaaaagtgatctctaagaaatgaaaataaaagaaaacaaatgaacccaatgtctccaactgggggcataagctcacagacagggaatgttccagaagctatcagactgtgcacccctagagatacactaaggtggaaagaactgcaaaagacaaatcttaagccatcctcgattattaaatcggtggcgaatgcactggttttgttattctgaggctgtggggtgtgtaccatgggataaagcaactgaatgattatatgatattctatttctaccatctccagtgtcattgagaaccaggattcttgctatgagagaaagaacgtatatatttaggacaaaaaagattaagtagaaaacctatagtcctgatgttgtatcagaaatatcagtttgaactcatgatgtattttcatctgaaagaaaagagaggggcatggaggggaggggagaggagagaggaagggaggggaggggagggaagggaaggggaggggaggggacgtgagtggagggtggaggggaggggaggggaggggaggaagaacattttctgagctctgtctgttgtaaagctcagaaacaataaccaacccagtacaatgagcactctagcacccagaatgaggtctcgaaatgccattttccttgaaaggaaccagagctctttgtagaagtgctgattccaggtctggggaagtgaatgtacaagatgagcctggaacatcttgtcatctcagagggccagtcaaaagaattcatcggccaacctcaagaggttctgatttgcaacactgggagaactggagcattagtaagggtcaaaactgtgactgactaaatcatattatagatttctctatgtcattatgtccataagtccatgatgatactaaaacaaactaactggccactactgtccatttttaggcaagaatcaaacataaattctgcttttcctataccaattgccaaccacatagcagacaagtaaaagtttctctttatagatatattccaactaataaaagaaaaaggcatgctagaattacagtatcaccatattgcagtctctaatgaaataatggatctaggttaagcattaacacagccaataaatcacacacaaaaagagagatactagatactagatgtgcttcctgatggaagaacacatcaccacctgtgaagcagtcttgcagcctcaaaacatcagttcttattctgatcaagcttctagctttaacaacaagcttatatgaaaaaggaggacaaaagaatatataaaacaacatgagaggtggggagtggatacaatcagtaaagttcagactgtaagaaatgctacaggacgaataaccttgcttcttcaacaaacgagggggtgagggcagaagagagacacactgatagattaagagacaccacagacatttcaacaaccaccatgtgtggcccttatatgaatcttgacttcagtggaaaaagataaactcatgacatttgtgagataacttgaaattttaacagtctatcaatagtttatcattttaagatattaatgatttattttttaggagcaatactaatattgtacctatgtttaaaaaaataatctgtgggccaggcatggtggctcatgcctgtaatctcagcactttgggaggccaaggtggactgtttgagcttaggagtaacatatcgaaaccccgtctctaccaaaaattagccaggtacagggacatgcacctgtagtcccaactactagggaggctgaggcaggagaacagcttgagcctgggaggtggaggttgcagcgagtggagatcgcaccactgcactccagactgggtgatgggagtgaaaccctgtctcaaaaaaaaaaaaatctgtttttaagagacacactggaatatttcccagtgaatacaatatggatctaaaatatgcttcaaaataaaaagtgagagagcaggtgttcgtagagatgaaacaggactggccacgattaagtggctgaaggggttgggggtgagtacagacttgtcactatattcttctttatagtgtgtgtgtcttggacatttttttccacaataaaaagttcaaccaaacaaacaacatgagtgcaacaggttctccctcagagcatggaggagactggccactgccacaatcatggtgttggcctctctggttacacaatgctttatcctttaattctctagtctagtttctccaaatagcttcagtaaggtaaaagatttttatcagaacatcattttcactttcactgcttttcagctctatcaagggcttctgtaatgtacactttggcaaacctaaacattcccttttctttttcataagaaaaacaaagcaaaatagagtacttgacagacaacagagaatttccccttcttttccctttagaataatgaagatgaggctccaaactcaacctcttgcagccgttctctgaaagtaaaccagggttgccaaaaagttctatggcctgcaggtccctgcgtcaccccatcctccagcccggcaaatctctgacatgtggtaaagcctgtgcaaagtcacatgtcaggaaataaacacacagagccactccactgaacatcagttcacagccacaggaacgcttttgctttccatttggaatatttgttaaatatatgtaacgggccgggcacggtggctcacgcctgtaatcccagcactttgggaggctgcggcgggcggatcacctgaggttgggagtttgagaccagcctgaccaacatgaagaaatcccatctctactaaaaatacagaattagcagggtgtagtggtacatgcctgtaatcccagctacacgggagggaggctgaggcaggagaattgcttgaacccgagaagtggtggttgtggtaaaccaagattgcgccattgcactccagcctgggcaacaagagccaaactccatctcaaaaaaaaaaaaatacacgtaaccaccacctattgacgtttcagtcaacagtggacccccttatacatggtggtcccataagattatgatactgtatcttttctatgtttagatatacaaataccattgtattacaactgcctactgtattcagtacagtaacatgctgtacaggtgtgcagcctagaagcaacaggctactccttgtagtctaggactgcagtaggctgtaccatataggtttaagtacacaacgatgttcacacaacgaaaatgcctaacaacacatttctcagaaggtggcccctgttactaagcttatgactgtattactaaggagctaagtcaaaggtaaaaatagtccagcaggtaaaaacaagaaaagctcaaacaccaatactacagagagatctttagccacaaacatcatttgcacatcaagaaccaaacagaattggggtgcaggtgaggaggtgggctgagctaaggtagagcctcttcccactaggaatgtaaaggagtattaaaggataattagaactttttttcctaaatgcacaaatctcaggtgtcagaaataagagagaaaagagctgggcatggtggtatacacctgaaatctagctacctgggaggttgacgcaggagaatggcttgagtcctggagtttaaggtcagcatgggcagcacagtgagacttggtctcttaataagagggaagcaggaaggggagaaataagagaaaatgtaaagccagggcttaagagaaagagtgggctggggcagccctggtggaaaaaaggggaaaacaagaccaggtacaggggacaatatccagaagtcacaaagacccagacatggcctcagacctgtgtggcacaggaagctggaacaaggtccctgcatcaagatgggcacacagaaaggctgccccctccaagtgaagaaggcaagaacaacaaccagcccagagaaatggcaaccaaagctccctgtccatggcctggggtggggagagaaaggtctgtaaagagaaatctcatctcaagcctgctccacaagtgggtgctaagaaaaaggaacaaagaaaacacctggtaatactaaagataagtggacccaattcaccatttaaaagacagattctcagactaaagaaaagcaaatttacatatagatgctcttcacaaaagacacataaaaacctactcacaaagcaactcagaaagaaattcagaagtaaaaggatgaaaaagatgtatcaggcaaatacttaacaaaaaaggaaaaccttgacataaagttatcggacaaaaatgagttcaggacaaaaaaaccccaaacaacaaaccactaattagaaaaacagcattaaactatgcaaagaaaaactgacagaattataaagaaaaactaacaagtacacacacacacacacacacacacacacacacaaactatacatatacatatatatatcccccaattataaactcgtgtcaagcaaacaaaaataattagtaaatatacagaagattgggacgtttctgacaaaccctacacttaacagttagaaaatgtactttcaaacaaacgtggcacatttacaaaacctgactaggccataaagcaagactcaacagatagcacacactgtcttaaccacattctctaacacaatgcaatacaatcagaaaatacagtcaggacaggatgcaaattagagcaatctctgctttctgccccatttctccgaacacagtcagagaagtctatcctcctgctgacctaaaattaatactgtacatacgtagagatcagatacagaaaagtctaaagacttatacagaatatgaaatgattattacatttaatgtcaaagacagaacagctaaccaaaggaaaacaaaacctgcctgcctctttgagcctcccagaaatgacagaaggattagggacataaagggctcagtcattcagaggacagggaggtccttaaacaacctaagtatagtcacttgttgcctaatgaaggggtatgttctgaggaatgcattgctgtgtgaacaccatagggagcacttatactagatggtgtagcctactacacgcctgggctatacagtatagcctattgatcctaggctacaaacctgcacagcatggtactgaatacggtaggcaactgtaacacaatggttaagtatttgtttacctaaacacagaaaaggtatagtaaaaatatggtattacaatcttatggggccactgtagtatacgcagtccatagttgactgaaatgtcattatgtagcatatgactgtagttgattctaacctgtgatgtattaaaattctcacttttcttaccctaagacacttaaaatatttcatggagtgttgtttccccaagacagctacctggttatgacttctttattttgtttgttttttcttattagtaagctctcgaagaacagccaaagtgtgaaggcaaaccagtatgccatcatacccttggtccatcacggcggtttagatcatcaagattcattaccaggtacaccttcctgtccaaacatgaattatgaaaaagatctttactcctaggggcagctgttcactgctgctgctaaactgcagcattaagagtgttcgatttatcaagataagaagacaaagatcaagcttgaacataatcacttttcaaactgcttgcaagcattcgaagtggggaaagacaaggaggggaaaagctcctttaactaaaattagaaacctactgataatttaaaggaaactctttacatttacttaaaatatgttactgaagatattttatctccactagaatataatttcccaaacattattcaattaaaatatctcagaaacaatatgaaaactgagtaatcaactgcctgtaaaaatttctccaagtagttaacatcagcaaaatacagccatcagtgccactcggatcctgcttcatggtttctatgtgtctttccttgttcagatccactaaatctttctattaccaggcaacacagaatatcatacatataaaatgaaactcttatttcctttgtatatcaagatgaatctctcttttaaatattatagtccaacccagcatatctaatagggaggaatggggatataatttcatgagaaaagagaaggatttaaacaatgacagattttaaaacagtctataacagaaacaactactactactacgaaatatgaggagtgttaaatttccttgtttcagtttgtctgaagttatccagaatacttacagataatcttgcaatggaatttcagtatgaagatctctaagaaaaagatccggattaagttcttaagctagtaaatgcgcctctctacagatgaggaagtaaatgcatcaaaggataaaggctgttccccaagaaatgaaacagatgactccctcccacctgaaagataaggatgtctctggaaaactcaggatgcctagtttgaagttgtccaagactcatcagtttccagcacttaatactgatgtggtattttgtaaccctcaatgcagcggtcacagaagggacaacccttctatgatggcaaggcagggaacccaattattcccagaccaaggtggggtgcacaaacattccattcaaatgaaggtcagcacagcaagcaaacagggaccatgaatcaagcttccaggagatgagggaaggcaatggcatggaggctgtgtgctctgctgggacacaggacccttccctcagcctgtccctcctgttcatggcaccctctcttcattatcacctacctgcaaaggggccctgcaagcctatgacagagccgctcagtgaatccagagattcagttcactcaacagacctaaaaagcaacactctccttaattgtaggctccaccaggaaaagactatactgttatttgcacagaggtgaaaagaaagattgcctaataggaaggacactgagtgttctcaccatgatttcaaccaaattttctttttcttttctttgagatggagcccaaactgtagtgtacagtggtgcgatcctggctcactgcaacctccacctcccgggttcaagcaatcctccaacctcagcctcccgagtagctaggattacaggtgtgcaccaccaggcccggctaattttttttgtattttagaggcggggtttcaccatgttggccaggctggtctcaaactcctgaccttaagtgattcgcccacctcagcctcccaaagtgctgggattacaggcatgagccaccacctataaccaaattttctacatgttacttttcccaagaacttgccaaaagaattaaataaatcatccactgtttttttttttttttgagacggagtcttgctctgtcacccaggctgtagggcagtggtgcgatctcggctcactgcaagctccgcctcccgggttcacgccattctcctgcctcagcttcccaagtagctgggactacaggtgcctgccaccacgcctggctaatttttttgtatttttagtacagatggggtttcaccatgttagccaggatggtctcaacctcctgacctcgtgatccacccacctcagcctcccaaagtgctgggattacaggcatgagccaccgtgcccggcctcatccactgtttttactcagctcccatctcaggccgcttccttctaaaggggccaagatgcaagttaataagcagctgaaatgaacaggctggcaaagtaaaccatacatccctggttttcccaaacctcatcacacaaaggaaaagtcaagggtgtaatccacaataaggagattcatctgcagaaaataaactatcaagaaaagaaaaaagcaacatcatcttcaattaaagtcaaattcaacagttgtagccatcctatgtctccatttgcctaactatccagtacttggagccgtccacggtcactgtgccagggttaaagttgggccaggagtggccgggcctccctgcagccagcccatttttgtggcatttctcttgtcaggcaagaaccagaatgactctcctgaagctctgaggtgagtacctctcctttaaaagcaaataaaaagtagacagcccagaaatcctcttcctaatggctttgggtcaaacaccctggtgaagaaaggaaggcagagaacaacaaacactccagtcttgcagctatattctataaagtctccattgttaaataaaatgtatagaggtcaatggtttggactgagctcctgcactaggcccaacagacctaactgaaatggagtcactcttaaagttccatgtcaccaagctgaaactaatttctctatatgaccttgtggggaatccaaatgagagtaaacagctgaatctccaaacaagccagttttacctgacgacatgataaattgagttccctctgctttaacctttacaaggaaagcaactatgaaatgaccaatctgctttttgttttctgtttctgctttcttcaacccttctctatctataaaaccaacctcctctgcccagctcattggaacgctcattctattttatggaatgagttgttgtcccattccagaactgcaaataaagccaatcaagatttttaaacaaaatctgtcataatttttttctttttgacgtcatgaaagctgaattagcaaatgctgagtcattgtttctagggaaatacaagattagggtcctacaaacctctgatcacatgttcatcaaccgatcaatatattatcttgttttatgtgtgtttctgtttaaagacatcttagttaatatactgttgattcattaacactgaactcatggccaagagcactttaactcatgtgtgaacaaagctcatctaacacgtgttttctctgtaaggcacctcacatccttcttgcattcaggaacactgggtatccctctaacactatgctttggggtcattttcaacagcaaaatcactaataaaaaggacaaaaattcaaaacaaaaaactggcactaaaagcctgtgaaaaggagccgtgtttacagcccaagagcagaaactggaaggcagagtgcagtctccttcagctttggctggaagcacatgttgggcaatacaaaattttcccaacctgcatatccctggggatgaccacaaaagcacgtgaaaactgaattgtgggttacaaaaaattgaatatctgaattcacaaatacagaatctgtgaataatgaggactgactgtatttttaaaaccatgcccaaaccagctgctcaaactgagtgtcagaataaatccatagccctaatgagtacaacttcaccttacagcaaacttctcctgtgcctgtggaattctcacattccttatgaacctactcaaaagttaacctctgtaacagaaagctgctctagtaactactgaagtgggacccccacaagaggctccaaaggagacccctgactgcactgataagagattaattagaacggcaacccaactgtaggaagccatgggaaagaaaaggaaagacaactaaaaatcattctggcagcaggttttgtctcttgtttaaaaggtacagacaggtgaagacctgcaagtcacttagggcaacaaacatggccctacctgagggacatgctgtcattttgcaagccgatcatacaaacaccaagagcttcacactcacacagtctccatgatgcagcaatacatcttttttacaaacttgactctgtgatattttattgtctggatttctgaatagactgatgtgggggggaaagtggacatttaccgagcagctaatgccaggcactatgtcgagaactttaccttcataacctcactgaattctccccagcctggtaaaatgaattttctcttctccactttaacctctggagctaaggactcaggttacatcaaacaccaccgattttatttccttcaagcggctaaaataactcgagagattgtttggatatttcaactagttgagtattcaattaatcactttaattactaatgattactttataagtatttcttataaactggattcatgagttttcctctaggtagagatctttccctgcaagaaacgagagaaaaaacattttctctttacagaaacttctctcatctctagtcataattctttaactgtttcatggaagactggacacagatcaagcagcactcagcagacatcttcgccctgactcctataaaagtgtcacttcaccgtgagtgcaaaggtggccctgagcgagtgcctaaccaaggcccctctgccaggcttctccagctccggactctaaaggcttccccacaactacaggagaggtacgctgtcgaatccgaatgctaagtctgtccacattacttagcatgaataagcatttcaatgttttacttggcgttggaaaggtagattggttgccagcacgacagcaccaccttctggttggtgaaaaggaattaagatacaaagtcacatctggagcatttcaagttttgtaagccagatggatggcaaagttgaaaatctagtttccataaaatccgaacaatgtcagtagcaattaaacaccctcacagatcagtaatggaatagtaactgtaggtcactactggctactgctccacttctgggcacactgcagccacttccagcctctcagccctgacattgaagcccactgcgccctatgaaagaaattccttatcatgtcatcagagtcacatccatccccctggctgtgcaaaaaggttctctgctgttcacaaagtccaaatttgatggccagcaataaagtatcagacactggcccaacaaccactcccactggtactcgttggcaggtagggagtatcgtcctctgatggttctaacgaggactatcatcctcttatggagcccatgaggactcggcatccccttcctgttcccctcaagcatgggactccttggtagactgtgctggagaaggatcttgagtgtgaggtccaaatggggcttcctcctataggtgataccatccctacagaaatccagaaatccagaccacgagaccccatcatgacagctgcaagaggcctctgaactctaaacgattccttaatctcagcttccaagagaccccagcagctggtttccaggcctgccttcttcaatgcagtggccccatccacttgtcaaatggcccttgggtgtcagactcttcctgattctgctcatcaggtaagctattcatcctgctccctcaaggagagccaagcaaggtggacagagagaggactgtgctttaatcacgacatccttctcttggtgagcagcacagaagtctcctccagacctgtggagaccacagggtgaaggaatgagcatttcttcctgaagctgtccacaggaatcccaagccccaggctactctagagagaggcagcacctgaggagggagagctctgccagttacctctgcttccccccagcccaccaacacccgccacagtgctttgcacacctggaaaagagtaattcttctttaaatgaggactttaatctgtgtttctcctgaagtgcctgagttcaaactctgtttaccataaccctcaacaagaaatccatgtgcattataacccagtacacacacatacatctgtacgtacagaaccctgaaaaaaaggttacattaaaaaaaaaaaactatattatataagacacactgacattttctaacttcttccattttattaaaaatgctggtcaccattcattcaaatgacttcacaacccagtgagggagtgcaaccctcactgggtgaacactgtcgtaaacttccgccttcgttcatcactctgttgggtgccatgctcctctctcttctcggctatcccagaattggccccttcccaaggactgtaccagggcatctcctcaaagccctctccagctctgtgccagcaccattccaaatgccaaggatgtagaataatgactaagatgtagcccccatgcagagaagccaagtctactgggtgggacagactgacattgcctcttcctctgaagacaaaaacacttgttatctgtattcattcattcatgcatgcattcattcattcatccatccatccatccatccatccatccatcccccaccttgactcactcccacatcattgtggaaacaacagcttacatttgtcaaaaggcaggccaggcgtggtgtctcatgcctgtaatcccagcactttgggaggctgaagcaggcagatcacttggagtttgagaacagcctgtccaacagagtgaaaccccatctatatcaaaaaatacaaaaattagccaggcgttgtggttagtgcctgtagtcctagctactcagcaggctgaggcaggagaattgctagaacccagaacgcagaggttgcagggaggcagaggttgcagtgaggtgagatcacaccaccgcactccagcctgagtgacagcacaagactccatctcaaaaaaaaaaaacagatgaatccatctaatagggtttcctttttcacaatctgtttgtcaagggataattttcatgaactctaaattaggaactaaagtgcactgtcactgattcttggaagccaatggcccatttattaccctatgtagcatttatagatgtggcaggttcccagataaattcaatttggcctcagcctcttagaaaaggctgtgaactagagtacatgcaaagactaaccttctaccatgcttaaaaatacatagaaactgtttgggtacgtccgtcaatttcatctacttttgactttgtgctaccatgccatcctacacacatgggaaagagtgccatgagggtgcccccccagacaacaaccatgctttccaagggcagctctatttggttgaccaacttcgtactcaatacttggaaattctttcaaaagccccagacttctcaatgaaaactggttagatgtaatattttattttaaaacttgtattcaacctggccaagatagcaagatcccatttctttaaaaaaaaaaaaaaaaaggcaggcatggttgcatgcacctatagtcccagctacttggaaggctaaggcaggaggatcgcttcagcccaggagttcgaggctgcagtgagctatgatcgcactgctgtactccagcttgaccctgtcagagtgagatcctgtcttaaaaaattaaattaaattaaaatataaaacttgctttaaccaagaataaataaatccccccaaccaacatgacagcaaagtttatacaaggcacaagattcaaactctgattttttttttttttttttttaattgttcattcttgggtgtttctcgcagagggggatttggcagggtcataggacaatagtgaagggaaggtcagcagataaacaagtgaacgaagttctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcacagggttgggggcaaggtcacagataaacaggataagaatttttcttagtacagagcaaaacgaaaagtctcccatgtctacctctctccacacagacacggcaaccatccgatttctcaatcctttccccacctttcccccctttctactccacaaaaccgccattgtcatcatggcccgttctcaatgagctgctgggcacacctcccagacgggggggcgaccgggcagaggcgcccctcacctcccgggaggggcggctggccgggtggggggctgacccccccacctccctcctggacggggcggctggccgggcggggggctgacccccccacctccctcccggacggggtggctggccgggcggggggctgacccccccacctccctcccggacagggcagctggccgggagaggggctcctcactttccagactgggcagccaggcagaggggctcctcacgtcccagacgatgggcggccaggcagagacgttcctcacttcccagaaggggtggcggctgggcagaggctgcaatctcagcactttgggaggccaaggcaggcggctgggaggtggaggttgtagcgagccgagatcacgccactgcactccagcctgggcaccattgagcactgagtgaaccagactccgtctgcaaccccggcacctcaggaggccgaggctggcggatcactcgcggttaggagctggagaccagcccggccaacacagcgaaaccccgtctccaccaaaaaaatatgaaaaccagtcaggcgtggcggcgcgcgcctgcaatcgcaagtactcggcaggccgaggcaggagaatcaggcagggaggttgcagtgagccgagatggcagcagtacagtccagcttcggcttggcatcagagggagaccgtggaaagagagggagaccgtggggagacggagagggagagggagagggagagggagagggagagggagagggagagggagagggagagggagagggagaggttccaaactctgatttttaacaaatcaagtaaaatccatgtttccacgttctagctccccgctgccccacagctgctccactccacgtgccctctgtttcagtcatgccaaaggatgtgctggtcccacaatccaccacaggtttctcagccttcctctactaggcaactccaacttatgaccggagggtgagcacaggcatcaccatcgcctcctcggaagccttccctggtgaccctcttctgcatcttcctgccagtttgagccagttcactctccccaggatcttccctttatcacaacactcagtagccactgatgcactggttgtctacacacctgcctgcaccacaagacactgattccttgaatggaaagccaattatttcatcttccacatctaaattcagtccctcagtccttcaacagtacaaaggcaaatattggccaagcgtggtggctcacgcctgtaatcccagcactttgggaggctgaggcaggcaaactgcttgtgtccaggtgtttgagaccagcctggacaacatggtgaaaccccatctctcctaaaaatacaaaaaattaggcatggtggcatgctcctgtagtcccagctactcagaaggctgaggtgggagggtaatctgagcccgggaggtcaaggctgctgtgaaccaagatcgcgccactgcactccagcctgggcaactggagtaagaccctgtctcagaaaaaaaaaaaaaaaaaaggcaatacttaaagaataatactgcaggtttcaaatgaaagccattgtttcaaaaatcttgcaaaataccttcctaattattctgttgttactataaagaacacagggcatataaacatatggtatctagactatacaaagataaatcagtaagaaataagaggcttaccctccatcttaaaatataatcacagaagtgcatacctaaatgtgaacttcaatatgcactaaaagcgattcaaacttatttggggcattaatagacaattatttaaattagtgatattctataatgagttcatttccccccctacataatatgctacgatcatttgtttctcttccctctaaattattacataatattaaaaaaagactgatgggaaaaatctcattttcagtttattttatatgacagtgtctttctgtgttcctttacataggaggagtagcagctgctccttggcctctgatgcaatttgaaaacaagtttctgtgaagttccccacatcgctccacttcacaagcggaaaggatgaaaggcattcctactattaatagctggactgcataatgtaaagtttcatttctaaatttttttttttttttttggagacagaatttcactcttgttgcccaggctggagtgcaatggcgccatctcggctcaccacaacctccacctcccgggtccaagcgattctcctgcctcagcctcccaagtagctggaattacaggcatgtgccaccatgcccggctaattttgtatttttagtagagacagggtttctccatgttggtcaggctggtctcgaactcccgacctcaggtgatccgctcgcctcggcctcccaaagtgctgggattccaggcgtgagccatcgcaccctggctaaataactattttaagtcatgtttactttttataatcttatcacctgaaagtactcactaacctagatgttagtgagtactagatgagatgtgggtaaacccctggtctgaggtgctcaggtcaccactgccatcaattttaagttacctaacactccagtggtctagcatttgctagtgtttttgctaaacaaaatgaagtaacattcactctggtattaaagtgatgtttgggcttctttccaggatatataaattacatcttttctaagaaaagacaagttgtacaaatactcaacagtggaaatattatcaataaacatcacaaatcaaaaatgtttaatagattctttttcagaatagcagatttaaaccaaaaagttgatggaaaattcagagaaactaatgctatacatttcatgattagaaaaaacaatgccataaaataattacagtcagcaacaaaaacagggctacagttagttcccccttatctatgattttgctttccaaagtttgtttcctacagtagagtatgataagatattttgagaaaaacagagcacatacacatagcttttattaagaatattgttataaatgttctgtttcattgtcggttattattgttaatctcttcctgtgcctaatttataaatttaactttatcataggtatgtatgtataggaaaaacagagtacatacaggctttcataccatctccagcttcaggcatctacttggagtctcggaatgtatcctccatggataaggagggactactgtactctgctagccatattaagagttttaaaagcaagatgtttccctttgctgtgttcctttacttatttaaaaaataaaaaagcatataatgcttttttagtcttaaatttaaaaattgtattacacattattcactatggaaaaatcagaaaatagaagaaaacataagaacataaaatccatctatagttccatcaccctgaaagatttattggtaacatttttagttacaaaataatattatattctggattagccatttatataacaaagtcctccaaatacatttcacttatattttaaatttgctaaaatcagatttcattttttaaaactgtgaggttgtagggaacaggaatcatgtacgagaaaacaatgtcaacatgtaaagactagcacagctaatattaatcaactatttcattatatctactgacaaaaacaacgacaaaacattaaaagcctcagaaataaggatccttatatttagtttctcagtggccgaagagcaaactggcagattaatttcactgctttgcgtttcctattatcaccagagtcctaaagtatttccagagagtgaattatgactatggcactaaataaggcacagtggtacctgctttctaaagtgtgctgtgcgatcttgatcctgcagatgtatcgtacacttaaatactatatacacaattgaaaggtaaatctcaaatattaatctgcaattatctttgttaataaagagaggggtattaaacaactttttccttttctatgtagttttaaatttttctaataaaaataagtggtatgtgaaacgcttgtgacatgattaattaaaaaagcagatccaaaaatgcatttcaagtctcagcccaattagtattaaaaatgttaaacataagactcaaaactataaaactactagaagaaaacattagacaaatgctaaaagacattggtccagacaaagattttacagctaagacttcgaagcacaggcaacaataaaataacagaaaaatgagactatattaaactgaaatgcttctgcacagcaaaagaaacaatcaacagaatgaaaaacaacccgatgaatgggagaaaatatttgcaaactatccaaaaagggactaatattcagaatatacaagaactcagacaattcaatggcaaagaacccacatgatccaattaaaaagtaggcaaagaaacagaaaaggcatttctcaaaagaagacatacaaatggcaacaaacataagaaaatgttcaacatcactaaatcaacagggaaatgtgaatcaaaacaacagtaagataccatctcaacccagtcagaatgactactataaaaaagacaaaaaaataacacagactggcgatgatgtagagaaatgggaactcttacacactgttggtgggatggaaaattaggatggctactatgaaagacagcgtggaagttcctcaaaaaattagaaacagaactaccatacaattcagcaatcccactagtggaaatttatctgaaggaaacaaagtcaaaggcatacgctgcacccccatgtttactgcagcactattcacaatagctaagataaggaatcaacctaaatgttcatcaaaagatgagtggataaagaaaatgtggtatatatcacaatgtaataccatttagccaaaaaaaagaatgaaattctgtcatttatggcaacacagatgagcctagaagacattagcttaagcaaaatacggcaggcatagaaaggcaaatgcatgttctgattcgtatgtgggagccgaaaagctttgagctcaagtagagagtataattgggagtattaaaggcgcggaagggtagagggaagaggaggatagagagacgctggttaatgcctacaaaattacagtgagataagaggaatgtgttctgatgttctggcagcactggaaggtgaatgtggtaaatgtggttaaataataatttattatatattttcaaaaagctagaagagagaagtttgaatgttcacaacacaaaactataatacatctttgacatgatggatatgctaatgatttgatcattacatactgtatacatatattgaaatgtgactctgaatcccataaatatgtacgtacaatgatcatgtgtcaactaaaattaaaggggaaataatatgaaaatacttatctaggcagagtaaagaaacaggaaataccaaaattttacttcattactaggttgtaagatcatggctgaattgttttccttgtattttcaaatatttttcactttttttttttttttttttgagacagtttcattctgtcgtccaggctggagtgcaggggcatgatcttggctcactacaacctttgccccacgggttcaagcaactctcctgcctcagcctcccaagtaactgggactacaggtgcaacgccaccatgcccagctaatttttgtactgttagtagagacagggttttgccatgttgaccaggctggtctcaaactcctggcatcaagtgataacgcctgcctcagcctcccaaagtgctgggattacaggtgtcagccaccacgcctggcctttttttcacattttcaatgagattgatgtacttcaaatttttgaagggggtgagagagcacaatgaaagcaatttttcacaaatgacattgcaattaaattagagagatttattcaatactctgaaaccgcatcataaagcaaacattcttaggtccagctaacataggccctaaaaccgaagtcgccaatctgtactgatctatgttccctggcatgttaggaaccaggctgcacagcaggagatgagcagcaggtgagctagcaaagcttcatctgtttttacagccactccccatcgctcgcattaccacctaagctccacgtcctgtcagatcagtggcagcattagattcccgtaagaacatgagccctattgtaaattgcacatatgaggaatctaggttgtgcactcccagaatctaatgtctgatgatctgtcactgtctcccatcacccccagatgggactgtctagttgcaggaaaacaaggtcagggctcccaatgattctacattatggtgagttgtataattatttcattattacaatgtaataataaccgaaataaaacacacaataaatgtaatgtgcttgaatcatcccaaaaccattccctacccctgctcccacctagctctgtggaaaaactgtctttcacaaaaccagtccctggtgccaaagactgctgccctaaaacataaaaatcaagtgccagtaatatggataagaaacaatgtaacagaatatgaaacttcggtctccagagcacaagtgctccccttctcctggctgcattctaactgccacaggacacaacagccgctttaatgctgtatcaaggacttgggaatccttctctggcactcagaaagctttttgctctattctcataccagttaatgccctaaagaatgctaattagggagagtccaagttattgtcacgctcttaaatctgtctgatgaacatttcgtagcagagatacataagacggctaattctccaaattgaacacattagggatatcagaaaacaataagattctcagtcagtattattaaacatttccatggtgcttttgatgacttaagtgatttagagaaaaacaagtcagttgcttttacaagttttctaatcagaaggtatccatccatacaaaacatacattcacatgtcttactaataatgattctcctatagcagactgaggtattttataagccactgttgtaaaaatcttgcctgttaaaaagaaatactgtcagccctccatatctgtgggtttcccatctgtggatttaaccgactcagatggaaaatatttgggggaaaaaattgcgtctgtactgaacacacagacttttttcttgtcatttttcctaaacaatatacaatataacaactacttacatagcatttgcattgttaggcatgtaagtaatctagtgatgtttttaagtatacaggaggatatgtacaggttatatgcaaaaattatagcattttatatcaaggccttgaacatgcctggattttgaagtctgcatggagtcctggaaccaatcccccatggataccaagggacaactgaacatgctttccaggatcctgtacttacagcataaaaatcatatatcctcctccaaaataagcttaacagaaatcttatttttaaaagtcatgccatagtttgactcatttatctattgccacatttagaattcaagatcactactgtaaacgaattctacatacagtttaagattaggaaaattaacattcatgtgaaaaatattcattttttggtttttattgaatattttgtgcatttcctctgtgacaagaataaataaacagtaacacactggccaactacaaaaggcaccaaaggtagaagcaaagacactactatgtctggacagcgtatcaaatatatatcaatatattgtatttcagatataatacatatatatatctgaaaggaaatgaacttgagtcacttttaatcagttaaaggcatgctttttgatgcatttacattagattttctgaaaatgttattaaagtagtttaagcatggtatgtgatatggaaggaaggtctggatcacaaaataggtgccagccaggcacggtggctcacagctgtaataccaagattttaggaggctgaggcaggcagattgctggaggctgaggcaggcaggtggcttgagcccaggaattgaagaccagcctgggcaacatggcaaatccttatctctaaatgaaataaaaaattagctgggcatggtggtgtacatctgtagtcccagctactcaggaggctgaggcaggaggactgcttgagcccaggaggtagaggctgcagtgagctgtgaacgcgccactgcactccagcccgggccacaggacaagactccgtcttgaaaaaacaaacaaaaaaatagatgccataagggttacaactaaaaagcacagatttcggccaaacacagtggctcatgcctgtaatcctagcactttgggaggctgcggcaagtggatcgcttgatctcaggggtttgagaccagcctggacatcatggcgaaacatctttttttttttttttttttaaagcacaggttttgaatgctacatgcagggtatgtcatgaaactaaataactttttaaaaaatcaaaggtaaggaagtccttatggaagaagcttaggggcaaacaggggcaatagagagtgaggaaggaattctggaaaacaggaagttagagaagaagaagaaactcatattggtatatagacccagcccaagtctctggttgaccctaaaccatgcatgtggcaaactgggagcaatctaagctaagttctgagccacaacccaccacagccatgaaaaagtttgtagtttgagtctaacaaagttaattatctgctgaaattatttttcatttttatttatttattttttgagatggagtctcgctctgtcacccaggctggagtgcagtggtgtgatctcggctcactgcaacctctgcctcctgggttcaagtgattctcctgccttagccacctgagtagctgggattacaggtacatgctaccatgtccagataatttttctattttttagtagagacgggattctaccatgctggccaggctggtctcaaactcctgacctcaagtgatccacccacctcagcctcccaaagtgctggaattacaggcgtgagccactgcaccaggccaattacctgctgaaattaaaatacaaatatcaacattcttctaaggaatgtaactaaatccagagtctccacaagagaacattcacaatgtccaggaaaccaatgaaattactcaatcccaaattactcaatatacaaagaaccaggaaaacatgacccattctcaagggaaaccatcccaacaacaggtatcaacaaccctcagatgatgcagatgttggaattattagagaatgatttttttttgagacagggtcttgcactgtcacccaggctggagtgcagtggcgtgatattggttcaatgcaaccttgacctcctgagctcaggggatcctctcacctcagcctcctaagtagctgggactacaggtacatgccaccatgcctgactaattttgtttatttttagtagagacagggtctcactatgttgcccaggctggtctcaaactcctacgctccagtaatcttccctcctttgcctctacaagtactatgattacagtcatgagccaacacacctgggcttttttttttttcttctttttttaacttttttaagagacagggtctcgctgtatctctcaggctggagtggagtggtacagttacagctcattacagcctcaaactgggctcaagcaatccttccaccatagcctccctagtagctgggaataaaaatgtgcaccaccacagccagtagacaaggactttaaacaacctattataactatgttcaatgaggtaaagaaataaagactaagtggccaggaactcaaaaaaattaaaaaaaaaaagaaaagaaaacagaaacataggctccaaatgaaataaaagaaactctctacagagaaacagaaaaaataaactgaatgaaaatacataactaaagtatacaatatatgcaataaaaattcactggatgggcttaatagcagaaaaatgatgtcagaggaaagagtcagtgatcctgtggatagacagaaaatatataacctgaagaagacaaagaaacgaacacagaaaaaaggaacagagcattaggaaataccaaaacatcaaaagatctcctacatgtgggtacctggagtctcagaggagaagaaagagaatatggaacacaaagattatttgaataatgtctaaaaacttcccaaatcctgtgaaaactatgaatttatagactcaataagttcagccaaccccaacaggacaattgcaaagaaagctacgcctacgtgcattatattcaaactgctaaaaccaatcgtaaatagaaaatgttgaaaataaccagagaaaattaacacattatatacaggaaaatgacaattcaaatgacacaaacatctcatcttaaaccatggaggccagaagacagtggaactacagctttaaaacactgaaagaaaaacccagaattctatatccagtgaaaatatcctgtgtgaataaaggcaaaataaagacattttcagataaagaaaaaattagagaatcagctgccaaccaaaccatcaatacaagaaatactaaagtaaattcacaaagctgaaggaaaaggataccaaaaaagaaacctggatcttcaggcatgaatgaggaacactgaaaatggtaaatatctgactaaatattttcttctccttatttcttaaaatacatagagagtttaaagtaaaattgtaacaccactttctgggatttataatgaatgcagatgtaatacatatgcccaattaaagcctaaaagactacaaggaatggttgtaaatgaacctatatgattgtaaggtctctacattctatgtgaaatggtataatatgaactctgagaagactgttaaaagttatggatagatatttaaatttgtaaagcaaccactaaaaataatgcaaaaagataaaacaaaaaagccagcagagaaattaaaacagaattctttttaaaaattcaaataatccaaaagaaggcagaaaagggggtatacaaaagaacaaaacacagagaaagcaaacaaaaagcaaattttaaaatgacagacctaaccatatcaataaggacattaaattggactaaatactccaattaaatttcagagtcaacagaagaaataaaaaagcaaaacccggctgggcacggtggctcacgcctgtaatcccagcactttgggaggccaacgcgggaagatcacctgaggtcgggagttcaagaccagcctgaccaagatggagaaaccgtctctactaaaaatacaaaattagccaggcatgggggtgcatgcctgtaatcccagctacttgggaggcagaggcaggagaatcgcttgaacccgggaggtggaggttgcggtgagccaagatcatgccattgcactctagcctgggtgacagagcaagactccatctcaaaaaaaagaaaaccaaaaccaagctatacactgtctacaagagactcactttgtgtatacacagataggtctagaataaatagaaggaaaagaccagtttggctgggtgtggcggctcacatctgtaatctcagcactttcggaggtcaatgcaggtgggtcacttgaggcaaggagatcgagatcagcctgggcaacatggcaaaaccctgtctctactaaaaatacaaaaattagttgggcatggtggcacacacctgtaatctcagctactcaggaggctgaggcaggagaatcacttaaagccaggaggtggaggttgcagtaagctgagaccgcaccactgcactcctgcctgggcaacagaatgagactctgtatcaaaaagaaaaataataataaaagaatataccaggcaaatataaaaaacataaggaggatgaagtgattataatatcagataaggtagacttaaaaataatagtattacaaaagataaaggagaacattttataaagaggccagtttatcagaaagacaaaacaatcataaatacgtatgcccctaataatacagccacaaaatacatgacatgaaaattgacaagattaaaagggtaaacagacaattctacaatcacaggcgattttaacccttctcaaaaactgatataacaactaaatctaaaaaagtcagtgaagatatagaataagactgggcacagtggctcatgcctgtaatcccggcactttgggaggctgaggtgggaggattgcttgagctcaacagttcaaggtcagcctgcgtaacatggtgaaactccatctctaccaaaaaatacaaaaattagccaggcatcctagcgtgtgtctgcagtcccagctactcaggaagctgaagtgggaggatggcttgagcccaggaggtggaggttacagtgagccgagatcatactctggcctgggtgacagagccagactctgtctcaaagaaaaacatcaaaaaaaggatgcaggatatatgaataagactaaccaatattgatgttctttttaagtgcacacagtatgttcaaaaacatagaccttatgcttgactataaaggaaattctggtaaatttaagaggactgaaatcctattgaaatctttagtcacaacagaatgaaattataaattagtaacaagaaatctaacgaaatcctaagcatttggaaatgaaacaacacatttctaaataatccaggatcaaagaagaaatcacaaaacttttccaacttaatgatatttaaaacatacgtataaataaacagttaacatacaactaacgcagtacttagaggataatttatagctttaaatgcttctgttagaaaaggaaaatggttcaagtcaatgacttgcagagtcttagctatgtacacatagctagctgaccataaggcctgtgcgcccacagaggacagaggtccagacaaaagtaaacattggggcagacttgtaagctgccggaatgttgagtctgttccctaacttagctggcaaagggttaaagctttaccagctcaaggtgtttcagcaccacctcttaccaatcactggctaatcagtaagatattaatatgttgacctaccaacaacctcgaggacgccaggcttaaattttttaaaaagaatttagaaaaaagaagaaaagaagaaccaatcacatacggttctagctcaagaaactgagaaaagaagagcaaagtaaacccaagcaagtaaaaggagaaaaaaaacagaaaccaacaaaatagacaatatcaaacaatacagagaaacgaacacagccaaaagcgttcttgagagagatcaacaaaatggtaacagctgactggaatgaacaaggaaaaatgagacacaaatgagtaatatcacgaataaaaaccagttatcactacagattctgcaaacatcaaaaggataataaaaagcacaggtaaagttcaaagttataagcagccttttagcaaattcagggctgaacaatcatcctgaaagagttgtctctacaattctaatatttatctgttcagcataatcaaaagctgtgctttttaaaaacacaatttaacataagcacactcaataatttagactgaggcaaagccaagtgtcttccctcatcccaaaaatcatcctgaaaaagcttctaaggcagggtatcaggaattcatacaactatctgaatttgggcttttattttatttataattactgggtaactttttatgacccaaaataactgttgagttcctgcctcttctaaagtgtctttatcaatttctgcttttaaaaagtttcttacagtatctactgtgtgtgttccaatctccagctttcaaaatatgtgaaaaagctctttttctaaagccatttctataaaaattatattcagagacacaatgtcctacgatgcatttaaagacactcaaaacaatgtctaaatattgagagtatggctagaaagttctactacatttgaaatattgttgagctcttccccatttaataaaactacattagaaatataaaaatccaaaatataaacaagctattcagatttgcccattaaagatgaattcctggccagggacagtggcttacgctgtaatgccagcactttgggaggtgagcagatcacgaggtcaggagttcgagaccagcctgaccaacatggtgaaccctcgtctctactaaaaatacaaaaattagccaggtgtggtggcgtgcacctgtaatcccagctactcaggaggctgaggcaggagaattgcttgaacctaggaggcagaagttgcagtgagccaagatcgcacaacggcacttcagcctgggcaacagagagagaccctgtctcaaaaaaaaaaaaaagaaaaaaaaagatttcctgcttgactactttgagaaaaattctcaaatggtgaaggtaagtggtctttccatggcaccaagtcccacactggccatgtactgcttcatctgaagagccagagggggaataatgctaaatgcacagcttgtatgggttaccacgtatccaaacaccccaaagccagcagggaaccgcttcccagcagcagcaaatgaaaagcaacagaaaccgaatggcactcagtagacgggttttagtagttagtataaaaagggttcctataaaagagaactttcatattcaaaatgtcgaaaatagccaggcacagtggctcacacttgtaatcccagcactttgggaacccaaggagagaggacggcttgaggccaagagttcaagaccagccgagcaacatggcaaggccccatctctacaagaaaattttgaaaaaattagcagggtgtggtgagtgcacacctatagtcctggctactcaagaggctgaggcaagaggactgcttgagcccaggagttcgaggctgcagtgagttataatcatgccaccacactccagcttgggcaacagagtgaaacccagtctcccaaaaaaagtcaaaaatggctttaaaaatcttgattaaaattagtaatactcaaagaaaaaaaaaagtgtcagttaaaaagcaactccttaaatgtaaatcagaaatagtttgtaacagagccaaagaagccattataagctgctatataaataggcatttaatgattttctcaatgttacattattgacctaagaggcgctctgtttccactgaaatgaataagtaatttgtttaagataacattaataggggccgggcgcggtggctcatgcttgtaatcccagcactttggaaggccgaagagtgcagatcacaaggtcaggcattcgagaccatcctgtctaacacggtgaaaccctgtccctactaaaaatacaaaacaaaaattagccgggagtggaggcacgcacctgtagtcccagctactcgggaggctgaggcaggagactcgcttgaacctgggaggtggaggttgcagtgagccgagatcgcaccactgcactccagcctgggtgacagagcaagactccgtctcaaaaaaaaaaaaaaattaataggatttgcagcacatcagataccctgggtccttcttatcattagaatcaccattataaagaacaaatttcacaccgtctttcagtgaaacatctgcataattttagaaatcacagctaaagagcagagacattagttacatccatcacatgcaaaaaggcatttccaagtcacaatactatgaatatcatttatgcaattcaataaatattcaacatttacttactaatgtcagacactaccactttacgcactaaaaacgcaatggtgactgagacatggtccctactctcaaagagtttacagtctatctgtgaaaacaatataataaggtatacaagatgctatgaaagcacagagaatgaggttcaataccctacaaagagagccagagaaaacatcagaggccgggtgcagtggctcatgcctataatcccagaactttgggaggctgagataggcggatcacttgaggccaggggttcgaaatcggcctggccaacatagcaaaaccctgtctctacaaaaaatacaaaaattagccagtgtggtggtgcatgcttgtaatctcagctatttgggaggctgagtcacaagaattgcctgaacccaggaggtggaggctgcagtgagtcgagtttgtgccaccccactctcgcctgggcaaaagaaatgaccctgtctcagaaaaggaagaggggagggaagaagaggggaagggagaggggggaaggtggggaggggaggggaaggaaacattggagaaactgatgttgaagctgagataaggcaggaaggagggcatagtcaggttctggtgggaggtgatgactgcataaaagatggcttcttctggcaaaggaaatgttgtcagaggcacagcatgctcaaattgccaagtattttgttaagagttgtcttttgcataagaaaagagactataccggaaaattaaactttactagcaaagctgcatatatcaagagaacagtgatctacttaacctaggaggaaaaaaggtaaaatatcacaatttcatcttggcctattccccatattccctattcaaacacacatttatttcctcatgctgcagtgtgtgtcaggtatgagagaggactcagggccaaacaagagggacccaacactgccctcaggaaaccaatgcaatgagcaatcagacaatagagtgcttctatggctacacatgattctgaaatgtagctccctgattagagttaccacggaataaaatacttagcttaaaagctactgttttaagaattgtccagtagtaaagaagagagcaactgttatttgacatcagatatggtggtataacaggaattttaaaagaaactttgacatcccatacacacaagcaaggaatcatgcttgtattttcaaataaatgctactaactcatgttttacagatttcaaagcactcttacacactgttcacagcaagggaggccaagcagctattttaataattacctaccacgggtcaagcactgattgtgtagtatggggctctttgctggcaacttaatatccatgatctcatttcatcctcacaacaatcatgccaagtaactattatctccctcttaaacaaacacggaacctgtggctcggaaggtttacataacctgcccaaagacacatggctgacaagtggtggagccaaagttagtccccgtgtcagtctgtgaaaactccttttatcgggctgcacagcttcaatgtcaccgagtgtggctagcaaaggagctgaagagtgtacagtgagcagaggaagctgaattagactgcaggtcaggactttgaactcagtcttcttgcagccacactgaagcctcactgtaactgtaacctcaaggtccccacccccacctaaagttatcttgagctttctaataattcaatccctctggattctctctaaaccatctttctaaggatagtggggaaatggatcacagaaaaaatctctatgcaaaaattaaaatatttaacaagcaacatcaatcacaccctgcatccaccactatccctggtgtctgatgctcctgagtacattccaccctgaaatctgctattaaagaaccacagtaaaagctcaaagccatgccaaggttcatttacttaatctcatggaatccttacaataacactaaagtccatactattatgcgcagtttacagagataagcagaagttcatcaaggttaaataaggcacccaaagtcacacaactgttaagtgatgctgcagtatgattccaaaagcctaagcttttcccctctacagcatggcctggattcctgcaacagtcagataatgaaagaaaaatgccaaaatactgtgatctgaatttgtatatttgcagaaattttcatatataattactcaccagttctactatcagaattatagttttactgtgcggcattttgttaaagtaaaaaacaaacacatcacttaaaaatttcacatcttttacattatcaaagcaacatggtgcttgaaatttacttgaatatacagcttaacaatacatattttcaccaatattttattcaaaaacttcccatcttaagaaaacaaaacgtttaattgatggttaatatcaaaatatcaaaattatttaggatcctacaagagacggggtgctccatctttttagaatcccctcctttttttttcaagacagggtctcactctgtcgcccaggccagagtgcagtgggtgcggatgttggctcactgcaacctctgcctcccgggttcaagcaattctcctgcctcagccatcacgcccagctaaattttgcatatttagtagagatagggtttcaccttattggccaggctcgtctcgaactcctgacctcagatgatccgcctgcctcggcctccctaagtgctgggattacaagcgtgagccaccatgcccagcctagaaccatattttaaaagcaaataaaatattcagtttatttgtttgtaaaacaaggctgggcattgtggctcatgcctgtaatcccagcactctgaaaggccgaggcaggcagatcacctgaggtcaggagtttgagaccaaaccggccaacatcgtgaaaccccatctctactaaaaatacaaaaattagccgggtatcatgttgcgcgcctgtaatcccagctactcaggaggctgagacaggagaagtgcttgaacccgagaaccagaggttgcagtgagccgacattgcgccactgcactccagcctaggcgacagagcgagactatgtctcaaaacaacaacaacaatgacaacaacaaaaacaacaagtatttgatacaagtttaatggagtgaataaatctcaaatatgtatcaacaaatggggggaaagtacagagatgaacaggtcaatgtaagtattaatttattacaggtacttctcattctcaaagtaaatctgcaactcacttcagaaaaagtgcaatgagaaaggaacagaatggaggtaaatgaaaaaatatactatgtagcatacctaatgaatcaaaagagatttgtcttattttctcatctatacatgatacttactaattatttcatttatttcagagacaatctcaaaaacaaacgaggcagcaatgagtgtaagctgactgagcccatagcttttaaattaagggggcagtgggagggcaacctctcactgtatttaatacacaaaacagaaatccaaaacacttaccaatctttacttgctcgggctggctaagggaaacaaatgctgatgtgtcatcaatccaggatatctgaatgttacctgcaatcgcaaattaaaagtaaagtgaacatttgaccatgtggagagctattagatttaatgcgcgtatcttacatatttcagtatagtctatctttaaagagagagaaggtgcttatttaaaatgtgatcaaaatctcagccctacagagagttagcctgttcaaaggctaccacagcagttatttacgttaaaacttcaagagaagagacaaaccagggggaaaagacgctattagaaatttaacacaatagaaagatccttccagattaaaccctggggcttgtcatcattcagtgcaatactaggattagggacttattttcctatcaagaccactaacaaaaatcagagaccacataggttcaaaaacacaactatttcttttttttatttttgagacagagtctcactctgttgcccaagctggagtgcagtggcacaatctcagctcactgcaacctctgcctcctgggtcaagcaatcctcccacctcagtgtcccaagtagctgggactacaggcacacaccaccatgcttacacataatcttattgaaaatagtgttagaggccgggcgcggtggctcacgcctataatcccagcactttgggaggccgaggtgggaggatcacctgaggtcaggagtttgagaccagcctgaccaacatggagaaaccccaactctgctaaaaatacaaaattagctgggcatggtggcgcatgcctgtaatcccagctactcgcgaggctgaggcaggagaatggcttgaacctgggaggcggaggttgaggtgagccgagatcgcgccattgcactccagcctgggcaacaagaacgaaactctgtctcaaaaaaataataataataataatagtgttagtacttaaagtaactttatatgccttaacgttcgttctgacttattttaaatatttacatgcagaaatggtgtactgtattatcagtgcaggaggcactgctgtgaaagtctactattctaaaatatcaatttaaaaaaaaagataagaaaaaaatagatcaggctcagtggctcatgcctgtaatcccagcactttgagagtccgaggcgggaggatcacttgagcccaggagttcgaggccagcctgggctacacaggaagaccctatttctatttaaaaaaaaaaaaaaaaaaaaaagaaagaaaatgaaaaatggtgttaagttacatggaaagcctacttcgtatctgctttttactctaaacgttaaaatacaagcactttaacttcttttaataaactcctcaaatattttttaaatggctacatactagaagatacataaacatttactaaactttcttactactggacatttaggttttgtggccttcactttatccaagaatttccaaagagaatagcttaaatgcttcgtttgttaaaataagaggcattgctgtgggtttacaatcagaatggtcttcataaacacttatcaggagactgctcaaacgaacctaatcacatgacctggtaaaaaaggaaagagaaggactgccctacctcatacacgtatcacaaatcctgatctacccaaacatctgtcactttgattaatctaaagcagagaagacctcccctgccattatgaaacacacaaaccctgtgagtttaatcttaaaaattatttatgcttagccacagcttattttccctggtcagtagtaaggacagtcctcatcacggtgttttgctttccatgaattaatagctctgtattgtgaggtgctattaaaagtttctcagatgatattagcacaaagataacagtatcctaaaccagaaaattcaaagagtgaaattaaaaccttgaatattaacattcttttatacgcaggccaaaactatctttctacttctgaccacctataccaaatgaatagcaaaaccctaaaaagtacatctgaacttgcgacttaccaaaggcactgaaaagctggtaaaggtcgctggttttccattctttggggaatgtcacatggagaacatgatcacgtttaggctgcactacaagacaaatttatgatgaaatattgatgggtgaaaagtgatcaagtaaaccagtgactctttgatgaaactaagtctgagctaatttggagaactgttatgaattcctcatgattaccaaacaactcctaaaagtatgcctaggattggtgggattctgccatggtaatctagacctcaggttctgatactttacagaacccacaacaacttgaacccaatgcaaaggcatcttctcttctcatgaagttcctgtgcaaattatttgtttattttttaattttttttttttttgagacagggttttgccttgtcatccaggctagagtacagtggcacaataatagctcactgcagcctcaaactcctgggttcaagcgatcctcccacctcaacctcctgagcagctgaggctacaggtgcatgccaccgtgcctggctaatttttttattttttaattttatttttgtagagatgggggtctcgctatgctgcccacgctggtcttgaattcctggcctcaagtgatcctcccacctcggtctccaaaagtgctggaattacaagcatgaaccaccacacccaactgtgcaaattatttagaagaaaaaaaaaacgctgctctgttcatgaagtttcacttcactaaacatttaactttcccattttaatatacttagttaaaaaaaaaagcactgtccaaattaaatggactaattgttaagtaaggcaatcccgagtcataatcttgctttctaatcccaaacctagaacttatttgtgcagctctaagcaagagatctaaccactctaaccactctggactataaactgggaatggcaatatttagcatacagaattcttgtgagaatgacagaccaaaatatcagtctaatgtggagggcaacacaacagtatgtcctcaaactatcattgcaacaattattgtcaccaagtatagttcacccacttccacctgccagtgacatgcattaaggtaaaaaagagcagtgaaatagcagaaaaaaagcagaggagaagaaaaagcaaccacctcccatagaccttccacgttttttaaataaaacaaaacaaaacaaaacagaaatcaacctactaaattcaaatatacacatactcaagtaactggaaaacagaaattttaccaagataactgacagctagcatatcttaaaaatctattataaatacttatagaaaatgatgaaatcagaattctgagtgaaaatgaaatatatagagaagatacatgcttctaaaattcatttcatgcataaactggaaaacataaatgaagaaatgactaatgaatgcccaagagtcccattaacttaagcatactattcatatcaaccacaaaatcacagcccaattttgagtgaaaaaagctttttctttagtaatattttcctgttatcccttccagaccacacacttaaatgcacagatgcaataagaaaataaaaatttacttacagtctggtccttccaagtttagataggggatatccatgaccctcataagaaataacctacaagaagaaaagacaaacaagtaatgggcaatttcctttaaaagacaggcattttgcatttttaaggttgaattagaaaaaaaaaattttaataggcatttattatatcttttgtagaagatccttgatatcactctatttgtaaaattatttctattatttatttttttttagatggagtttcactctgccgcccaggctggcatgcagtggtgtgatcttggctcactgcaacctctacctccccagttaagtggttcttctgcctcagcctcctgagtagctctaatttttgtatttttagtacaaacggggtttcaccatgttggccaggctggtcttgaactcctggcctcaagtgatctacctgcctctgcctcccaaagtgctggcattacaggcgtgagccaccacatctggctttataattattattattactattattattattattatcattttgagacggagtcttattctgtcgccaggctggagtgcagcggcacaatctcggctcactgcaacctctgcctcccaggttccagcgattcacccgcctcagcctcccgagttgctgggactacaggcgtatgccaccaagcccagctaattttttgtatttttagtacagatggggtttcccgatgttgaccaggctagtctctaactcctgacctcaagtgatccacctgcctcagcctcccaaagtgttgcaattacaggcgtgagccactgcaccagccatgtaaaatcatttctaaagctctgaaattcatttcagagatttttctcctgggccaaatatttatcacaaatagaaaaaacaaacaagcaacaaactggcatcctcaacagttcctggcactcagtagctgctcaataaatattagctaaatgaacaaaattaatcatcaaagagtcaagggaaagtcctccacagagctgtcgtgttagtccaagtaaacagaaagaaaataaatattacccatcttaccaatctatgaacaagtgttcctaaaaattctaagtgtaacccttacaatgggcatttgtgagctgagaatgacaacacaggtttctttttttttaatgaaatgcaaagtcactggataaatgctaatctctctgggagtctgaaataagtgactgtctcaaaagcccacatcattattatcatttaaaacacactaaaagcaccaaacaaaacaatccttggtaaagaaaactatcacactaatataaatcatagcagtcattttatgtttatcttccaaaatgggtacaaaggcacttataaaagagtgcttgtaaattacaactctctgtcatgccattcaattttcttttatttgcaagattatggacaaaatatcatgcattctgttgtgtgtaagattattttaatgagttttacttagataacaatatattatgcatttctggtagagacaacattatacagcaaattaaaaaggcaatctatctgcccaagaagcaattagtttggcttcacggacccacagttaaggaacattattaccaggcattcaaaagccaagcagggccaggcgcggtggctcacacctgtaatcccagcactttgggaggctgagggtggatcacctgaggtcagaagttcaagaccagcctggccaacatggtgaaatcccgtctctactaaaaatacaaaaattcgctgggcatggtagcaggcacctgtaatcccagctactcgggaggctaaggcaggagaatcgcttgaaccatggaggcggaggttgcagtgaaccgagatagcaacactgcactctagcctgggcgacaagagcaaaactctgcctcaaaaaaaaaaaaaaaaaaaagccaagcagggcaaaagctagtttacaaatggaaccatcagcatgaacaatactgttctgttaatgtcagaaaaaacgaagtcatagtactctgtggtttgagaatttgttgtctggcctacaatttaataaaccaaattctatggctaagaaaccaaatttatttttagttcactaatttaggctcaagtgtactattctggttttgtaagctgttttaaccaatttaatcaatactccctgcaatgccagaagacaagaagatacataaagcacctagcatggtgggttctcagtgagggcagctatcatgttttcttaaatattattttccagcataaacgatacacactggaactatcattattttcgcctaccagaacctaataataacaaaagttattcctaggttagtgagctagttagttagataagttaactaacctaggaataactcttgttattgttagtcatgcttcatataattttcagttctccgtttagtaaatttagaaatagtctccaattctaaacaccaaattttttaaaaaattaattttaaaagttaatgaaggctgggcacactggctcacgcctgtaatcccagcactttacgagaccaaggcaggcagatcacctgaggtcaggagtttgagaccagcctggccaacacggtgaaaccctgtctctactaaaaatacaaaaaattagtgagtttgagaccagcctggccaacacggtgaaaccctgtctctactaaaaatacaaaaaattagtgggtatggtggcgagcacctgtaatcccagctacttgggaggccgagacaggagaatcacttgaacccaggaggcagaagttgcagtgagtcgagattgcgccattggactccagcctggcaacagagcgagactctgtctcaaaaaaaaaaaagttaatgaaacgtatcaagcaccataaaaataactgagaagaacaaaagttgaatcaacaaaatgttcactgctataccatcaaatatgccaataatcaaaatcaacctcaagatttgataatacatggaggtcagtaaattatagttcaaaatttcaatataatattaagcaaccaaaataactacgaaaatgtcaaaacatggataacttataattctaagttttaaaaaggcacaaaattttatactatgattttacctttataaaatatttatatcattaagccaagaataaaaaataccctcccctctcccaccaacagctttgggaaactttgagctttgtttctcaaaattccttttacgatcattttttaaactttaaaggctaccagaactgagaagcccagggaaaataactagagactttcttagaaaaagccaaccgaaaatgccatctgaattaatctttcgtatactgtgcactacctcacctggctgggagggagaaaaatataaatataaaaatataaatataaaaccacaaactcgaatttgcaattcttgtatttctgtttacaattctgttatattgctaaagtcatgggacctcaacaacaaatttaggaaactcagtgttgtaaaaataccaggaaggattatactaacaaagaaaaagaaggctctcccaatttctcttaccatttagatgttgttgttttttttttatttctttattttatttttttccatttagatgttttgaaaaaatttttttgaaaaatattttttgtcaatatataagctatgtgttctctaatatttcacctgaattttcaatattatctctgattaaagtaagcaaaaatttattctcagctaaaacactcaaaagatttgttttttttttttaatttttatgagtatacagtagatgtatatatttgtagggtacgtgagatgtttggatagaggcatgcaatgtgaaataagcacatcatggagaatgcagtgtccatcccctcaagcatttatcctttcagttacaaacaatccaacgacactctatttaaaaatgtgcaattaagttattaccaaatatagtcaccctgttgtgctatcaaataggtcttattcattctattttttgtacccataaaagctattttttaatgtagtcaatcctacactatcttgtttgtttactccacattaccttacacagaaacccctttcaaatgaattattaatagcacttctcactctttccctataccttcaccttcacatctggggtttagagggaactgaatagctccaaaacccggaagaacacgaaaaccaactctgtgtgacttggcagactgcggctctggagagcgccacgcaattgtgaaactgactctaaaactgtggctgagtgtctgcggaactgaaccaaagtaaactctcccaacggcctcccaccgtccttatgccatgctgtttggaagccactgctctggtaacatctctgcccttctgaagtaaaattaaaacatttcaatataggcatgcctcatcccagctggctgtcaaatggcctgcactgactccctggaatgatttgataaaatacttcacatatgcctcatccaacttgacagttttcatcctagcatatgaggaaatgcactaggcaagcagaaatgctgataaagacatgaaaggatgttccatcactgtgaactgtattgaagaacaatctctcccagaaggactttcatctgcagatatcaaaaagacactcagactaacacttgcacgaaacgttctttctattttagcaaagatccgagagggtgtaacacggtaaagaccctcaagactgcgtgcgggtatcttgccacatttctgaaagctttctgatgaaatattatttccccacttattctctaaaggactgacattaactttatcaaacactaaaattaaaattcccattaaatacaatggctaattttacaaaagaattctatcctaagaaacagtgtaactcaagttcacattctagatgtcatagagcaagttttaacctttgtggaatctgtcattttttaaatgttgtatgagtatatcactggcagtgcttgttatcctggctttcaaacaagtctggaaagactccagggtaaagcacagcataccaggatcttttgctcaatacactgggtcacttccactcagtctcttcacaggctacacagcatacgctacacaatacctttagctccaaagagccaccacctcatctccattacccatgtgctgggtggcactcacaaaaagccaccctccaaacttttttgtgaaacaggcggtataggccgggcgcggtggctcacgcctataatcccagcaatctgggaggccgaggcaggtagatcacctgaggtcaagagttccagaccagcctagccaatgtggtgaaacctcgtctctatttaaaaatacaaaaattagctgggtatggtggcgggtgcctgtaatcccagctacttaggaggctgaggcaggagaatcgcttgaacccaggaggcgaaggctgcagtgagccgagattgcactgctgcactccagcctaagtgataagagcaaaactccgtctcaaaaaaaaaaaaaaaaaagaaaagggcgggatgacactgtgtcccaggctgcctaagaaggctcattagttactgaagaatttcatttcagatatataactctagaatatagaaccttgaaccgttagcaaaatgtgcttccccgccaactggatcagcatcacctgggaacttgttagagatgcaaattcccaagcgccatccaagactcctgactcagaaactctggactgagaatcaccgagttaacaggaaaacagtatattcaatgtggtgttgttaattaccactaaagatgatgcagcaatcagctggataatgacttgtgccaacttctccaaaagatattagtcttaatgatttgtttatattaaatcattctgtggctcatccctgttaatcccactgcttcgggaggcagaagtgggagaattacttgaggcctggagtttgagatcagtctgagcaacatggtgagactcctgtctttacaaaaagtaaattagccgggcaaggtggctcgtgcctgtagtcccagctactcaggaggctaaggcagcaggattgtttgactccatgaatttgaggctgcaatgagctataacatgccactgcactccagtctgggcaacagagaaagaccctgtctacacaataaataaacaattaaatgaacaaaccataaataaaatacgtagaaaaacacaaaactggccagccacagtggcttacgcctgtaatcccagcactctgggaggctgaggcaggtggatcactggaggtcaagagttccagactggccttgccaatatggcaaaaccccatctctactaaaaatacaaaaattagccaggggtggtggcgcacgcctgtaatcccagctactcgggaggctgaggcaggagaatcgcttaaacctgggaggcagaggttgcaccattacactccagcctggggaacagagtgagactccatcgcaaaaaaagaaaagaaaagtacaaaactttgacacataaaattttaaaaaagaaaaaaactgccaagcatagtggctcatgcccgtaatcccagcacctggggaggccaaggcaggcagatcagagtttgaaaccagcctgggcaacatgactgctacaaagaaatacagaaaattagccaggtgtggtggcacatgcctgtagtccgagctacttgggaggctaaggcaggaggagcccctgagcctgagaggtggaggttgcagtgagcctgggggtcagagcgggactctgtctcgaaaaaaaaaaaaaaaaaaactatgaataaaaaaaagaaaaacataaaactattaaataccaaggactacctcaaaatccagaaggcagtaacataagccttctaccactccttgaaaccaggaggccaaactgtagcatgcaactaggttctctgcaagagataaattgggtgaaattactgctgacagctaccactcttgtttttaagtagatttaaaaaaaaaaaaaaaattactcaaactactctcttggcaactcattagcaaaagtctaacctgtttctgtgaattggccacaaattaagctttagccactaatgcagcactaaagattagcaaacacttgagggagtaacacacacaatacaaaagaatcagacacctctaacattagcaaaatcctccacccttaccacaaagcttcagacacagattatgttaagtacaagcacagatcaaaggttattctatgatgacacaatggcttgccttggactgtggcttatctaagccattccctagtagtccggtgaatattaagtgggttgcaaaacaatgctgctattaacccatttcacgcagctatgctcaagaaaacgaagtatgatattcaaaaatgcatgcaagcagtcctaaaggtgattcaggaatactttggatggagactcaaacctctgagaactgaaaagatcattatagttctttcaaattctacattaccaaatctatctacaaaatcacagatttgattcacaaaggaaaggaaatacttagttttgctcctgaggcagcaggctttccagtcctaaaactgatggcagaggaggagcgtgaatcagacaggcggccactttaagaagcagttagcaaaaaatggtcacgcctagtgttggagccagtgcagtgcaaggcaagcatgtactgacaagagctccagccacgaaggaaggttgtgagtgtaccatgacagatctggctggcaggccactgaaggctgtctacatgatgctgaccacgagttttaatgtgtttgaaaattcctttgtgtgtgtgtgtgtgtgtgtgtgtgtgtgtgtgtgtgtgtgtgtgtatataattcttttaagttctgggatacatgtgcaggacacgcaggttaaatatgtatcttttaaattgagacagggtctatgttgcccaagcaagactcaaactcagtctcaagtgatcctcccacctcagcctcataaatggctggaatgacaggtgcacaccaccgcacctggctttttttttttttttagttatacaattatataactagtataatctcaatcagcaaatgaggaacactgatctcaattagtaaatgaaatagacacagaacacaaactagcaggaaattctctaagaggacagctttttttcttctgggctgaggaattatgagtgggatttttgtgttttaaaaagaaaaaaaaattaaggacaaaaattcctaactaaagtaacatttatcatggcctgttcagcctcagttgatcctctcctgtctggaagttatcggtccccctgtactgagaatgggaggcagattcttccaagtttagccacttgcccttggccaccatggaggccgaccctaagcttcccactacccgccctacacacgcaggccctgttctctctctcccacgtggcttttaacctgagctgtctccatagcctccctgtgaaatggtaagcctagagtaccagcgggagcagctagggacaagggttttcatcctaaaccactagtcaaagcccttgtgtatataagagaagcaagtgtaagcaagtgctcaggatacaacatcccagaaacatttttttataatactcaaagggctgattaacttatagcttcacgtgatggcgtggagccctgatacaaaaaatgaggttgctgtctgaggaagagctttgggtagagcgaattttcaaggcaacaggaacaacacgcagtgaagagagccatgtggccggagatcaaaaggacaaccttcccacgactgtagtgcaaagcaagctgctacctgggcatggggcttgccaggcacacctgctcccacacaccgtgatcaccatcaggaaaacgagtgaatcagcatctcagggtgaggcgaggcctcagaggtgtagggacacagaggtttagtttgcataatgacacacacacaggcctggatgatctagacagacttctaatgtcatgacatgtgttaataaagaagaacagagtttattctggtctctcttcctagcaaaaggaaaaacctcaagcccccaaactctttatccttcctcctaagaactcagtattttcactccccgagtgaaaaatttgcattcgtgtccatctgctttctgcttctctcaagactacacttccgatttctcaaaaaagagatttccaagtaaaattgtacccctctcctaccactacagactgggatacagaaatgttgaatacaatctcatctcaacccaatttgagcacagaattaatctgcggctcaccccaagtcccaagccttctaaagagaaattgaaaccttaaccgaccagcagctctactgtacttgcaaacggtcttggtatttccttcagggcagagcagtaaaagcacttcataagaaccctgtatgcaaggctcatcattatacatatttatgtgctataaaaaactaattttatcatccagggtaggaagcatgcagacatctctcacaaaataagctcatttattttgctcactaaggctcctgtgtaaaataagggtaaccactggctagatgggagtgactgtggcatcagttattttaatttcactcaggtggggggaatacagttttcaatctagccacttgctgttttgacaaatagagcgttactcaacatttgtcctgaagccaactcatatcctttcttaaatacatacactagaaacaaaggcaaaaaaaaaaaaacaaaggaagaaaaaaacaaaaccagcagctcatttcaacagtctccaaatgaagcatatcaaattacatcaactaaaaacattaaattaaacattatacaaaggcaatgcctgcagggcctgtaaaacaacatactgtaaagtgtcagaggaaacaagccccacacaatccaacagtctaagtcaacatcttttacagtctgtgctcaggccaaacattgagagaaacggaaatcttctttcaaagacactaacactgtctcttaaaaagatatgccaccaactacagcattgtcccttatagacactgtgtgctatggaagaagaatcccttcttagtggagcacaggcttgattatccctgactctgccactcctggggccctaggcagatgtctcggctttaaaatgggcacattttcccctatctatgagggctgcctttagaaaaaacagtcaatgcaggtgacatactgtgcatagtggaaggtgttcaatcgataagctatttgataggtagcccaaatttcttagagtatactgctaatccttgaacactgcaaattaaatgctaaatagtcttggaaataactattacccacttgctccaagccaggaccaatgcaaggctggaaatagctaagaatgctgactttactactaacctgcctacagtgggctgaatggtggcctccaaaaagatatgtccactttctactccctggaacctctgagtgctaccttagttggaaaaggaatcttagtagatgttattatattaacatctactaaaatgataatatctgggattgatgatattatctgggattatacaagtggggcctcactgccatcatatgtgtcctcataagagagaggcagagacagagaggacacacacacagaggaggaggaggcaatgtgaccatggggacagagactggagtgatgtggccctaagcagagggatgccaaggaacgcctgcagccactggaagccagaggagacaaggacagattcttccccagagcctctggagggagctcagcaatgctgatgacttgatttgaaacttctggcctccagaaccatgagagatgtattcacctaaaacacttggtattttaagccaccaagcttgcagtaacttgtcacagcagccacagaacactaatccaataccctacagaacactaatccaataccctactacagaggaggcaagttgcttaaatatacatccaagggttgactgatttccttttacctcaacaagttattttaaattataataataaacaagctattaagccagagagaaatgtactttaaagtaactagagcaaacacaagactagaacagctcagcacgtggactgcccctgcagtgctgcagggctagcataccaagtacaggttgctgggtgggtggcctgtaaggtttctttaaaaagcagttttttgatgctgccacagaagtggcaatcaagatcacaaggcagaaattaaataaggcagtatcaacttgaggcaagcagtcccttccctgaagtagcacttgtttccagtcttaaaaaaccagactcaaggcttcacagtaatttaatgtgccctgtcttttgactttgtgaaaatcagtgagtgcattaaactttgagggtaatcaaaccaagccaattcatggagattctttttatcatggtaacttggggagccaaaaacgaaataaacaagactttgaggaaaaataaatggctttggttaaagtatgtgaggaagaaaaaatgcatcttgtatattaggggaaaatatattttgtgaactagggaaaaactggcttcaagccttctggaatctgggaggctggcttgaagcatctgcagtgctaaaatttcactcctccatggcacctgactccaaaatttacacaatccagaagaggttgaaaatggagactattttttaaagacgtatttcctgggctctttatgattaaagggtaatatcaacaatcataccactgtccacatgcagccagtttatgataagctgtgctgcctagtccaggttcatacccatttttggtaaaagctgcagggcacaggatatcatcttttaaaagatttgttactccctcatgcaagcacattaatataaaattaaaggataactactaccaagttcttgggaaagccagccaataagaaagaaggggcccatgatcaccactgctataagtggcctccttcctgccttccctgacctcggttctggcatcaccaggtgcttctgggaaagggatgagaagggatgtgcccggcacaggcagacaatggaggaggctgtgttctcgaccctaatgcctcacaaatcacacagcctcaccagcgtcagaaggctcaacacaaattagtgcaaataacacacagggtaggtattttcttttcacttacaacccaactttgcagcaagacctttaaaattaagatgcaaagacagttataaagtgttttcttaagaagatatctaaattgccattctcaattaaaaagtttttgttggcatcacgtatgtgggccactttgcttctatcaacacagagagactgtcacccaagggtcctcagcacagaacacaccgcctgctgtgtttctttcataaaatgaagacctacccagcactgtgggaggccgagacgggagaatcttttgggtccagaagttcaagaccagtctgggtgacagggcgcgacctcatctctatgaaaaactttattttttttatttttaccttttttttttttttttgagacggagtctcgccctgttgcccaggctgcggtgcagtggcacgatctcggctcaccgcagcctctgcctcccgggttcaagcgattcttccgcttcagcctcccgagtagctgggactacaggtacccgccaccatgcccagctaatttttttgtatttttagtagagacagggtttcaccacattggccaggctggtatgaaaaacttaaaaaaaaaaaaaaatagctgggtgtggtagcatgcatctgtactccctgctacttggagggtggagcaggaggatcccttgggcccagaatgcaatgagccatgtctgctccactgcactccagcctgagtgacagagccagaccctgtctcaaaaaaaataatttaaaaaaatgccgggcgctggcagggcacggtggcccacgtctgtaatcccagcactttgggaggctgaggcgggcggagatcaagactatcctgtccaacatggtgaaaccctgtctctactaaaaatacaaaaagttagcagggcatggtggcacgcgcctgtagtcccagctactcaggaggctgagaaaggggaatcgcttgaacctgggaggcagaggttgcagtgagccgagatcacgccattgcactctagcctggcaacagagcaagactccatctcaaaaaaaattaaattaaattaaattttttaaaaaaagtgcggggacagtggctcatgtctgaaaacccaacactttgagaggctgaggtgggcggatcacttgaggccaagagttcgagaccagcctggccaacatggttaaaccccgtctctactaaaaatacaaaaatttgccgggtatggtggcttgagcctgtaatcccagctactcaggaggctgaggcatgagaattgctagagcctcggaggtgaaggttgcagtgagacgagatcacgccactgcactccagcctgggcgatggaggagacttctcaaaaaatatatacaaatttaaaaaaaaaaaagaatttaaaaaaacgaaatgaaatgagaaacaagatttccattattttcttcaagttcactacagtgtaagtcacagtaacaaccaccctttctgcacaccttctacatgccacacccaacaccaaacagccttatcagcgctgctgcccaaccaggtggagattatgatctacagttgaaagactagaaacctagctttggcaagacaaatctcccgtctggtggcatcaatccaaccgacccaccctgaagcctcagctatttcccttatgctcctgctgccttatgcataagccaccctagctgagatgttgcacagatacacatctatgtatcttaaagtttatgtgcccaaggtgtgatctaaacataaggcagtaatacaattacaaaagaaaaatgctccaggtgatgcaaaatatcattgttttaataaattaaaatgtcagtgaagcaatgagttgctcaaaaagaacagttcacaaaaggatacattcatagacagattagaggtaaccaggagctgaggggaggcagaagatagggagttactggcttgctggttacagagtttctgtttggggtgacgaaaaagttctggaaacagtggctatggttgtataatattgtgaatgtaattaatgccatcaaactgtacattttaaatggttaaatagcaaaagttgtatattttaccaaattaaaaaaaattaataacgtaatatgccaaaaaccactgaactatacactttaaatgagtgaactatatggtatgtgaatttatatctcaataaagtggttttgaaataggaaagaggaggccgggtgcggtggctcacgcctgtaatcccagcactttgacaggccaaggcgagcagatcacgaggtcaggagttcaagaccagcctggccaacatggtgaaaccctgactctactaaaaatacaaaaattagcagggtgcagtggcacgtgcctgtaatcccaactactcaggaggctggggcaggagaattgcttgaatctgggaggtggtatcacaccactgcgctccagcctaggtggcagagcgagactctgtctcaaaaaaaaaaaaaaaaaaaaaaaaaaagaaaagaaaaaggaaagagggccgggccctgtggctcatgcctgctgtaatcccaccactttgggagaccgaggcggcggatcatgaggtcaagagttcgagaccagcctgcccaacacagtgaaaccctgtctctactaaaagtacaaaaattagccagacacggtggcgcatgcttgtagtctcagctactcaagaggctgaggtaggaggatcccttgaacctgggaggcggaggttgcagtgaacaaagatcatgccactgcactccagcctgggcgacagagtgagactccatctcaaaaaaaaaaaaagagaaaagaaaaagaaaaaagaaaaaggaaagaggctgggcaccgtggctcatgcctgtaatcccagaactttgggaggctgaggttggaggatcgcttgagcccaggaggtcaagaccagcgagggcaacgtaatgaggcccccacctctacaaaaaaaaaaaaaaaaaaaaaaattagccaggcatggtggcatgcgcctttggtagctacttgggaggctgaggcagaaggatcatttatgcccagaaggttgagggtgcagtgagccatgatcgtgcctctgcactccagcctggatgacagagcaagaccctgtctcaagggaaagaaaaagaaaagaattaaagttaaaatttaaaaaaggaaagaaacagcttctaatagttcacttagaagatatatttctttacttccttttcccaataaaagtctaaaactccaggcgcggtggctcatgcctgtaattccaacactttgggaggctagggtgggtggttcacttgaggtcaggagttcaagaccagcctagccaacttggtgaaagcccatctctaccaaaaatacaaaaattagctaggagtggtggcgggcacctgtaatcccagctatcaggaggcggaggcagagattgcagtgagccaagattgcaccactgcactccagcctgggctaacagagcaagattccaactcaaaaaaaaaaaaaaagtctaaaactgaaaacacaatacagaactaagagtaagaactaaccatatgattcaaaggggagaaacaaaaaacagtaacatattcaatcttctccctgcatattatttagttacatgtaggttttttgcgggaggtctcctctgctttctggtcaaggctcaataattcaaaacaaagtcctgtttactggatgtacacagtgcatcatacaacatcttctatgcaaaccaacagccctccttctgtcccccacatctagtcagagaagtgtctcaaactatgtcaccacagcagtgacagcagtgagaagttaactgaggcctatgatgtaccagccactatgcattttacacacactctctcatttcatcctcacaacaaccctatcaaacaggttctaatattctcaatttaaaaacgaggaagctgaggtacagggagggtgagtaacttgcccaagatcacacaggtaataaggagcagagccgggattcaactgtactatactacgctccacaagatcctgaagtaaagcaatcctactggagaaatcaatcaaacggctttttaaatatttaaattcaaatggaaatgaatcctatggagtgttgtgacactgacagctatatgcttaccaacaataaagctatgttaaaactcatgtttatgttgggaagctggaagtcccatggaggagggaggtggaattactgtaagactcaatttaatacactgctcctctgtatgagggagggacaggctggacagcagaaggttaagcgagggcttccctgcaggtgatcaggcagcaccctccagggagacaagcttgacacacggggtcccttaacaacccactgcgaccctgcacgccatgctgctgggcacgaacggcagttgtgctagtaagcagcaaataaagccttgttctgtccgttactggcgagagggctgggaagaaatcttttctttttttttttggtcacccaaaataagttgacactgggaagaaatctttaattcttcagtttaaaatctctctgatgttaaatgtcaagcacatgcatattacaagaaaaacccaatttgctaacagcatgcaattgctttctatggagaaaaagggaaaacactggtgtgcttttatttcaggcaccacaggttccttcctctcccatctgtacatacagctgttatgtatacctattcaaccctccatacactgctgcgttatattcatttcaaaaacaaaactttaaaaaatgctccaaaccaaagccatcatgcttctattacgtaccaatgtgacacaatcatcatctgatttttcataagcaaacactaatgggtaggtactagcagaagtagacacttcacatttgttgctactgcactccaattttatgtccacaagctaacatagtttctttttcattaaactaaaacataaaacacattctgctaccacctctacctttactgaatctcctagcatgttagatctttttgtattttttctttttttttttttgagacagggtcttactctgtcaccaaagctggagtgcagtgctgcaaccatggctcactgcagcctcaacctcctgggctcaagcaatcctcctgcctcagcctcctgagtagctgggactacaggcatgtgccaccattcccagctaatttttttttaagagatggagtctcgctatgttcccctgcctggtttcaactcctggcctcaagcaatccacctccctggcctcccaaagtgctaggattataggcatgagccaccatgcccaaccttatttatttatttttaattaacaactaaaaattgtatatattgatatgtacaacatgttttgaaatatgtatacactgtaagatggctaaattagactaacatatccattacctaacatactcactttttgcagtgaaaacacttaaaacctactcttctggtaatcttcaagtttacaatacactgttagtaactacagtcaccatgctgtataacatatctcttgaatttattcctactaactgaaattttgtgtcctttgaccaatatctccccaatcctccccgcaccccttatatttcaagaaacggaaaagaatatatgctgggcacttattaagttctaggaactatcaaagtcctttcaaatctcatacaatccttataacctcgacggaagatgatacgctttggctatgtccccatccaaatcttatcttgaattgtaactctcacaattcctacatgttgtgggaggaacgtgatggaaggtgattgaattatgggggcggatctttcctgtactgttattttgatagtgagtgagtctcacgagatctggtgttttaaaaacgggaggttccctgcacaagctctcttgtctgctgccatgtgagatgtgccttttaccttctatcatgattgtgaggcctccccagccacatggaactgtaagtccaataaacctctttcttttgtaaattgcccagtctcaggtatgtctttatcagcagcatgaaaatagactaatacagtaaattggtactggggcgggagagggggctgctgaaaagctatcaaaaaatgtgaaagtgactttgaaactgggtaacaggcagaggccggaacagtttggagggctcagaagaagacagaaaaatgtgggaaagtttggaactccctagagacttgttgaatggttttgaccaaaatgctggtaatgatatggataatgaaatcaaggctgagatggtctcagatggagatgagaaactttttgggaactggagcaaaggtgacccttgttatgttttagcagacactggcagcattttgcccttgccatagagatttgtagaactttgagcttgagagaaataatttagggtatctggcagaagaaatttctaagcagcaaagcattcaagaggtgacctgagtgctgttaaaggcattcagttttatgagggaagtagagcacaaaagtttggaaaatttgaaacctgacaatgtgatagacaagaaaatcctggccgggcatggtggctcatgcctgtaatcccagcactttgggaagccaaggtgggcagatcatgaggtcaggagttcgagacaagcctgaccaacatggtgaaatcccacctctactaaaaatacaaaaattagctgggcgtggtggcgcacacctgtaatcccagctactcaggaggctgaggcaggagaatcacttgaacccatgaggcagaggttgcagtgagccgagattgtgccactgcactccagcctgggcaagagagtgagaccccatctcaaaaaaaaagaaaagaaaatcccattttctgaggagaaattaagctggctgcagaaatttgcgtaagtaatgaggagccaaagacaatggggaaaatgtctccagggcgtgtcagaggtcttcaaggcaggccctcccatcacaggcccagaagtttaggaggaaaaaatggtttcacaggccaggcccaggagccctgcatcccagctgctccagccatgactaaaagtggccaaggtacagatcaggctgttgcttcagagggtggaagccctaggccttggcaacttccatgcagcattgagcctgtgggcacacagaagtcaagaattgaggtttggggacctctacctagatttcagaagatgtatggacatgcctggatgcccaggaagaagtctgctgcaggggtggggccctcatggagaacttctgctagggcagtgcagaagggaaatgtggggtcagaacccccacacagagtccctactggggcaccacctagtggagctgtgagaagagggccactgtccttcagacagcagaatggcagatccaccaacagcttgcaccatgcatctggaaaagccacagacactcaatgccagcacatgaaaggagccaggagggaggttgtaaccctgcaaagccacaggagcagagctgcccaagaccatgggaactcgcctcctgcatcagcgtaatctgaacgtgagacatggagtcaaaggagatcattttggagctttaagatttgactgccctgctggatttcagacttgcataacttgcccaaaatcacacaggtaataagagcctgtagccaattactcccatttggaatggctgtatttatccatagcctgtacccccattgtatctaggaagtaactaacttgcttgtgattttacaggctcataggcggaagggagacttgccttgattcaaatgagagtttggactgtggacttttaagttaatgctgaaataagactttgggggactgttgggaaggcatgactggttttgaattctgaggacatgagatgtgggaggggccaagggtggaattatatggtttggctgtgtccccacccaaatctcatcttgaattttaactcccacaattcccacatatcgtaggaggaacccggtgggaggtgatacaattatggggcaggtctttcctgcactgttctcgtgatagtgaatgaatctcacaagatctgatggttttaaaaatgggagtgtccctgcacaagctctcttctcatctgctgccatgtgagatgtggctttcaccttctgccatgactgtgaggcctccccagccacgtgaaactacaagtccaataaacctctttattttgtaaattgccctgtcttagttgtgtctttattagcagcatgaaaatggaccaatacagaaggtgaatcattttatccccattttacagaggagaaaacatttgtccaagagcatatcattccttgtctcatcggtagctcagaaagaccataaagcagtgtcattccaggaaggcctagatttccagcggaaccctgttcagattcaaaacaaggaagcagtcctgtagagtaaactgcaggcatctagctcatcttttcacattccagtgcttactgaagatagccaaaaaagagacctgcttattcttcctctttctaagaactgaggtaaacagaaaacaaccttcccgaaaaccttcataaaagggtcaaggtgtcttgacaataccgaagacagttaacaaaacataaggcaaacgtctgattttgtgctttctgttgtacaataaaaagcaaaagcagagagcatttttagctcttagattttagatctggatttgaccaaaggatcttaacattaagtttggttttcaatgcattgattaaaactgaccaaagctataaaagcaggtaaatcatttgctgaggagacagcctccaatataaacagagtgcattccacacaggctgtcattagcagtggcgtgatcctgatttccatggctcaattctctcatgactttcctcctgattccaaaaaagcaaggaggactatgggaggtgcccaggccatgaaaaagacaaaatggcaccatgcaaaacccttatgggacattcttctagaccagtatggcttaaaaaaacacctcatatcacattcagtctttgcatactgcttaaacaacagtggtctcaggatttcctcaatagttgacttgataaagcttcccaaaatggcataactgatgctactaaatgctaatttagaataatgcagacgtaagtgaagtttatttcccttcgaggtttactttttaaatgttaagtctggtgagagcaaaataaaatattgtttgcatatgtgggcagtttaatgtccacccaaatttatgttaggagtatgcatgtttggtaaaggttacatttagaaaagactggtgtcaaaataaattaatcttcagaaaatcttgcatatttttctaaaatcatcagcttgagataatgttgggggcaactaccaaatgtttttctacaagggtaaccatgaaaaatgacaaaaatcaaggtttaatatcctaaatcacctgcaagtaagtaaaaacaaggtcagtattaacatagaaagagatgtcaaaagaagcaattgtttttccttcttttttctttttggtctcctcttcccagactcaagtgatcctcctgcctcagcctcccgagtagctgggactacaggtgtctgcccctacacccacctaatttttgtattttttgtatagactgggttttgccacattgtccaggctgctctcaaactcctgggctcaagcaaccctccttcctcaccttcacaaagtggtgggattacaggcatgagccacggcacctggtccagaaaacccactttacttacttacttacttacatttatttatttatttttgagatagagtctcactcttgttgcccaggctggaatgcagtggcgcaatctcggctcactgcaacctctgcctcctgggttcaagcaattctcctgcctcagcccccccagtagctgggattacaggcacccatcaacacgctcagctactttttgtatttgtagtagagacagggtttcgccatgttggccaggctggtcttgaactcctgacctcaggtgatccgcccgcctcagcctcccaaagtgctgggattacagacataggccaacgcatctggccataaaacccactttctaagggggttaagaatgaatgcctatacttaaccaagttattccaataaataataataaaaacaggccatgcatggtggctcacgcctgtaatcccaacactttgggaggccaaggcaggtggatcacctgaggtcaggagtttgagaccagcctggccaacatggtgaaaccctgtctctactaaaaatacaaaaattagcagggcgtggtggtacgagcctgtagtcccagctactcaggaggctgaggcaggagaatcacttgaacctaggaggtggaggttgcagtgagctgagatcacgccactgcactccagcctaagtgacagagtgagactctgtctcaccaaaaaaaaaaaaaaaaaaaaagaggaataaaaacagttcttggctaggcgcggtgactaacgtctgtaactccagcactctgggaggccgaggcgggtggatcacctgaggtcaggagttcgagaccagcctgaccaacatggagaaaccccatctctactaaaaatacaaaaaaatggccgggcatggtggcacttgcctgtaatcccagctacttgggaggctgagacaggagaatcacttgaacccgagaggcagaggttgcggtgagccgagatcacgccattgcactccagcctgggcaacaagagtgaaacaacatctcaaaaaaaaaagaaagaaaaaaaacacagttcttattttgtatttcaaatcttgcaggaatatttttcctttaatgatgaagaaaatattcttcctttacagattggaaaaaaatagaccaaaaaaataatcacagaaggattcccaaatcccacctcctattcaactactcttggtatgcatctaggttttacaaaaaaattctgaatggacagatgtcccaattcaaaataagcctacacatttactgtctagttcttttcaataatagtcctgcacagtattagcaatattagattgatctagaaatacagaaagtctcagctagcttttttttctttttttttttgagagggagtctcactctgttgcccaggctggagtgcagtggtgtgatcttggctcactgcagcttccgcctcctggtttcaagcgattctcctgccttagcctcccgagtagctgggaatacaggctaatttttgtacttttagtacagaccggttttcaccatgctggccaggctggtctcgaactcctgacctcgagtgatctgcccgccttgttctcccaaagtgctgggattacaggcgtaagccactatacccagcccagctaagctttttaatcaaagtttattttgattgctctgcatgttggtcacatacatgactgataaactagatgcagcccacatctaacccagtttgcatccaacatctgattttataaggagctgactttagtggagaagcaggattactgttttaatatttacagcgtgtaaatatttacaaatgactactcaagagactgaggtggaagggtcacttgagctcaggaggtggaggctgcagtgagccaagatcatgccactgcactccagcatggaaaaaagagcaagaccgtgactcaaaaaaataataataataatacaaatgagtcaacatctctcagttgaaaaatactgcagaacaatgaatttaacatcaagtacataaaaatgtaagggaacaatcataattggacctatatttagctggccacggtggttcacacctgtaatcccagcactttgggaggctgaggtgggcagataacctgaggtcagggagttcgagagaagcctattcagcatggtgaaacaccatctctactaaaaatataaagattagccaggtgtggtggtacatgcctgtagttccagctactccataggctgcagcaggaggactgcttgaacccaggaggcagacattgccgtgagctgagattgtgccactgcactccacattgcagcctgggtgacagagtgagacaccatctcaaaaaaaaaaaaaaagaactatatttaacatcaatcacctgtgggttccatggtctacagcaaaggctacatttccaaagacaaacactgccccaaaaaataaaagagctaagaaaatcatgttttctacaggcgcccgccaccgtgccggctaattttttgtatttttagtagagatggggtttcaccgtgttagccaggatggtctcaatctcctgacttcatgatccgcctgcctcagtctcccaaagttgggggattacaggcgtgagccaccgcgcctggccaggaaattttcttttgttttttttgtttttttttttcagacagagttttgctgtgttgcccaggctgcagtgcagtggtgcaatctcagctcactgcaacctctgccacctgggttgaagcaattctcccactacagcctcccgagtagctgggattacaggcacatgccaccacgcctggctaatttttgtatttttaatagagacgagtttcatcatgttggccaggctggcctcgaactcctgacctcaagcactctgcccacctcagcctcccaaagtgctgggattacaggtgtgagccaccacacccggcccctcataggaaatttaaatgccagaactaccagttctttttcttggaagagatctactatactacgtctagcaatgttttcttttttttttttaagcctatatttttaatacatttgttccccaaaaggtcactttctactttcaaaaaacatgtgagtcactcgagatgaaaaacagcttatctaaaaatgtgttatagctcccaataactccaaactgacatcccaagatatgaggctgttccacagtgagagaacttggaaactggaactctctgattacttacttgttaaaaaaaggttcaatgagttttgatctggcagacacatgaatttttggagggctgagaaaagaacctaatgaagaaaagaagagaggtattattattcatagtcacatagaccaagcctgaaagttcagaccaaaacagatttaaattaacagcatggttcaacaagtgtgaaaggtattcttttttttttgagtcagagtttcactcttgttgcccaggctggagtgcaatggcgcaatctcggttcactgaaacttccacctcccagattcaagtgattgtcctgcctcagcctcccgaggaccagggattacagacatgtgccaccatgcccagctaattttgtatttttagtggagacagggtttttccatgttggtcaggctggtctcaaactcctaacctcaggtgatccacccacctcagcctcctaaagtgctgggattacaggagtaagccactgcgcccggcctgtgaaaggtattcttacgcaccaagtaccataccacagcaagtgtcagtggtttttcttgcagatttcctcctcccctcatctcctcccactcctacctcaaaaccctcccacttttaattgggtgagtggatcccaaggaaatggtagtgctataggttcaatgtttgtgtccccctaaaattcatatgttgaagcctccccagtacgatggtatttggaagtgagacctttgggaggtaattaagtcacgagggaattagtgcccttataagaagggtcaggaggctgggtgcggtggctcaagcctgtaattccagcactttgggaggctgaggtaggaggatcacttgagcccagaaattctagatcagcctggttaacacagcaagaccctgtctctataaaaaaattaaaaagttagccaggcacagtgatgcacaccagtagtcccagctacttgggaggctgagcccaggagttcagcgttgcagtaagctatgattgaaccactgtacttccagcctgggtgacagagtgagaccctgactcttaaaaaagaggcggcacagcttctgctctctctgctctccaccacgtaaggacaggagaaggcagccatctgcaaaccaggaagtgggctctcaccagatactaggtctgctggcaactgggtcttggactttccagcctcctgaacatgagaaataaatgtctgttgtttaagccccacactcgacagtaatttattacagcagcctaagccaggagacaggtaagatccaccctagatcactgcgtgtttgactgaaagacatgtaatgcgtacctaggtaattggccatggagatgaagcacagccctgtgatgtaggcatcgtagcctgcctcgtggagttgttcagaggctgtgtcataacttggaaaaccttcggcactttctaagaaaaaaaaggaaaaagttttcctcaaaacaaagactagtaagcacattgccctaccaatcaaaattgcattagcatatgctagagaaataccctaaataggcagaaaaaagctatctattccttaattctctctatataagaccttaaaatacaagataacagagtcactgaaaaggagggctttggtctaggatacagaaatgcctcagttagattacaaaggactcagccgtgggctttctcgtcccacactggtgggtgctatttatgatcatccataactcactctaggacaatgattcctcttctgcttgctttctaaggccatgaaaaggatattcttcccttatacaagatggtcacatcaggccacaatagatgatccagagtaaagattaagagcatgggctctggagtcacactgagttcgaatctctgctccaccacttatttgcggtatgaccttgggcaagtcacttcatccctaaggttccagttttgtaaaacagagatgataatcaaaccttcttcaaaaggttattgttaggatcagataagataatataagttaaactcttacctagtgcttggtacatagtaagtgctcaaaaactgttatctatcaatacctgaggcaaccctcccccaaaaaaagagaagactgcaattcactatcaacagctccaactcactactgtcctctactatgttcccaagcttagagatcgaaaggtgacagcacaaccaactccaaaaataaatcgaacttgctataatgctggccttggatcatggaaccactttacagcaaagaccgctttatatacaatatggttcttttgtgacattgataaatacagatgtgaccagataaactataagaggaatgacctgctttagactgaattctctaccagataccactattttatatggaaataataacataaaactataactcataaataattatatcctagaaccattctggaaatgaatgtcaggaaggttactataacacagaatcaaaagcataaatggaaattaacaatgaaaaggctgtaactgtttttatgtcaatacaatgctctttaagcaagaattctttaactccatattaaatattagacttgatgcctttaaaaaaaagccttttaacatggtagccacctaagtaatatcttccactccatcatcaactgagacacattctttccaaaatcaattatttccattatattgttatagaaaaggtccacgttttctcccccaatggccccaccaccacttttcttaattcctttcttggactattacccagaaaggggcaaataactgtaatcttggctgctttaatactttgcattatcaatttctaaaccattagtcctattatccatgtctttagaagttttcaggctacaactaatggctcgctaatcaccgtatcagcagcacaatcaggttaacagggaccaaggaagtagcacctggtaggctctccacataccttggtggtggcccgaggtggcaaaacacctccatctcatctccctacttctggttttcctcagtgctgctgtttctactctctaaaccagctgaaaaggaggcagggtggggacttgccttaatctcacctgtaaatccagttctcgggcttttctgagatggaaaatatattttttactctacccctggtgattaatcactagctctttgtctctgcttcaataatgtatgaaagaataaaagggcacatcaagttttaggagaattccatattattagaaaatagaagccttgaagctttaattgctaaaattctcaatgaatggctacccaactccattaacataaaatatatgtagaattaaaagaccatctttattcaaaaaacaataattcaacacacggtacgtgcaagtgaattcagccaaaatctataaatgaacaatacggtctccagagccattctgcttttcttctacaatatacatcaataattattacaaagagtttggagggtttccggtttaatattcttaccaactttaggagggttgaaaggtgtctcttttaaccgcttttccaattccgcaagggatgtgttgttaatgatatcctgcaaaccacgaagcaaagaattatgagatttcatcatctcagaacaatatattaaagagattcactgacccccccaaaaaaaagacagcatctagtactgtctccttgtgttctttaaagaaacacagaagtcttcgtttttttcaatgtgaaagagaagcagctagtttaatttttataatatacaaagtataaccaaatgaataaagatctttacagatgcattaaatacctccaaaccttttgccagaaggctatattgttctggcattcatttcactcagtaatatgcagtcgctttataaagtagcaaatgaataataccttaaaaggttgtgtgctggccatcaatttagtatccaagagtctaaaaagaatttttaacaaggtaaacaaaatgtatatcaatgtttaaaatgtcttttactcaaatatgtaagctacttaaaatacttcatacataaaaaacataattaaaacataaaatgtttaatacagaaaatacttaaacacagacaaagtaattaaacacattggccattttgaacccagcaccagcatccctgctacgttggagtaggtactcagtcccatcatcagcgacttcattgagcaactgcaggagagtccacacttggagtacaagttctagattcacctggatcctcagagagcctgggctccatcaatctcaagggtgagtcaaatactctcacatggttttacgtggttcaaatactgctgccggtctaccattcccaaactgctaccatctactcctactcctcaggtttgtaaactataaattcttctgcagggccaaaatctacaatcagtactttcacgctgttgtttttatttcttattattctatttcagagatcagaaacaccaaaaggggagggtggggagaaacccacatgaaaactctatttctctgttttttttttttttttttttcatataaatgtgaacagagtgggtaacaggacagaaataagcccagctgaaagagaaactgctcgaacaccacgcctatccctcttcaacaggtcctaagacacaaacacttgttcggtaggctccacatggctgacctatgatgtctcagagatatgtgacatatgacctatcagaacaagggggcaataataactatggaaaacaccaacaggaaaaggcactgacttgaagtggatgaaaaacaaaatctctagccagatggacagttcttgactgactcttgaacactctcaattggacacttcaatagttacaaggtacatcctacatgcaagacagacaagagccatctcaaggaggcttcaacagttcttcagacagcaagatgagagataagaaaaaaggagtcgttggtctactttcactctcagttcaaactgtgattttttgataacaaaaccaatcataaattataaaagcaagccatcacaacattggagacattaaataagttccaagcttatatgaacatgatctaatggttttaacaaattactatatacctatttgtattgtgtatgtcacaatgactcttttttttttttttttttttgagacaggatctcactctgtcacccaggctggatagtagcactattatggctcactgcaacctggacctcctgggttcaagcaattcgcccacttcagcctcctgagtagctggaccacacgtatcccaccacacccagctaattttttattttttatagatatgtggtttcactatgttgcccaggctggttctgaactccctaggctcaagtgatcctcccacctcagtctcccaaagtggtgggattataggtgtgagccaccgtgcccagccaacttttttaaaagaaagacaaatcctcaaagaaagcttacctggggaaaacacatgttgtcatctctttaaactcacttaagtcctaaagaacaagagaaggacttgttacaattttcctaatacactcgcagtattaaaaaacatgtaaacagctcaagttccatagctgtcttctcaaacaagctgttggggcccttaagctaaactacaaaacccatttctagttaacaagtacaaaaaaaacacaaaaccttcccaatttcctcactcattgggaaccatataacctgataactaacttctgcataaccaaaacaacaaatttaaggatttaatagttgaaattgggaaggggcagggggtccaataaaatgttaaaacctacctatttgagaggcctgtaataaaagcagaaaacttccagtaatagctaacaggctgcgatctaccacacaaatttatcataacagtgagacaagcagagtcatttaaattaaatggtttacacaggaaatgggcatactgtaaactagcttagacctttcctgagatcacctttgaaatgttagtaaaaatggccttggaaacacaggcttttcaatacacatatgattcctgtttcaactccagaaaattgctcaagtggcactaatagcaagtgcctagattagacaattcatttctcaagtttattttgatcaggaagtctagagctgaaatgagagtcctctaattttgaattaactcatttacatacataattgccatgctagactgagtagtcatactcctgactctttgtaaactacacttctcttcaatgttattcatgcttcataggaaactgctgtttccaattagcttttcaagcctgtaaatacagactgtatttagctagcctgatatatttaccagcttttcactggctataaattaatgggcaaagcatgaacaggcgatttcaatgcaacgtcaaaaaatgcaataatgatgtttgtaatctctcaataccactagaaagctttacaagcaaggaacaaggagaattacggccacctccagggccaacatatagcacagttctagaccaatgtcttctaaaaggtcatgctcaagtatcaagatagttcataagaaaacactctcctctaaaaggcaactccaaaatgtggattatttagtatccttttaaatgcaaattttgataccagtgcatgtaaaagctctacctttttatcaagtcagggtctcactatgttgcccagactagccttgaactcctgcactcaagcaattctcctgtaacagcctctcaagtagcaggcactgcaggtatgcaccaccacacccagccttctaatttattaggctttctaatttcttctcatcacttcttctaaaggtagatggaaaaaaacaaaacaaaacattttctttctctgacaatgccagaacataaagaagttaagttacttaccaggtagccttagtaataaagtgaaggataaaactgcttatcctaacccacttactactctacaacaaatcacttgctctttctaccagaatttaattcaagaccactttcattccacttaacgttcattaactgcttacatacaatgtgttaagtcaggccattcattaactgcttacacgcaatgtgttatgttacgcacttacacaacaaaatggctacaccccttgtccaaggagctaaccacctagaagggggttatgctgtataatacaagacaaaatttatgtaacatagagatgtacaatgttctgtgggagttgagagaaaggaaagatcacctcttgggcaaggtagcaggcaataaaaacttcatggagaaggcaaaagctgcaccgcggaaagttaagggaaagctgtgaacaacaaacattgagaacaacaagagaaaattcaagttggaagaaattaaacaaagcacctcttagggaacaaataagtcagtcttggaaaaaggagagcaacaagggattagactacacagaaaggttgggctggatcacagaaagcctgttatgcatgggtaaaaatagtcaactgcctagaaaacaaagagtgtgggattaatttagaattttcagcagggtcagtgacaggaacggagccatacatcagaagattacaaaactggcagtcgggagatacttcatttgttaaatcgatatttaatgccttctagtgccaagctctattcagtattcgaaacacctagaagcacagaattaaatacattttcctcttgccttgctgataacttcattgctttaaagatcaaaaaaggctgggagcgggtggctcattcctgtaatcccagcactttggaaagccgagcgggtggatcacttgaggccggaagttcgagaccagcctggcaagcatggtgaaatcccatctccactaaaaaaaattacaaaaattagccagatgtggtggcgtacacctgtaatcccagctacttgagagactgagacatgagaatcacttgaacttgggagagggaggttgcagtgagccaaaatcacaccactgcactccagcctggcgacagagtgagactctgtctcaaaaaaacaaatgaacaggctgggcgtggtggctcacacctgtaatcccagagcattgggaggccaaagcaggtggattacctgaagtcaggggttcaagaccagcctggccaacatggtgaaactccgtctctactgaaaatataaaaattagctgggcatggtggcaggtgcctgtaaacccagctactcgggaggctaaggcaggagaatcgcttggatccggtaggcagaggttgcagtgagtcaagatcgcaccactgcactccaccctgggccacagagcaagactctgtctcaaaaataaataaataaataaataaataaataataaaggtcaaaaagtcaagagaggagctgctactttgatctacttggccagtaagaagtgggtgatctggccaggtgtggtggctcacatctataatcttagcactttgggagactgaggtgggcagacttctcttgaacgcaggagttcgagagcagcctgggcaaatggtgagatcctgtctctacaaaactttcaaaacaattagtgaggcatggtggcatgtgcctgtggtcccagctactcgagaggctgaggtaggagtatcacttgagcccagggagttgaggctgcagtgagccaagatggcgccactgcactccagcctgggtgacagagtgagacactctctcaaaaaagaaaaaaaaaaatggccgggcataatggctcatgcctgtaatcgcaacactttgggaggcccaggcaggcggatcacctaaggtcaggaattcgagaccggcctggccaacatggcgaaatcccgtctctactaaaaatacaaaaattagccaggcatggtggcaagcgcctgttaattctagctactcaggaggctgaggcagaagaatcgcttgaacccaggagacagaggttgcagtgggccaagactgcaccactgcactccagcctaggtgacagagtaagactccatctcaaaaaaaaaggtgcgaaagtgaagaaaaaagaaaagaaaaaaacagaagtgggatgacataaaataaacattagctcattagacttaagaaacgcaaatccaggccaagcccggtggctcacacctgtaatcccagtactttgggaggcagaggccggtggatcccctgaggtcaggagttcaagaccagccttgccaacatggtgaaaccccatctctactaaaaatacaaaaattagctgggcatggtggcgggcgcctgtaatcccagctactcggggggctgagtcaagagaatcacttgaacacaggaggccgagatcgcaccactgcactccagcctaggtgacagagtgagactccatctcaaaaaaaaaaaaaaaaaaaaaaaggtaggaaagagaagagaaaaaaaaaaaaaaacagaagtgtggtgagtgacataaaataaacattagctcattagacttaagaaatgccaatccaggccagacgtggtggctcacgcctgtaatcccagaactttgggaggcggaggcgggtggatcacctgagatgaggcgttcgagaccagccaggccaacatggtgaaatcccgtctctactaaacatacaaaaattacccgggcatggtagcaggcatctgtaatcccagctcctcagcagtctgaggaaggagagtcgcttgaacccaggaagcggagggtgcactgagcagagatcacaccactgcactccagcctgggccacagaacaagattcagtctcaaaaaaaaaaaaaaaaaaagaaatgcaattccataccttttacacttgttttgagacccacaactatgaagtctttgagtcctaaaaggtgttaaaaggtgatagagctgtcttaaacagtgatgacaacctaaattttaagaaatacaaggggagcaactgacccactcatgacgtctgtattgtacttttttaaaggagggtaatcaaaatgctgacggaacaatgggacctaagaaatgtgaagtaactgaaggtttacagatgtataagtgagactgaactctcaagcaggtgtcttccaatctagaagtaacaaaatattaatcttttagctgggcgtggtagtgcacacctgtggttttacctatttgggaggctgaggcaggaggaccgcttgagcccagcaccctgagatcagcttggacaaaagagtgagacctagtctctattttattaaaaagatatggggaaggccgggcacagtggctcacacctgtaatcccagcactctgggaggccaaggcaggcagatcatgaggccaggagatcgagaccatcctggccaacatggtgaaaccccatctccactaaaaatacaaaaaaattagcagggcgtggtggtgcacgcctgtagtcccagctactcgggaggctgaggccggggaaacacttgaacctcggaggcggaggttgcagtgagccgagattgcaccactgcactccagcctggcaacagagtaagactccatctctaaaaaaaaaaaaaaaaattatttaaaataagaaaaagattagtccagtggcatactatggtccataggccaaatacagccaaccaattattttgtaaatgaagttttattgcaacacggctatgccaattggtttacgtattctatggcatttcggggctacagtggcagagctaagagttgtgacagaaactatgcagcatggaaagctgaaaatattttactatctggccctttatagaaaacgtgccaacgttcattttaaaggatgggctgaaggttgaagggggacaggaaatgctgcctggaatttgctaaactcaaagatgagaaataaggccgcttgcaacaaaaataaaaacaatcagctgggcatagtggctcacacctgtaatcccagcactttaggaggctgaggcgggcagatcaggaggtcaggagattgagaccatcatggccaacacagtgaaaccctgtctctactaaaaatacaaaaaaactagctgggcatggtggcacgcacctgtagtcccagctactcgggaggctgaggcaggagaatcacttgaacccaggaggcggatgttgcagggagccgagatcatgccactgcactccagcctggtgaaagagtgagactccatctcaaaaaaaaaaaaagaatccagatgtgagagagggcatggagataaaatcgtcagaattttggaaatgaccagatctggagacagagcaagagtcaaaactgatgctaaaaacagggttggtaactgggaatcacttatagtaatgggatgaggagaaagaagtggtttggagacagtaagaaagaaaagaagtacaagttaaatatctcatttgagccacgtcaattcaaaacaacacttagtctgggggctatccaggtagggatgtctggagtccagcatgaaatgtatacctggatctgaacagagaccacagctggggataaagatgttggtgtctacagctgaagctgtaaagtgagtgagatcactaaaagacaaaaaagatgaagaggaaataaaagagtggagcgcagagtggcgagggacaagtaacgtgaggccacgcaaaccgtatggagcagaagagggagagccagtagaggaaccaaagcagcttgtgctttggtcaaccaaggcaacttggctcaaggactgaaaaatgcactactgaggtcagcagagaatctaagggaagcagcctagcaagggcgatcaagaattctgtaggactggacccacttcagctgccaccacttaccttcaatggccctgctatgtctaattgtagcaggaccaaactagcagcccacacctgtggcctgggaatccctgcccagcactaaatgagcaaaccactggcattaagacaatgaaacaaatgtttaatcttcctctggcaatggcagtgactgaagatcccttaataaaaaagtttgtggccaggcgtggtagctcaggcctgtaatcccagcactatgggaggctaaggcaggcggatcacgaggtcaggagttcgagaacaacctggccaatatggtgaaaccccatctctactaaaaatacaaaaagtagctgggcgtggtgacgggtgcctgtaatcccagctactcaggaggctgaggcaggagactcgcttgaacccaagaggtggaggctgcagcaagccaagattgcaccactgcactcctgggcaacagagtgagaatacatctcaaggaaaaaaaaatgtgcaactgagtgcataagattctctctgggaacatgctgcatacaaggaaatggcacccaagtagaggacagttcagttaaaagcatcataataatattttttcagataaaaagaatcctgctaatattaaacacagaccaacaggtcacttaccgcaggcagagggcagtagaactgatgaactgtgtgcatgacgtccaagagcatattgtgtccaataacaagttttccctaaagaaagtcaaggttagaaaaaagacttctacattcgaaattatactggggtttcagaatgtatagttcagattccaagaggactttgtactaaactcgctttccagacttaaaaaaaaaaaaaaaaaaaaaaaaaaaaaaagtacaaataagctaatttgggctggcttcattcctcctccattttggaatgttaaatccagaaagcaaagtgaaagcacaaatgactttgatgtcactgatctttttcttgaatttttattaattatgccaccctcatgaatcagaagtagtaaaattttgattgaaaagtttttttaaaagtaaaatctgggccaggcacggtggctcacaaatgttatcctaccactttgggaggtcaaggcgggtggatcacctgaggtcagtagttcgagaccagcctggccaacatggcgaaatcccatctctactaaaaatagaaaaattagccaggtgcggtggtgcatgcctataactccagctacccagcaggctgaggcaggagaatcgctggaacccgggaggcagaggctgcagtgagccaagattgcaccactgcactccagcctgggcaacagagtgagaccccgtctcaaaaaaaaaaaagtaaaatctgaaagcgttgactcccttaaactgtcaaataatttgggaaaaaactaaacacaaattttagggctgcatcctttaaaacaacccacttattttaaaagatacattcataccaatgctaaaaggtaaaaataactaatttctaactatattaaacagaattgcatttcctatatcattatgtcaaaattcatggggcatgttcttaaacacacatccattaaaagtcactgcctttcagccaaccgaaatacaatatatgtgctggcagccctcttcgtgcaatgggcggtgtgtctgtctcacactatatgtgcaacaaattagtccattttgataaaaattaaatttccaaaatggaacataaatttagatttagccagccaggtgacaccatttttaacataaaacatcaggggccgggcgtggtggctcacacctgttaatcccagcactttgagaggccaaggcaggcggatcacctgaggtcgggagtttgagaacagcctgcccagcatggcaaaatcctgtatctactaaaaacacaaaaaattagctgggtgtggtggcagatgcctgtaatctcagcaactcgggaggctgaggcaaaagaatggcttgaacccaggaggcggaggttgcagtgagctgagatcgcaccactgcactccagcctgggcgacagtcagactctgtcttggaaaaaaaaatcaggttaccacgatggagcttttactataacccaaaggaccttcagtgtaacactgcttgattcatgggactacacattaattatctgaaataatcctacacaaaatctcccaaatctaacagagaagctgtccttttggctcattattggtgtacattctgaatacctatgctacgctaaaataatgagcattgattgaaaccacagaaaagatgtgtaggtaaccccaaatggaatgcaaacactaagaaatgaaccaaactgtattataaatgactaccataaccacactgaaggttaagaagaaacaaactaacttggaaaagagcatcttgactagatactgtaaggctaaaaacaaaacgaattgcacataaatcataaatgttatcatttcatcaataaatgtacttctcgcgaggtatgggttagtagctctgaagctactttatgtgtataccgggtttaaacaaataaacataatggaagtaatagaaactggatttctcactgttgagaaagaaggcacaaataagaaaagagaggaagctaaaaataagtcacgtggtattgtactggaatctgaggtatcagtataaaggcatgcatacacccatgcgcacacacacacaaacacacacacacttatttatttagagacagggtctcgctctgttgcccaggctgtagtgcaatggcaccatcatggctcaatgcagcctcaaactcccatgctcaagcaatcctcccacctcagcctcccctacagctgggaccacaggcatgtgccaccactcctggctaattttttaatttttttttttgaaatgcagtcttgctctgttgcccaggctggagtgcggtggcataatctcagctcactgcaacctctgccttccaggttcaagagattctcctgcctcagcctcctgagtagctgggattacaggtggcaccaccacaccagctaatttttggattttcagtagagacggggttttaccatgttggctaggctggtctcaaactcctgacctcacgtgatctgcccgccttggcctctcaaagtgctgggattacaggagcgagccaccacacccagccaatttttacattttttgtagagagggggtctcccatgttgcccaggctggtcttgaactactagcctgaagcagtcctcctgccttgacctccctaagtgtgggattacagggttgagccaccatgcccagctacatacacatttatatagatccacacacacatacatatacagagagacacagaaatatagctgtgtgtgtacatgcctaggtctacatacatatggttcttagttctgtccagtgagagggcttagaagcaataatatcacctagggccagaagcagtaacctagggccagatcttggtttctaaacatcattccccattaagaggaaccagagctccgtggagaagtcattcattccatagctgagccagagaaactacaagaataccagaaagcaaagaagtgctcagaaaaggatggggggcttgttcagagggcacaggagccaagtcaaagaagctccaatggccaaaggtggtacaatttaagcaacaaagtaaacagtaaaaatcctagataataatctagtattattattaatactaataattaaaaaaaatccctgagtccatacatatacataaaaaccattaaataaacaagggaaagggctgggtgtggtggctcgtgcctataatccaaatactttgggaggctgaggcgcgggagactgcttgagcctaagagttcaagaccagcctggacaacataggaagaccccttctccacaaaaaaaatatatatataaaattatccacgtgtggtactgcatgcctgtagtcccagctgctcaggaggctaaggaggagggaggatcgcttgagcccgggaggtagaggctgcagtgagccagtgtactcccagcttggggaacagacagagactgtgtctcaaaattaaataaatacataaataaacaggggaaaaggacatttttttctttcctttttttttttttttcgagacagggtctcaactttgtcaccaggctacagtgcaatggtgcaatctcaggttactgcaacccccgcctcctaggttcaagcgattctcctgcctcagcctcccaagtagctgggattacaggtgtgtgccaccacgctcagctaatttttgtattttcattagagatggtatttcaccatgttggttaggctggtgtcgaactcccgacctccagtgatccgccccccttggcctcccaaagtactgggattacaggtgtgagccaccatgcccagcccatttttttctttatagaagaattccaagaataaatgtagaaaggacgaaggaaatataaacttgccattagaataccacagtaataactgctacaggcaagatatgctgatagacgataatattagtaggcaaagtttgagggaaaacaggattttcatggtctcaaagtatctcccccaagatattcataaactataaagttaaactatatagttaatttaactataatttaatgacatagttaacttattaactataaaattaatttcacagaacacaaatccagccaacaccaccttaaccaagcgatcaagatcaacatcacgggcagagaatggtggctcacgcctgtaatcccagcattttgggaggccaaggcaggcggatcacgaggtcaggagaccgagaccatcctggctaacatggtgaaaccccgtctctactaaaaatacaaaaaaattagcctggtgtggtggcaggcgcctgtagtcccagctactcaggaggctgaggcaggagaatggcgtgaacccaggaggcagagcttgcagtacgccaagatcgcgccaccgcgctccagcgtgggcgacaaagcaagactccatctcaaaaaaaaaaaaaaaattgatcgacatcatgaaccatcatttctgtggtattcttgccaaaccatatatcctcaaatcagtcatgagaaaatgtgagacaaattccaactggcggacttctgacaaaacagcaatcaataccattcaaaagtatccaagttatacagccgggcatggtggctcacacctgtaaacccagtatcttgggaggctgaagaaggcagattacttgaggtcaggagttcgaggccagcctggccaacatggtgaaagcccgtctcaactaaaaatacagaaattagccaggcgtggtagcaggcacctgtaatcccagctacttgggaggctgaggcaggagacttgcttgaacccgagaggcggaggttgtggtgagccaggattgcgccactgcactccagcaggacaacagagcgagactccggctcaaaaaatatatatatatatatatttaaggtatgggatttacgcatcttattttactttagtcaactttcattcaagactcaaaaattttaaatgtccggatcgctaataaacagggctttttggtagtatgctttgggatgttgactaccaacggtcagcaacatgttatgaatattctgtagaagaaagatgtcagagaaaagaaaacaggtacagcaagctaaggtatccgaatgtgtataagacaaacaaatgtccaatcttggaaaagctgactgaactatcatgacggctacaaaagagctcaaaaccaacttatgttccgtatctctgaattttagggcccgcctcaatcaaaaccaccacttatctgaagtctgctggctaggtgtgcacaacatgagcaaatggaaccagaaactcaactctgcttttctggatacctgtaatctcagccactgctgaagaggctcacagcattgtttctctccggatctttccaactttctattcgactttaatcgccccacttacttgagcaagagaagtcctcgtgagccaaccctcttcttttacaaggctctgtaaacctctgtttatcccggaatgaggacagcaggggccttccctacagcgcccctgtgtttacaagcctgcagctggcagtgagacagcatgaaaccttgagagggtttctatggccttaaagcttccctgatgcaaagttcagcatctaaggtataagatgattccttctcccaggccaactgctcaaataagagaatgtcctagactacaggcaattcagcatccaagcaagctgtctagaacaaccagcagcatgacctagtttacctatgtaaaatgcggatgcctgttttctttctcctcttcttttttttttttttttttttttttggagacagggtctgtctgtcacccaggctggggtgcaatggcgtgatcacagctcactgcagccttgacttcccgagctccagcgatcctcccacctcagcctcccaagtagctggaaccacaggcatataccaccacacctggctaatttttgtatttttggtagagatggggtttccccatatttcccaggctggtctcgaactcctgagctcaagcaatccatccttatcggcctcccgaagtgctgggattacagacatgagccactatgcccggccgcctgttttcagaaaggcctcacaaagcaaggaaaaacacccatcatatctatcatagagtcccctagcacatttacacaaatggccaatatctttttaaaacatatcaaatattattaagaataagattcaattacacttatgtagcactaaacaaagacatcattatttttaccctctagattcttctacttagggaacaaaacaccttcagtcaaatatctgattgtttctccccttattccttactttctttttcgacttcttactggttttgaaaataactcttggtttccatgtagccatataaggacaacatagtgtaaccctcctatgcatttttcaagcaaggctccctgaaaattgatttgaatataatttagcaattatgcctcaccaagtgcattataacaacagtctatcttgatgaagttctaacttcttagaatgttctaggtaaacattctaaaggagatgaaatgattaatctgcaatgataattagatacttcacctgaaatagtatgttctgcaatcttgctaaaaagtctggctcacttaccgaattagcaatggcgtgaatgactctagaaaatcccacagcatcattcagctcctcctaattaaaaaaatatatacatatgtattattgatgtataaatattccttatgtgaattaaaaaactaccccaaaaaaaagacactgaaattttgtatcaagttagatagctttagtttcctgtgctttgcgcctatcttcccaaacatttgcatctaaaatgatctacgtacatacttttcttctattttagaaagtagaatgaacaaatggaaaattattcattagttactaaaagaacaatgcttagggtttatccatcacttcaccgacttctttaaaatttccaagtctttcaaggtgtcttaaaaacagtaacttaaaaagttgccacctgcaggctaaactcagtaacacattcaattctgaggaaacccatctggcagttaactgatcaaatcaagtattttcataattcctgattttttttcctcgaaaaatacatttttacaaaattctcccacccaccttcttctctcctatattctttccagcagtgttgaaagaggctcagtgtctctcttatcttgaaaaccctcccctcctctaagatctctcagactactgccccttctacttgtctcatcaaagctaacttgctttctccagtttaactcccaggtgttcccagccctctggcttcatgctcactgaaattgctcacctccttaaaactaaccccaacactggctgggtgaagtggctcacgcctgtaatccgagcactttgggaggcagaggcagatggatcacttgaggtcgggagttcgagaccagcctgaccaacatggtgaaaccctgtctctactaaaaataaaaaattatccggacgtggtggtgcatgcctgtaatcccagctattccagaggctgaggcaggagaatcgcttgaacccgggagacggaggttgcatgctgtaagccaagatcgcaccattgcactccagcctgggcaacaagagcgaaactccatctcaaaaaacaaacaaacaaacaaaaaactaaccccaagactaacaagtatttgcaaggatgtagagaaactggaacctgtgtgccgttgatgaaaatgttaaacagtgcagcagctaaggaaaacagtatggaggctcatcccaaaaagaattcccatattacccagcaattccatttctgggtatataccccaaagaattgaaagcagggactcaaataggtatatgcatacctaaattcacaagagcattattcacaatagtcaaaagcaacccaggtgtccacaaacaaatggataaacaaaatgtggtctagccacacaatggaatattattcagcctttaaaaaggaaggaaattctgacacatgctataacatggggaaccttgaggctgctatgctaagagaaataagccagtcacaggaggacaaatactgtacttatatgaggtactcagagtgaccaaattcatatgacagtaagtagaatagtggttgccaggggctgggtgtcaggggtgggagatggagagctgcttgattagtacagtttcggttttgcaagatgaagagaattctggagatggatggtggtgatgattgcacagcaatgttaaactacttgatgtcactgaactatacatttaatagttaagatgataaattttgttatgtgtattttaccacaattaaaatttttttgggggggtcaggcatggtagctcacgctggtaatcccagcactttggcaggctgaggcaggcagatcacctgaggtcaagagttcaagacctgcctggccaacatggcgaaaccccgtctctactaaaaatacaaaaattagccggacgcagtggcatgcacctgtaatcccagctactcgggaggctgaggcaggagaatcgcttgaacccgggaggcggaggttgcagtgagccgagatcatgtcactgcaagcaaggctccatttcaaacaaaaacaaaaattgcttttttggttttgttttttgtttttgagacagagtctcactctgttgtccaggctggagtgcagtggcgtgatctcggctcactgcaacctccgcctcccgggttcaagcgattctcctgcctcagcctcccgagtagctgggaatgcaggcacatgccactgcgcccggctaatttttttgcacttttagtagagatagggaaaaattgctttaattatagtttaaaaaactactgccagggctgaatccaacagccatgtctcaatactaacccctacatgggagctgacattgctgactgcccctttttctctcctcccttggctgtgtaccacaataatctcccggtacattttgtcgacttctgcctatcatttaaatgctgttgatcctcaggattcagccccaggtcctcttctcattcctcacgtactctgcagttgctctgatccagtcccagtctctctgccaatgacaatcatgcctagccctcacccctctcctgtgctcaacactgacaaacctgctaagaggacatccacccttgcatgtcctaaaaacactcgaaacctcatcaggtcaaaaccagaatggaacatctttttccactctgggggaacatctttttccactctaggggatgccatggtgccctggtggccttgcatgtatcaaaacgggccatgcaggtaaaggctaatctgcgtcttggccacagactcatctgcgtcttggcacaacacatcaggagggaagggtgggaggcagaggcttctaaggagctgctatgaggccagctcccacccccttccctgtcactcctgggaggctgtcatgaaacagttcctcattgcctcctgggttctgaggaggtgtggggctctctgcctcgccctctcagaagagagctgcagagtatcaaagccctgagctgcagcctagaactcatcctcagtgaagccacatcacaaaacacatgctgcaatcatctcgtatcttttttttttaagacaaggtctcactctgtcacccaagctagagtacagtggcataatctcaactcactgcaactgcaacctccacctcccggggtcaagcaattctccagcatcagcctcccaagtagctaggactacaggcgcacgtcaccacacctggataattttttttgtattttttgtagagatggggtttcgctatgttgctcagactggtctcaaactactgagctcaaagtgatcctcccacctcagcctcctaaagtagtgctgcgattacagtcatgagccatcacacctggcctctaactggcaccttttgtttctgcgttgtcctttttagtatgtgggacagggaccacaggcagcacctcttgctaatctttccctgtgtaggtaatatgctgtctcccaaagtgggtcattgtggttaagtcaattaggagtgaccctgcctaatgtacatatgagcatgacattcatccacatgcaaacccactcctctctcctccaccttttcccccaaccgatgtcactccagccaacccctccaagtgaatggagtgcagtctaccccgttgtgcaaatgtctggcatgagcatcttcctccttcccccttcctcctccaccacccacattcagtcataaattccatggattctaccttccaagtatctccagattccatctacactgctactcactatcctacgccaggtcaccaacatctcctagctaggttactccacagcttaactagtctcctgcctccagtcttactcactcgaaaccattcttcacacagcaagcagggtgatgttccaacagtacaacctaagcatgtcatcctcatctgtcagatcatgtgctctgaacttggtttaaggaaaactagtaactatacatgaagttagacgttgcagtattaaaggatagtgacactcagtgacacaagctaaatgagaatcaagagtactttcttcaggactggtttaagtagacactggtcatcagtgacgtcagactcactttgctagctacgtctcatgcttaaatctaacttccccttattctagtccaggtttttctgccaattccattgttctatgaaagaaaactattcattaaattgaatccaacatatgatctgaaatagacaggaataaatcaatatttatgttgccatttctcaccccccaagaattaacatagcccaattacctgttctttggcatgtttctgctgctctcttcttttgcgttcttcttcatctactttgctgataactatatatcgctccttctaaaagacataaagcagatatacaattttcttttctttttctttttttttgagacagagtttcgctcttgttgctcaggctggagtgcaattgcatgatctcagctcactgcaaactccgcctcctgggttcaagcgattatcttaccttagcctcccgagtagctgggattacaggcttgtgccaccacacccggctaatttttgtatttttagtagagacggagtttctccatgttggtcaggctggtctcaaactccccacctcaggtgatccacccgcctcagtctcccaaagtgctgggattacaggtgtgagccacggtcctggccacagatatatacaattttctagagacaacttaatccaaaaaattcagatttctgctgccattagaattttttttttgagacagtctcactctgtcacccaagctggagtgcagtggcacaacctcagctcactgcaaactctgcctcccagattcaagtgattctcctgcctcagcctccagagtagccaagattacaggtgcgcaccaatacgcccagctaatttttgtatttgtagtagagacagggtttcaccatgttgcccaggctggtctcaaactcctgacctcaagtgatctgcccaccttggcatcccaaagtgctgggattacaggcatgagccaccacacccagccagaagttgtaatttttgtaaccgcacactttttttgtatgtgtgacaggttatcactcccattgctcaggctggagtgcagtggcatgatcacagctcactgcagcctcaaatttctgggttcagatgatcctctcacctcagcctcctgagtagctgggactacaggcatgtaccactatgcctggctaatttctttttatatttttagtagagacggagtttcaccatgttgtccaggctggtctcaaactcctgggctcaaatgacctgctcatctcagcctcccaaagtgctgggattacaggcctgagccaccatgcccagccactgtagtctttcatgagccaaatacaacagaaaatactttgaaatgccaacataagttgagctaatgcattacaaaccaaattttgtctctgtgtttccatgacattttcctacggtttactaattcaacccaacagacatcagttaaaaatatcaacagactgtgagaataagacatttcctatgacaaatactaaaaaagttatattgcatttgaacattgacttctgaagagttttaaagtaaaatgtatatgttgtattaacattaacaaaacttacatatatatgttgtattaccataagaaaaaactctggattttctgccaaagtgtcagataactagtactttctttctcatatattttgtgtccactaaagataaattatctaccaagattatttttctactttatttaatctctaattttatacctgacttaacagcaacaacaaattataaaattgaaaaactgcagaaggaacccaccactagccacccacttcccatcacaattctatcagtgtaccctgtgtactcaggacaatagctgtgcttacgacccaaattctaaaatttaattttgtctgcccacgcaacatgaagccatttcttcacatgtaccattatagctttctgccatagtaagaatacaaactaatatttgtatactttcaagtttacaaggcatcacttccacttacccacggtatcaccataaaaaggctatgagaaagtatagatcaccgttatcatgctcagtcccaatgtacagaagaaaattaggcttaaagagatcaaatgacttaccctaggttacctagctcataacaagcacagacaagatacaaattctgactttcagcacactaaggattgagcatggtagctcaggcctgtaatccagcactctgcgaggccgaggcgggcaaattgtttgagcccaggagttcaagactagcctgggcaacagggcgaaaccctgtctctactaaaaatataaaaaattagccaagcatggtggcacgagcctgtagtcccagcttgggaggctgatgtaggaggatcacctgagcccaggaagtcaaggctgcagtgagccgtgactaaccactgcactccagcctgggtaatcagagaaagaccctgagggaaaaaaaaaaagaaaaaaaaaagaaacccctaacagtgtaacaatggatgtgtttaatgttagccctagataattcttggggttaccttttcagtttctaaagtctcaacatgaatgcctttcggatacctaaagaaaagaaaaacatagtatcagtagatgagtcaatgacagctaaatcccaaagtattttataagcaactatccagctactaattaagtaagttttattaactacaaaataattatcactacaatggagactttacagcacatttattttataacgtttcagctgctaaatgtttccttacccttgctcttaaacacataaacgtggatttgacttcaaattaattttttttaggacttaggtattttctatttttttttttttttttgagacaagagtctctctctgtcgcccaggctggagggcagtggcgcgatctcggctcactgcaagctccacctccctggttcacgccattctcctgcctcagcttcccaagtagctgggactataggcacctgccaccacacccagctaattttttgtatttttagtagaaacggggtttcaccgtgttagccaggatggtctcgatgtcctgacctcgtgatcctcccgcctgggcctcccaaagtattgggattacaggtgtgagccactgcgcctgaccaggacttaggcactttctaaaatgtcctacatctcaaaatacagtcaactcattaccacagagtcaaatcttgcttccaaatataaaaatgtttcctaactgaaattgtgaaagtctttttattttatttatttatttatttttttgagatggagtctcactctgccactcaggctggagtgccaagccgcaatcttggctcactgcacctctgcctccagggttcaagagatgctcctgcctttgcctcccaagtagctgggattacaggcatgtgccaccatgtccggctaaattttgtatttgtagtagagacggggtttcaccatgttggccaggctggtcttgaactcctgacctcaggtgatctgcccacctcggcctcccaaagtaccaggattacaggagtgagccaccgcgcccggcctgagtctttttagattgcacagggcatataaagaggaggttttagatggccagctctgctgtagttttgcatggtattaacagcttgcatcagccaaggaggagagggatctggaatgcaggtggagtaggctgcaaggacgacatgacaggaaaggagtgtgggcaaactaaacagccctttcctgttgtgttcaaagtatattcccagtatacatgtcactggtagattccaacagaagaacaaggtccccaaagtcaaatggaaatgtccacctgtctatgtcaatgttcaatttctgagttgaagacccacctgcaaacacaaggaaaccaagggaaacatccttggaaaaatacacacacaaaagtctggatgttatttcaggggattcacagacctcctgaaacccatccatagtctcaccctaagttaagaactcttgctttaccaaaagcattcatctgagtatttcctaggtctgaaaaccaaatatttattgtataccccaaaggacaaaaacactaccaatccatagcttaacagatgcaccaaagtgataattattttaagaagccttaaagcatctgttaaaaaacaataacaaaagaaaattaagtgagtattcaacttaagaaagtagggggaacttcatgtagtcaaatcactgagaaccgcagaatttcaaaaaggaaatgagaactaagagattatatttagtctttaaatcctgggtcccccacagagctgctgcatacaatataaatacttacttccagctcaaagtctgataaattagttttctttggaacctataaaaacaaaagaaaaggtattgattttggctcattagaagtaaatccaaactgatcaagcatttgttgagaaggatttcgctttaaaaagagacttcattagaactgataggtaatttgcaaacaaaaatacgcaggttttttgaggtggggggatttcctcatcacttgtcttctaaaattttctttaatattatgctgcttttactgaagaggtagaagttctcgtctaatcaaaatattgcttcctgcagctgcataaagagagcttaaagtagacagatgcattgaaatacttttgtgaaactcctcacaaagtaaaaggaaaaaaagacaatcacgttactgactctttgaaatgctaatgttctctgaatacagagagaaattaaaagggtggaagtagcctgaaagtgaattctttcttctgaagccttcacgtattaagcgcgcctcaaggccaaattaattatgccactcttgggcataactgaaagtcaaggttgcacaacagttttctccgctccaagtacaggacaaagcattcattcagtgtctcagtatacacagtcatccccactgtgtaacgctaaagttagtgtttaattcttgagaacatagcaataataaaaagaccctttataaagctgtttttaaaagactagatgcatcaaatgccacaaaccatctacctttccaaaaaaaggacatgcagaaatgttcaggacaactaacccggtacatggctctaaatccaagttcttgttttcttcactttgtaataaatcctctattttctctctgaggaataagaatagaccataaccatcagtacctttaaggaatgaagtcatcaaccaagaaaataatcacaaccaaaaacagtctaactataagaacatgtgacaatgtaattctaccaaattaccctagaaattttagttcaaagacttttttaaaaatgctttattttgacctaggcatagaatcccagcactttgggaggtcgacgttgggtggatcacttgagcccaggagttcgcgaccagcctgggcaatatactgagagcccctcactacaaaaaataaatcttaaaaattagctgggagtggtgcagtgtaactgtggtcccagctactccagaagcggaggtgggaggatcacctgagcccaggaagttgaggctgcagtgagctgtgatcgcatcactgcactccagccttggcaacagaacgagaccctgtctcaaaaaataaataacataaaataaaaaagctttatttggcgtattttggggggaagagggttactgctgctatttattagtgacaacttctcaaggactcgtcaatacaagtgatttaatttttgactttcccagtaaaatggttacaccaacaactaagctgagcaagaccagacacttgtccaaaatcacatctgcttgtcggcacctttactgcaagcaaagagaacatggacatgctacaggctggataagcctgatccactcctctgccttcaaggacattggacagtggctgtcaggtattcagtccatgcaagttttagaagtcagctgattagcatttaaaaaacaagaaaaggggctggacaatggctcacgcctgtaatcccagcgctctgggaggctgaggcaggaagatcccttgagctcaggagtttgacaccagcctgggaaacatagtgagatccgtctctattaaaaaaaataaaataaaataaaaaatccacgcaggtctgaccacgtactgaaatctcttgcctagtgacatgtagcaagtccaagtacaatacatggaactctatttacaatttgttgctgttacactaatttgaatatgccggctaggcatgctggctcatgcctgtaatctcaacactttgagaggctgaggcgggcagatcacttgaggccaggagttcgagaccagcgtggccaacatggcaaaacctcgtctctactaaaaatataaaaattaggcgggtgtggtggtgcacgcctataatcccagctactctggaggctgaggcacaagaattgcttgaacctaggaggcagaggttgcagtaagccaggattgcaccaatgcactccagcctgggcaaaagagcaagactgtctcaaaaaaaaaaaaaaaaaaattttttttttaatatgccacaattatatcctgccattcacaacatcacacccgtgtgtgtactatgtttgtaaagcacaggtttgagatatagatgcctgtcatccccaatatatagcacacaatgcacgcttagttttaatttaggaacttacaccacttggtcaataaacttcttttgatcctcaggaatcgtgacaggacattttgaagtgttaggagatacataggacagagctcctgcaccattcgcctgtgaacgtttttcatcatactgctctcttaactgtctttcttcttcctgatttaaatatggaattcctaaacacgattttaaaaagaatgcattagcagaagtaactgtctaacataaaatttgtttaacaaaccaaagagtctaaattactcaggaaagatttaccatatttaactacatctcaaaaaatgaacagaaaggcaaatgattttgaaatgtgtttatcattcatccattcattcagtcttctttcaagaaatatttatctggcacttatgctgtgccaaagcattatattaggcactggggaatgaacagtgacaagctgatgcatcctgctctgtagtgaagggaactacttctgacaagaaaatcaggaaagtcagggaaaacccaaaggatgagaataagtcggatacgaaaggagctaggggaagagtccttcgggtaggggaaacaagtattaatacccagaacatggaaatggcttggacggttccaggagcagcaaggagctggtgtggccagatgtcatgagcaaaaatggaatggtacagcatcacattggagagagtatggagcaagattctgcaggccctcacaggccagtgtaagaaatgtacattattctaacagtggctggacaacattagaagattttaagcaagataattaccttacctgcataatgtttcaaaggccatgatgactactctgagagtgaagttaggaaacaagtcaggagcaattgtccaggcaagagacaagagctcagatcagaggtcagcaaactttttctttgttttgttttgttgtgagacagtcttactctgtcacccaggctggcatgcaatggcacaatatgagctcactgcaacctctgcctcccaggttcaagcaattcttctgtctcagcctcccgagtagctggaattacaagcgtgcaccatcacaccaggctaatttttgtattttcggtagagacagggtttcgctatgttggccaggctggtttcgaactccagacctcaccgcctgcctcagccttccaaagtgctgggattacaggcgggagccacggccaccgcgcacggccagcaaactctttcttaaagggctcgatggcaaatgttttaggcttgtgggcaatgggggtctctgtcgcaatactcaaccctgctgttgtggcacaaaagcagccatacacaaaatgtacatgtacgggcatagctgtagtccaacaaatcttatttacaaaacaaggagccagcagtgggctcttgtttgtaaccctggtgtagagatggcagggtagaaggagacagtgattttctagacataagacgtaacacttactgatatcctggagatgaaggataaagggaaaggcaaaatcaagagtaacaccttgcggccgggcatggtggctcacgcctataatccaaccactttgagaggccgaggcgggcggatcacaagttcaaaagatggagaccagcctggccaacatggtgaaaccccgtctctactaaaaatacaaaaattagctgggcatggtggtgtgtgcctgtagtcccagctacttgggaggctaaggcaggagaatcacttgaacacaggaggcagaggttacagtgagccgagatcgtgccaccgcacttcagcctggcgacggtgtgacactgtctcaaaaaaaaataaaaataaaaataaaaaaaacaccttgctatttggttcaagcgattgggaagatggtagggccactaactgatgtgaagacaatgaggggaaaaataggtatcggggtccaaggagtgaaaatcaaaagctaccttttggacatactatttttttttcttttttttctttttagaacgaagtcttgctctgtcacccaggctggagtgcaatggcacgatctcggctcactgcaaccgccacctctcgggttcaggcaattctcccgcctcagcctcccaagttgctgggattacaggcgcccgccaccatacccagctaatttttgtattttagtagagacaaggtttcaacatgttggccaggctgatcttgaactcctgacctcaggtcatctgcccatctcagcctctaaaagtgctgagattacaggcgtgagccaccgcgccctaccacggacatgttaaatcatctaagggaatacacaaattaaaagctgcagttacaagcctatagctcaagagaaaggtgttgagatatacatttagttatcattgggacacgggtggtattaaaatccatggggacggggcgcggtggctcacgcctgtaatcccagaactttgggaggccaaggcgggcagatcacctgaggtcgtgagttcaagaccagcctgaccaacatggagaaaccctgtctctactaaaaatacaaaattagccgggcgtggtggcacatgcctgtaatcccagctactctggaggctgaggcaggagaatcgcttgaacctgggaggcagaggttgcggtgagtcaagattgcaccattccactccagcctgggcaacaagggtgaaactccatctcaaaaaaaaaaaaaaaacaaaacaccatgggaggccgggcgcctggctcatgcctataatcccagcactttgggaggctgaggagggcgcatcacttaagatcaagagtttaagaccagcctgtccaatatggtaaaaccctctctctaccaaaaagtacaaaaatttgccacgcgtggtgccacgcgcctatagtcccaggtactcaggaggctgaggtgggataatcacgtgaatctgggaggtagaggttgcagtgagccaagatcacgccactgcactccagcctggacgacagggtgagacagtctcaaaacaacaataacaacaaagccatgggacactaaggaatttgtagaaagaacaatgaacgtagaaaaccaccatcagtcaacgataattgcttaaagcaagaactatcaatagatgctaaaactaactggcaaaaaaagtggtccacgttaacatcaccagtattgggacaaatgacatcacgtgcctcctggtatgatacacggagaagaatacacatagaggagaagcgggaaggcaacagatagtgaaaaagcaatggaagtcaacagattgctgaaataggtaccagagcaagtgaatcagaagcatgagtagtactctcaaaaaaagaaacattaaaaacactaaaaacaataaatgagaccatgcgtaacaggtcactcctataatcccagagctttagggggtggcggcaggaataccaggagtttgagaccagcctggacaatatagtgagaccctgcctctataaaaaacataaaaattagctggacatgatggtgtgcacctatggttccagctacacggaaggctgaggtgggagaatcacttgggcccaggaggtcaaggctgcagtgagtcatgaatgtgccagtgcactccagcctggtgacaaagcaacatcttgtctcaaaaatgggaaaaaaaaaaaagagtaaatgagaggtgcagtttttgaccctaagacccatgacgctgccattggtatagaggactaaagagagatagaaagatgctgaccacctggtcaagaaacagaccagagcatttgctggttatccttgaggatactaaagtcacccagagaggggcaggagtggagagaattataacacaccaaagccaaggctaagatgcacgctgtgcctacaggagtcagcacagaggggcagcagagctggtgacagcctgaaaatggtggctcccgtacaaaagaaaattcaggggccaggcacggtgatcacacctgtaatcccagctctttgggaggccaaggcaggtggaccatctgaggtcgggagttggagaccagcctggccgacatggagaaactgtctctactaaaaatacaaaattagctgggtgtggtggcacatgcctgtaatcccagctacttgggagggtgaggcaggagaatcacttgaacccaggaggcagaggtggtggtgagctgagatcgcaccattgcactccagcatgggaaagaagagcgaaactgtctcaaaaaaaaaaaaaaaaaaaaaaaaaaaaaaaagaaaagaaaagaaaattcaggtgtctgaaggtggtgtggggaaacaaggaggacacctagcacagcctggccagaggaagacaagagtgagagggaaaaccaccggggatggagaaggctacagggggaaactaacaaggagtcacctggtttccctccagacaaggaaatcaaaaggaacttgagagaagactgccgtaaagaaagggcctgacatttacagagcctgaatggaaagccttgaaaatggagagagatgagggtctaagtcagatttagagcatatcaacaacggcatgggatgaggcttggtagtatggatgacctgggagtcctgactatcgtgactaaaatattccagggcatgactataaaacagaagaaggaggcacattccaatctggctgtttctcttcttttatgggaaaaaaaaaaaaaaacaagttagaactatgcatccatatgagtaccagataaagtggttccttcaagagatgctgccactagtccaatatagtgctctaaatgcatttggaacttatattttataatggctttcagagtcaagtatgagacgaataaaaaaaattctttataatacccaaactgtattgctctgctggttcagtcactatgtgaagcagttttggctcaaaacaagtttgtttttattacctccgaagatcaaaatcagtaaaaattaagatgcagcatcactgaaacaattaaaaaacaatatgggccaggcccggtggctcatgcctgtaatcccagcactttaagaggcaaaggtaagtgaatcacttgaggtcaggagttcaagaccagcccagccaacatagtgaaaccccatcgctactaaaaatacaaaaattaggtgtgcgtggtggcatgtgcctgtggtctcagctactcgggaggctgaggcacgagtatcacttgaacctgttaggtggaggctgcggtgagtcgagatcataccattgcactccagcctgggcgacacagtgagattctgtctcaaaaaaaaaaaaaaaacaccaccaatatggcatgggtactaaacaccttgcaaagaggttctgctgagaataggagaattcatttgaagtccatgtacttttttttgagaaaagttcagttatttttgttgggataaacctccttccctctttcattcattaattctacattcaccatgggggaaaaaaaacaaaatttatgtaaataattaaattaaaatattgaccttgtacatacttaataccactgcaaaaagcacagtctttccaaacacttttagagaaacaaatggagaggaaggaaaaccaatctgaaatgttctaatgtccagtagtcatgcacccatttatgcatcaaatatttggtggtcacctccctgatgtagaagagaaatcatgctatgcaaggggatgtgaaaagaacaagacacaatcccttcctcaggtgctccccaggccatcactctagcaagttagccattatcaatcgtgcagtctctgcacttttcttctcccataagaaactaagaaactgtctccaactactaaaaaagcaacaggtaggcagggtgtggtgtctcatgcctgtaatcccagcaggctgggaggccaaggcaggtggattgttcgaggacaggagtttgggaccagcctgggcaatggcgaaatcccatttctacaaaaaattcgaaaatcagccaggcatgctggtgcacagctgtagttccagctacttgggagggtgaggtgggaggatcatttgagcccaggaggtcaaggctccggtgagctatgattgcaccactgcactcaccctgggtgacagagtgggaccctgtctcaaaaaaaaaattaaaaataattcctgccagcagaggggttataaaaaataaacataaaaaataaaataaacataaacatgcactagctggaaaagagggttttcattacagcatcagtggaatacaggacatttctaaactacatacctcttgttacactggaagaaaacaaggaagcactccccacaggtggtgagttaggccactatatcacgccagtggtagaataaactgcactcgataaaaacaggagtttgaaaggccttatcagagttaaatgaagtagtatctattctgtttagctcatggctgattatgttttttgtttttttttaaaaaaaaaaaaaaaagatcacagtaggccaggcgtggtggctcacacttgtaatcccagcatttttggaggccaaggtgggcagatcacgaggtcaggagatcgagaccatcctggctaacacggtgaaaccctgtctctactaaaaatacaaaaaattagccaggcgtggtggcgggcacctgtagtcccagctactcgggaggctgaggtaggagaatggtgtgaaactgggaggcagagcttgcagtgagccgagatcacaccactgcactccagcctgggcaacagagcgagactcttctcaaaaaaaaaaaaaaaaaaaaaatcacagtaagcaagtttttaaaaattctaaggctgcatatgtgtactggctgcacatgtatgctggaactctaagactgtgtctcagcaggcacaaaataataattctcaaccaagttcagacttacttcccaaggatattttgaaggtttataagctctaaagataggttacccataatcttaccatttcgaaaaactttattaaaatcaaatccctggcttgctagaaagtcaatgctggagctctgaaacagagtaaacagaacacatgttttggggatgttagcggcaggaatataaagagatgcagagaagtaactcaaacaagaaaacaaagacaatatgggaaggaagcgatgtgccagaggtcacaatacaaggaatttctactccacaaacaatccattaacttgcttaaaacatttgggctcttctcctttatagcttacaaaacaaacatcctttgtttcacaattttttttttatagacagggtctcactatgttgcccaggctggtctcaaacttccggactcaagcaatcctcctgcctcggcctcccaaagtgctgggattacagatgtgagtcaccacatccagcctacttcataatattttttaaaaatctactgggtagaccggcacagtggctcatgcctgtaatcccagcactttgggaggcagaggtgggcacatcacttgaggtcagaagttcgagaccggcaggtcagaactttgagaacagcctggtcaacatggtgaaaccctgtctctactaaaaatacaaaaattagccgggtgtgccaggcgcggtggctgacacctgtaatcccagcactttgggaggccaaggcgggtagatcacgaggtcgggagatcaagaccatcctggctaacatggtcaaactccgtctctactaaaaataaaaataaattagccaggcgaggcagcatgtgcctctagtcccagctgctggggaggctgaggcaggagaatggcgtgaacccgagaggtggagcttgcagtgagccgagatcatgccactgccactgcactccagcctgggtgacagagcaagactctgtctcaaaaaaaaaaaaaaaaaattagccaggtgtggtggtgtgtacctgcaatcccagttactcaggaggctgaggcaggaaaatttcttgagtttgggaggtggaggttgcagtgagccgagagagccactgcactccagcccaggcgagagagcaagactgtctcaaaaaaaaaaaaaaaaaatattccactgggcgaacggattattctcccaataggcagaaagctcctgatcgcttgactgttgcagtactgactaggaaactataaatagaactagtatgtattttattaccctgtcccaggttcaagtttaacacaggcacatgcacaggttataagacactgacatccacctcaaattagataatgaaagcccaaaatcttaattaaatgttctcaatgttgaagatcaaaagagaaaccaggcacggtggctcgcacctgtaatcctagcacttagggaggccaaatgaggaagatcgcttgagcccaggagttaaagaccagcttgggcaaaacagtgagatcctatctccacaaaaaatttaaaaattagccaggcatggtagcacatgcctgcagtcccagctacccaggggctgaggtaggaggatcacttaagtatggaaggtgaggaggttgaggctgtagtgggctaccatcatgccactgcactccagcctgagtgacaaagtgagaccttgcctcaaaacaaaaaagatcaaaaggaaagttcccaataataagccttacgaaacaaatatatctcgaacctagcatgagccaaaatatgttcccagatttaaataaaaacattagactgggctggacatggtggctcacacctgtaatcccagcacttccggaggctgaggtggttgcatcgctggagcccaggagtttgtgtgaccagcctgggcaacatggcaagaccccatttcaattaaaaataataataataaaattattttaaaataagtatatattaggctgggtgcagtggctcacacctgtaatcccagcactttaggagatggtgggaggatcgcttgagcccaagacttcgagaccagcctgagtaacatagggagacccatctctacaaaaaatttaaaaattagccaggtgtggtggttcccatctgtagtcccaactatcccacaggctgaggtgggagaatcagaaaatcatttcagcccaggagttcaagtctgcagtgagctgtgatcacaccgctggactccagcgtgggtgacagaacaagtctctgcctcttaaaaaaaaaacaaaaaacaggttgagtgtgatggctcatgcctgtaatcccagcactttcggaggctgaggcaggcggatcaagaggtcaggagttcgagacccgcctgaccaacatggtgaaaccccgtctctactaaaaatacaaaaattagccaggcgtggtggtgcacgcctgtaatcccagctactcagcaggctgaggcaggagaatggtgtgaacccaggaggcagaggttgccatgagccgagatcatgccactgcactccagcctgggtgacagagcaagactctgtctcaaaaaaaaaaaaaaaaaaaaaacactggccgggcacagtggctcatgcctgtaatcccagcactttgggaggcccaggcgggcagattacaaggtcaggagatcgagaccaccctggctaacatggtgaaaccccgtctctactaaaaatacaaaaaattagccaggcgcggtagtgggcacctgtagtcccagctactcgggaggctgaggcaggagaatggtgtgaaccagggaggcggagcttgcagtgagctgagtttgtgccactgcactccagcctgggcgacagagcgagactccatctcaaaaacaaaaaacaaaaaacactgtattaagtgaacaatactatagatgaaacacaagcacggcaaaattatggagttcatactcaaatgaacttaagaaataagcattactgtagctactctaattttattcttggccaagtcagaacatcagcaggctacacatctgaatcattttcatctggtccctttcctgcactgtactttgacattatgccatcagtctagattgaaggacatggtaacaaacagttccattaaacttatcacagtactgacttcagagatgtgattgaagatcaggttttctacagtaatcatttacttataattcaagggtaaatgttctgaggtctctattctggggaaagctatactaatcctgagttctggattgtcctaatcctatggaccacggaatgactgtgtttccctcttttctttgctactaggaagctcagggacaaacaaattacactttctttggcacaaattctgtgttctattcataccatagtgattgtatcatttttcttttctttcaaattttcatttactaattttttaatcttatgttaaaaggtaaataccgtatatatctttaataaccaaaacaaatcgttttgaaatggtgagatataaaaagacaatctgaacacagaaaaacacacaaacaaatagaagcacatgcaaatcacttccatcgtgtccaggcttttatactttacaacaagcaatctttccctacccccacttcttttttaatcctgtcctgaaccaagaaccaagactcaatgtattttgattggtctgtgggcttctgtctaccatggctggagtgttcttataactctgcccacctaaacattccatctctgacaaaggcactgaaacacaaactgtggaaggcatttttgtccttctagtactagacaccaaaacatcctactttcctttatcccactgaattcaaagtcagagtcatctatgcctttcctgaagctgcttattttctaatcaaaacaacactctttgggttgtacaatagtgtcaatgtacttaatgccactgagctatacatttaaatacggttagaatagtaaaatttatgttacatatattttaccacaatttttaagaaaacctctgaacttggccagacacggtggctcacgcctgtaatccgagcactttgggaggcgaggcaggcagatcacgaggtcaagagatcaagactatcctggctaatacggtgaaaaccctgtctctactaaaaatacaaaaaattagctgggcatggtggcagcgcctgtagtcccagctacttgggaggctgaggcaggagaatggcgtgaacacgggaggcagagcttgcagtgagccaagatcgtgccactgcactccagcctgggcgacaggggcttcgtctcaaaaaaaaaaaaaaaaacctttgaactaacaaaaccttttggagtttactagccactacctttgatttgtcataaatgtaacatgttcaagattgaagagatgaggctgggagcagtgtctcacgcctgtaattccagcactttgggaggccaaggcgggtggatcacttgaggtcaggaattcgtgaccagactggccaacatggtgaaactctgtccctactaaaaatacaaaaattagccaggcatggtggcacgcatctgtagacccaactacttgggaggctgaggcagaagaatcacttgaactcgggaggtggaggttacagtgagccaagatagtgccactgcactccagcctgggtgacagagtgagactccgtctcaaaaaaaataaaaagattcaagacatgagaacagatatttgggaggacaatttgagacatccatcaaaactttaaatgcatatatcctatgtctcaacaactctccttctaggaaatctacaatacaaaaaaattcttacacatacaaaaagatatactgaacacagatgttgactatagaattgctgataaccactggaaagcctccaaatttcaattaactgatcaaacaaattatacgtatccatactacgaaataaaagacattctgctgagtggcaagtgcgagttgcataaaatgtgaaattaggattccatatatatatatttgagacggagtctcgctctgtcacccaggctggagcgcagtggcgcgatcttggctcagtgcaagctctgcctctcgggttcacaccattctcctgcctcagcctcccgagtagctgggactacaggcgcccgcccccacgcctggctaattttttttgtatttttagtagagacggggtttcaccgtgttagccaggatggtcttaatctcctgacctcgtgatccgcccgacttggcctcccaaagtgctgggattacaggagtgagtcaccacacccggcccattttttacaatgtaagcctggcgcagtggtacgtgcttgtaatcccagcactttgggaagccaaagtgggcagatcgcttgagcccaggagttcaagacgagccaaggcaacatggtaaaaccttggctctacaaaaaatacaaaaattagctgggcatggtggcatgtgcctgtagttccagctactgaggaggctaaggcaggaggatcacttgagctggtgaggtcaaggctgcagtgagccatgacaacatcactgcactctagccttggtgacagagactctgtctccaaaaaaaaaaaaaagctaatatgtatgtgtgtctaggcatatgtctatatgtatacatgtacataaaagctaggaaaaaaggagtaaaatgggaaggaagtggcatgggaaaaggatataagaagggaaacacagccaggcaccatggctaatacctgtaatcccagcactttgggaggccgaggtgggcagatcacgaggtcaagagatcgagaccatcctggccaacatggtgaaaccccgtctctactaaaaatacaaaaattagctgggcgtgttagcacatgtttgtagtcccagccactccagaggctcaggcaggaggatcgcttgaacccaggaggtggaggtcgtggtgagccaagatcgcaccactgcactccagcctggaaacagagcaaaaccccatctcaaaaacaaaaaaaaagaaaagaaaaaaaaaagaaacacatctggccaggcgcgatggctcacgtctataatcccagcacactggaaggccaaggcgggtggatcacctgaggtcaggagtttgagaccagcctgaccaatatggtgaaacgctgtccccattaaaaatacaaaaattagcagggcgtggtggcaggtgcctgtagtcccagatactcaggaggctgagacaagagaattgcttgaacccaggaggcagaggttgcagtgagccgaaatcacaccactgcactccagcctgggcgacagtgtaaggctccatctcaaaaaaaaaaaaaagaaaagaaacacatctgttactctacatacagcagttatgcttcaatttttcacaaccatatatataaaataccttctatgaattcaactacagatcttcagcctgaaaaaggaagaggaagaaaagaaaaaggagaagacaaaaatgatgtaaatgtcatgctatgctgactgccctactattctacaaacacactcttctgggtgtgagtgtggttctgtcagcccattcctccacatcttgacaagcatatgggagcatctcactgcgcacacagggtcttattttttaaagaacatattaaattgttgtatcctcaaatcctatatgctttaagggtgataagagctttctgagagagattttgacccaattttcaccctacttaataactccagaaactaatgcccttgtatgcaactctgctacaactatagaattttaaataaaacaaaaaccttaaatgagagaccaaagaaaatccaaaaatacattaaccttttcatacaattcccaaatttagagtctaaaccttttctctgcctttgcttttccacactagagaatcccggcatttttattcatctgttttagacattactctctgggctatcttcaagtctatgatagctttttttaaaggagtggctggcaactacaactgtattaagtattccaggtgtacaatcatggtttgtacaatgggtgaagttcctctgatctgtttccaatacatttctcaaaataaccagttttgtcttggttgtttagaacagagtgccatcggccagatgtggtggcttacgcctgtaaccctagcactttgggaggccaaagtgggaggatcacctgaggtcaggagtttgagaccagcccgaccgacatggagaaaccccatctctactaaaaatataaaattagccggtgtggtggtgcatgcctgtaatcccagcactttgggaggccaagatgggaggatcacctgaggtcgggatttcaagaccagcctgaccaacatggaaaaaccctatctctactaaaaatataaaataagccggcgtgatggtgcatgcctgtaataacagctactcaggaggctgacgcaggagaatcacttaaacccggggctttagcctgggcaacaagagcgaaactccatctcaaaaaaaaaagaacaaagtgccatccccaaggtgtctcattgccaccctctgcttttgtttgattaacccctggccaaagccatggaacccactttaaataattctgtgttgctggtactgctagaaaactatatccacacaaatttcccaactgagcctacttttccctcaatgaaaatttaccaaaaaaaaaacaaaacaaaacaaaactgtaaggccgggtgcggtggctcagcactttgggaggccaagccgggcagatcacctggggtcgagagttcgagaccagcctgatcaacatggagaagcctcacctctaccaaaaatacaaaattagctgagcatcttggtgcatgcctgtaatcccagctactcgggaggctgaggcaggagaatcgcttccacccaggaggcagaggttacagtgagcctagatcatgccatcacactctagcctggacaagaagagcgaaacttcatctcaagaaaaaaaagaaaagaaaatttataaatactctttaagtatcccataccacggtgattgacaaatagctattaactgattgcagggtaaaggtaaaatgtcaactggtttacttgctaatttaggaaactgtctataagaccagaatttaaccttcaccttttctcttttgcccataagcatatgattaactctcgatttcatttgtttatatactgccagttttgagaaagaatttgacataactcaatcacttgaagcctaccctcgaggctttcataactgcattaccattaatctgcaagagaagggaaagatggcaagactcaaatgaattcatgtttttagtgggagagaagataggatgcaagattttaagggagaaaagattaagacttatctttaatcacatagccacacaaccataccccttactcacattctccttatccattacaacagataatcaaaagagcagaaaggaaacagtgatatttactgagtgtctaccaggtcagctacaacacctctagagggaatatcctgaaggagaacctccctaatattgacccatcaattaagctctcttctcctcaagagaaacagtagtttttttttctacccccctttcctaattagtgagcttgagaaaaggaagtcagcataaatacttgaaccccttctgcgctttctctttttgcataggatacacacatactctgcttttccagaaaataaaggtctacaccctcagagtggatgcgaggagaatgagtgaggatagggagaagcctccaagtcttttgtttattttaatttttattttaaaatagagatgaggtttcactattttatgcccaggctggtctcagactcctgagctcaagtgattctcccgtcttggcctccaaaactgctaggattacaggtgtaaaccaccacatccagccaagaagcctgcaagtcttgatgtgtaggtggttcaacttgggggtaaaataataaaaatcccaaatggagttacgaaactatgttctcaaattcagctttagaattactaaacctcatgttctcatatctgtctgtctgtctctgcatcttattccttaattcattcttttttttttttttgagccagagtctcgctctgttgcccaagctggagtgcaggggcgtgatctcggctcactgcaacctccacctcccaggttcacgccattctcctgcctcagcctccctaagtagctgggattacaggcacccatgaccacactcggcaaatttttttttttgtatttttagtagagacagggtttcaccatgttagccaggatggtctcgatctcctgacctcatgatccgccctccccggcctcccaaagtgctgggattataggcatgagccgccgtacctggccctccttaattcattctacagcaaaggaggagataacagggtcatgaatttattaccctaaaactgaaggtcaaaggtgaaatgatttgccccaaagcccaaagttaatagagaaccaaattctgatttcacatttccatgctgcctcatcagcaattcagaaaagaaaaatctcaattatgctacttacctgacaaacaaatttgacatctggtgaggatctattgaagggtttcgggaaaacatagaagttaaatgacttcgttatatacctgggataagataaaaggagacttaggaggtgacattgtgccacaaaaacggaattcccaacgtttgttaacacaacctactttgaatctgtgtagtcatacttaaaagtgcaaaggccaaactgaaatagcaaaaagtccatggaatgctggaaaagggaaataaaacatctgtcacaaaagtgctgcatattccatgtgagcatagcattctcaaacaggtgggctttctgaattactcaatgagacttcagcagaatacttccaattagaacagattacacatatgaatcagaagcattattaatttgtatacatttcataatacttttcccatttaaggacctatttatccatcatccaaagaatcatattaggtctatttccaaatgattaaaataactgcctcatatttcctatgaatcaaattaacactgaaaatgctaaactttccccaaaatattttccagcaaacaattatttttgctgttttaaatatcattaaaataacactttaaggccaggtgtggtggctcacacctgtaatcccagcactttgggaggctaaagcaggaggatcatttgacgccagaagttcgagaccagcctggtcaacaaagtgagaccgatctctacaaaagaatatgtaaaaattaaaaaaaataataataattggctgggcacagtggcttgcgcctgtagtcccaactacttgggaggctgtggcaggagaatcagttgagccaggagttcaaggctccacagagcagtgatcacgccactgcaccccagcctgggtgacagagcgagaccttgtctctaaaacaagacaaaacaaaaaaaaaaatcacttcatggctaggtttgaggagaaaatactgcacttacaaaaccttaatgcacaagtttagtaacaatatttatcatttaacataaggaagactaacatgagaaagaaaaagatttcctagcacatccacttgcctttttaagcttctgatacctctcttctggagtgtcaaaaccatttgttaatgcagagactgaaggtccatcactgattcctagattttaagaaataaaaatttttagcttactaataaatactaacgtaaaaatgccagtcaatcattcagtgcctctataatgtcgtatcacgaattaaggttacttggaagcactccctaacttacttttttaaaataagcattaatttcagtggccaccaggttaaaccctctaataatgaacttagagatgcgaatgtttcaacatgagaataggcagttccagcgtctaaaacatgacttaaaacacagtaatcatgtaagaaaacaatctctatgcttgaataagttttgctgctttaaaagattcctgtataaacagacatcaataaatccctaagtatattattgccagagttccagtcttggtcaagagtttggagtggttaatatctatgcaaagaatgtatcttcaagattaagagaaaattatttctctaagtgaaaactcttagcttcctagggaagtgattccaactagacactacctaaagccaaggatactatttacccctgcatggattccttcatgattcaaacatggaaaatcagacagcaaaaatggatatccatatcaaagggagtgaaccgttcatattgacatcagcaatttaaaaactagtctttgctccccctaaaaaaggggaaaaaaaatttgcaactttaagtgtcagtgaagtatttcctgtatacacacctgttgaggcaggcaatgaacacgtccactaatgcataaagaaatatctcatttatctgcaaaaacctgaccctagccggtcacaaaagggcaaatattgtaagattccacttatatgagatgttaagggcagtcaaattcagagacaaatggcggttgctaaaggctgggcgaaaggagaaatggggagtttaatgtgtaaagagtttcagactgtgaagatgaagaagtcctagagatggatggtgatgtttgcacagcaatgtgaatgtacttaatgccacttaactgtaaagccacttaaaatggcaaatttcatgttatacctattttacaatcaagaaaaaaaacagtctgaccctaatcctcaagctctctgcaatgtacacgccgcactgttttaagcagcatcaaaaccatcatctctatctgagatcctgagtccaatcacaaacctacggcgtatcttcatttctttcgtgcttttgaaacgtttaaagggtaacactgagacctgtgaaacccgcccaaggctactaacagcaagaggccaccaccaagcataagaagttgggggctgggggattgaaggagccttggctatgcactgcaaagtgctagcctgagcttgcaagggagggatacctgaaaactccccatcgatggcgaagaagtcggcctcctctatggcctggtacactttgtgaagattactcttaaaatctgcggagaaaccgaaaagaggctcagaaccagtggcctgaattcctgctaaggggagagggaaggagggccgaggagctcccgaggctgagagccggaaggggaaaagtcccggaggtgtgcaccggggcgaggggaatcaagtcctcgaggggtgcatgggtcaggggggacaagccccggggggtgcccggcccggagaaggacaaggccccggatggtgccggggttggaggagtaagtacaaggctcctagggtgcacggtccgcagccggaaaagaccccaagaggcgcaccggcttaaggagggaaaagccctgaggggctgcctcagccccaggcccagccaaacacgccggccatggtctcggcctagcaggccaggggcagccgggtgtggggaggcggggaggtgtacggcggacacgcactgctcctgattatctccattctgcagagtggccggaaccttggccccacccgggcccgcgcccgcctcagcggttctactcgccgaattccgcggcgactgcggcagtagctgaggcagccgcagcggtgacgccggccgcgacttccggaaacagcgcgcgcct

SEQ ID NO: 2665 - DNA, 194572 bp, Homo sapiens; identical to SEQ ID NO: 2664
  source 1..194572: mol_type = genomic DNA

SEQ ID NO: 2666 - DNA, 194572 bp, Homo sapiens; identical to SEQ ID NO: 2664
  source 1..194572: mol_type = genomic DNA

SEQ ID NO: 2667 - DNA, 441423 bp, Homo sapiens
  source 1..441423: mol_type = genomic DNA
ggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaaggtgaggagcaacggggcctcgcgggtccgggcttcactgggcttctagccgtgccgcctctgggcggctggcgccgggagagcgctggctgggtccggctgcccccgcgccccggttccgcatcagctacaccgcttgctttcctccctcccggagttcgcgtggcagcgggctcaggaggcatccctcgttgcagctgttcctcgcggggatcctgcggagcagagaggcctagggcagaggcagttgggtgcccgcacgccctccgaggcggctgatggctttgggcaggcatattgctcgaggtctgcttccagggccccgcggcattggctttgtcttaagctttccagggtgtctttttaggtgtccttatagtttccgtgttctgttgcctctttccagcatttttgaagggacactgtgaactgttgcttaagtagtgttagggttgtgagtttgtcttatcttttaaagtattataccatgtcaggactgccaatagattttacgtttcatttgaaagcctgttttaattgtatgacaccccagtctactgtgtaccaaatgcatcccgtgaacttactttccttttcggtatagtggtgagcctgattttggcactgttctaaacacatttcatgactgttctgtatacctaggctgtcatgatggcagattgacaaacaggttggagtgcttgtgtgtgcttctgagctctgtctccagtcaatgtcgagtctgtcgttaattctggggcacagaccacctaacctactttataaggtttgttgaggcacttgaacacattctttaaaatgaaggtcccctgaaaaccatctgtcagctggttcagtgtgcttgttaaacttccttttaaaaaataattattaaaacattgccacataacttgatttatagtcatttaattttagacgttgaagacactttagagacgacctgccccatcctactctttaaagaggagggaaccgagccccaggtgggcagtatgagagctggagcttatcgacatggaagtgagtggcacctatgtttgttttgtgtccaattcagcgtgcggactttcactgttttctgtgttcccatacagtttagtgttctttaatctttatcattctgttcatctgtgttggccacttcaattgcagctgtaagacttatgcatttacataggaggcaagttagtatggtgtaaagtgtgggctttggggtcaggcgcatgaggctttgtatattggacaggtctcttccttgggcgtcagcttcgtccttgtagctatttttttcaacaaatatttactgaatatctcctgtcttccacttctggggaatgaatatggtttctgctttcttagaaattttactctagtagggagactgtaacaagtgtaaaatggtattaggggagatgcccgggtgctataagaaaataaaatagagggatttgaccaagccaagattttgaattctgtgttctagatactgttctgttgctttgcttgaactaatttattcaatctcacaacagtcgtatgtcccccatttacagaagatgaaagtgaggcactgagtgttaatgtgacttgctcgaagctatagtgccaataagtggcaaacaggatttagaactccagaacctgtgctcttaatcatactatgctatctacggtaagggagtgttttcctttggaactgaaaattgagacaagttttgaaggatgaagtgaccttttctaacaaacagagatgaatgttataggtgagagagcagtgtatgcaaaggtcctgtggccagagggaatgacaggttagaagaactgaaaaaagcctacagaggctctgatgcagagagtagatggtgttggggaagctggcaggagtcagaccatctggctcttatagatcacattatgaggtttggtgtttgtcttagagcagtgggaagacattgatgttggaggtgggagggatgacactgacattttagattggagaggctgagaggaaggctgttactgtacttactgttgtacacttgttatacacttactgtgtaatacatacgctttgatgattcttacctggttttttccttttaatgtgttggcagagactgcatcttgtctatttctgtgttcttagtacaatgtttgacacaataggtgctgaatgtgtaacaatagagtagcattatgtttgtgccggtaaagaattcctccttggggtgggaagcatctctgaagttcactatcactctaggggaacttgagctgctgcttagcttctctctgcgcttctcttctatgaacttgaaatatgctctactgagtctgtttgaagctgaatcttttgaagattttaacccctcccatccctccctccacctctgcaaaccttttggttggttgaaaagcagccagctaactctagggtctagtctagagaattctgaccattcttttagccagtcaacagagtttatttatttttagggtatatgtagagttcaccttttagtcttatttgttttgtgtatcagctttttaagcacattctgttttaatgcctagttttttcttctgcgtaaatgttttcagtggctctaggatgttggttttatggtaattgctatagttattattgaactcttatatgccttgcatgatttttctttgcttttctttttttttgagatggggtctcgctctgttgccaggctggagtgcagtggcgcgatctcagctcactgtaacctccacctcctgggttcaagtgattcccttgcctcagcctcccaagtggctgggactacaggcgcacgccaccaccaccggctaatttttttttgtattttagtagagatggggtttcaccatgttggccacctcgatcttctgacctcttgatccactgccttggcctcccaaagtgcttggaattacaggcatgagccaccgagcccaatggtgtgatttttcatatatcttttatccttataacaactaggtaaaaaatcccaattttacagtagaggaaacaaagctcagggcagttaagtagttgcttaaaagcacaattggctgaagtagaatttgaaccttagataatatgattctgaaggctttcttttctttcttccttttttttttttgagatggggtctggctctgttggccaggctggagtgcagtggcatgatcttggcctactgcagcctctgcctcctgggctcaagccatcctcccatctcagcctcccaagtaggtgggaccacaggcacgtacgaccacacctggctattttttaattttaatttttattttttgtagagatggggttttgctatgttgcccaggctggtctcaaactcctgaactcaagcaatccacccacctcagcttgcttttctaattacaaattgtctcatttgaatcatggtctcattgtgtgatgcattcatgaaatttgaatgtttaagccctgtgttacttgacatccattattttcttttgtaatcagtaaatatggaaaagaatgtttaggcttatatgaatgctttagaattgcctggaggttaatgtttccaacatgctgataaatttctgacaaatcatttgggaaaagaaatttctgagattattacagaaactagtttctggtgtaaaaaaatgtttatagacatttatatatttatacatctaccatttggattttattctgttcctgagaggttcagaacagaggtaaaaactgctctagtccttttctaagaggaaaagatgtgacatttttgatgaagagtgagggaaaaggatttgtttaaatgattccaaactttaaaaaatgtaggtgggagaacaaggatgaaaaaggaatttgggaagaaacacttttttggtggggctggaaacatagtgtttcattgtaggtatctggagttagatgcccgcaggagccatgctgaggtgctgggtatcagtggctggcttttgggccagggatacgaggctagagttagagttagaactgtgagccctgacggatatagtgagtcagttaatatttaattgaataaatgcttcgttttataaccctaaattaggatttggaagaaggaagaagagacaagaggagttagaggtatggtttgagaggagccaatgtagtgtagtgttaccaaacctaggaaagaaatttcaagaagtagttagcattcattcattcatttgtctagagatctagctctttactcagaaagtgtttgtggagcattttctaagttccaggtactatggcacgtacagaggagagaaaaagaaattaaaacatattccctaactatgtcccaggtgcagagaggctaaggaataaaagattgatgaggccaggtgtggtagctcacgcctgcaatctcaaccctttgggaggccaaagtgggaggatttcttgagctcaggagtttgagaccagcctaggcaacataatgataccacccccacccccggctatctctacaaaataaaataaaataaaataaaaattagctgggtgtggtggcacgtgcctgtggttctaggtacttgggaggctgaggagggaggatcacttgagcccaggaggtcaaggctgcagtgagctgtgatcacaccaatgtactacagcctgggtgacacagcaagaccctgtctcaaaaaaaagtctgggcacgatggctcatgcctgtaatcccagcactttgggaggccgaggcaggcagatcacctgaggtcgggagttcaagaccagcctgaccaacatggagaaatcccgtctctactaaaaatacaaaattagccgggcatggtggcgcatgcctgtaatctcagctacttgggaggctgaggcaggagaatcacttgaacccaggaggtggaggttgcagtgagccgagattgcaccactgcactccagcctgggcaacaagagcgaaaatctgtctcaaaaaaaaaaaaaaaaaaaaaagattggtgaaagaatttgaaaagatctttgatctttaatgagaataattttagtagcatggtaaagtgttatatacaaaaaatactgcttttgacaacactcttgaatagttgaagcaaaattatattttttgaaagataagcatattgcataactttcaaaaattagtttctttattttaaatgcctattgacattttcgttagaaaaaaccccacaaactgatgggatcaacctaataagatcaaaataaaagtgaatttaaagaatgttggaagatacagttttgtgatttcattcacaaaacctaatacagcatccatgtggcatactctctttggtattgtttgtttgtttttgagatagagtctcatgttgtccaggctggagttcagtggtgtgatctccgctcacggcaacctccgcctccggggttcaagtgattctcctgcctcagcctcctgagtagctgggattacaggcatgtgccaccatgcccagctaatttttatatttttagtagagacggggtttcaccatgtcggcctggctggtcttgaactcttgacctcaattgatccgcctgcctcggcctcccaaagtgctgggattacagatgtgagccaccgtgcctgccctctctttggtattatttattcaagaaacctttggtttcctagagctgctgtacaaatgaccatggacctggtggcttaaaacaacaaattcattctcccacagtactaaaggcctgaagtctgaaatcaaggcatgagcagggccatgcttcgcctgaaggctctaggggagaatcctttcttgcctctttgagcttctggtggctgcattcattccttggcttgtggctgcatcactccagtctctgcctctgtcttcacatggctgccttctcctcctccttcttgtgcgtctttccctctcattcttttataaagacacttttcattggatttagggccatgacaagatctaggatgatttcatctcaagatccttcactttgttgtattggcaaagacactttatcacaggttccaggacgtggacacatcattttaggggctatcgttcaattcacctacacgtagtatgtgtcagacactacttagagctgggaatataattgtgactgtttctgctcccattgtggttacatttgagtaaggagactgtgctcgtataaatagaaaagttcagagagtgagaagtgctctcgaaggaaaaagataggttaatgggatagagagtggtagtggtgctgagttggggatgttacctaatgagaccatgggggacatttctgagcatgtggcatttggacaggaaactgagccagccagccatgtgactatatgggggcctagcattgcagaccaaggagtgccagggcaaaagctctgaggggagattgcatttggcataattaagggatgaatgtggctgctgtggttggagtgaactgaatgagggggtgatcttaggagatgagggaggaggagtgggtaggcgggacagagtcatcaggggcttgtatttggaatttagtaatgagagtccagttggaggcatttaagcacattgaatttatgtttggaaaagacgtttgtgactagtacgtagcgaatgtcttagtaggggtgggagtaggattggggactggggtgggaagagtggaaacagagagacccatcaggaagctgttgtagaagaccaagctagagatgatggtaacttgtgctagggcactggagttgctgagaactggtcagacttggaatgtattttggagctagagccagtatcttgctgtggggtttgaaggcagatacagatgtacctcatatcttggctttattgaccctgcagatactgctttttttttgttgtttttacagattgagggtttgtggcaaccctgctttgagcaactgtattggtgtcatctttccaatagcacatacttacttggtgtctctgtgaaacattttgataattttttcattattactatgtctgttatggtgatctgtgatcagtgatcttcgatattcttattgtaaatattttggggtgccgtgaaccacgcccatataagttggagaaacataattgataaatgtgtgagttttgacttctccaagcagttattcccctatgtctctccctctcctcaggcttccctaattctctgagatacaacaatattgaaattaggccaattaataatcttctaagcgttctagtgaaaggaagagtcacacatctctcactttgaatcaaaaactagaaatcattaagcttagtgaggaaggcctgtcaaaagccaagatagactgaaagttgggcctcttgtgccaaattgtaaatgcaaaggaaaagttctggaaggaaattagaagtgctactccagtgagcgcacaactgattaaaaaaagtgaaacagctttattgctgatatggcgaaagctttagtggtttggatagaagatcaaaccagccacaacatttccttaagccatagcctaatccagcgcaaggtcctcgcttcagttctgcgaaggctgagagaggtgaggatgctgcagaagaaaacttggaagcagaggttggttcatggggtttaagaaaagaagtgaggccgggcgcagtggttcacacctgtaatcccagtactttgggaggccgaggcgagtggatcacaaggtcaagagattgagaccattctggctaacatggtgaaggatcagatgattgttagcatttttgagcaataactgttttgaacaataattaattggacctgaacctacagtatctgtaaggtatgtacaaacagggaaaggaaggaattaagagtgacttttgaagggtagacacacaaggtcgctattgtgtgattttgtgtttatatgcagtctccagaatagactgatccatgaagacagaaagtagattagtggttgcccagggcctggaggagaggggatgggagtgactgcgaatagttaagggttgtctttttggggtgataaaaaatgtcctggaatcagtagccatcatggttccatgccttgtggatatactaaaaaccacggagttgtatacttttttaaaagggtgaattttatggtatgtgaattacatctcaattaaaaaataaaagaatggtccgggtgcagtggctcacacctgtaatcccagcactttgggaggccgaggcaggtggatcacctgaggtcgggagttcgagaccagcctgaccaacatgaagaaaccccatctctactaaaaatacaaaattagccaggcatggtggcacatgcctgtaatcccagctactcgggaggctgagacgggagaattgcttgaacctgggaggcagaggttgcagtgagccaagatggcaccactgcactccagcctggcgacagagtgagactccgtctcaaaaaacaaacaaacacaaatcttcgaatacttatgttaacaaagtaaagcaaagaggccaaggtgggaggatcacttgaggccagcagttcaagaccagcctggggaaaatagtgagaaccccccagccgcccagtctctacaaaaaataaaaaaattagtggggcatggtgacatgcatccatagtcccagctattcaggaggctgaggtgggaggattgcttgaatgcaggagttcaaggctgcagtgagctatgatcctatcactacacttcagtctgggcaacatagtgagatcctgtctcaaaaaaaaaaagtacaatgaagctaggtgtggtggcagggatgtgtagtctcagctacttaggaggctgaggtgggaagatcatttaagcctaggagttagaggctgccatgggctataattgtgcctgtgagtagtcactgcagtccagcctgggcaaacatagtgagacccccatctcttaaaaaaacaaaaaaagtaaaataaggtgaaattaatatattttacttaatatattcaaatattcaaagtattatttgaatatgtaaatgtaaaaattcactaatgaggtcttttacattttctgggtactaagttttcaaaatccagtgtgtagtttactcttagagcacatctgaatgtggctcgtggctgccatattggatggaacagctctagggcacagattgtgctactaatcaagtcccaccttgaggtgctgggactggccttttgaatgcagtgttagtcagcccttggccaggcagggtcgggggagctctcaggcttgatggagagctgtatagttgaggaacatggtcgagatgagggtgcaggtgtgagccgttagttgtcaacacagcagttagagaggatctgagtggccactgacaacatctgctacagcgggatggggaagaatggcctggcggaagagtcaagggtgggatgatggagctctagagttgacatgtatagtttcctggtgcttgagcttagtacagaggcagagcccagagaatcttgagtcttgaacatctctctcaaatattaggtgttcaacttggcttttggcagacactgaagattggaatggtctctaagatcctgaagactaaatagtctatttgaaagaaaagctgtgcttccaggaaaaagccagacctaattaagtgtcttcagagaagggcatgggctctgttacaatgcatgatgaaataccgtgtcataatacatggataagaccttcacctggaattttagagatgaagcaagatgaagtaaactaatgtttactttgaccttggtgagatcattttatagctccattaacccagttttgaggatagtttcttctttgaagcagaatgcattctgataatgaatttatctcataatgagttatttagtattattcatctgaatgctactgcgggtatgttaacaacagtagttttggttttggcagaaatagtgttcagattgttctttaagatatttgccagtggatttaccagttttaactgccacgtgaggccacatcttgcttatgaaagtaggtgctatctaatcttttttttttttttttttttgagatggagtcttgctctgtcacccagactggagtgcagtggcgtgatctcggctcactacaacctctgcctcccgggttcacgccattctcccgcctcagtctcccgagtagctgggactacaggcgcctgccaccacacccggctaattttttgtatttttcgtagagacagggtttcactgtgttagccaggatggtctcaatctcctgaccttgtgatccacctgcctcggcctctcaaagtgctgggattacaggcgtgagccactgtgcccagctggtgctatctaatcttaagaaaggatttttttccagccactgcaaacaggatttgtttccctgtttgcagtggctggaaggcatgcatccagtttgtctaaaagcctaccatttcccccgctttttgtgtaagttattgtgtgctgatgataatatatgcaagactgtgctagccatgttagacattctcatttaatcctcatagcagcattatgacctagataagtactattattatccccagtgtacaaatgaagaaactttctatatatctaggaaatgtcagagccaagatttgaatccaggtcagaatctgagtctagaccagaactcttattgactatattattctctaatggtaattcccaagtggttctggtataattttaagaaagaaggtgacagttacatatttggatttagttttcatgtaaaaccttacattttttggcactttactgtttataaaaactcatttgatccttttaataactccctaggaaatcagggaggtgtcatcacctacattttgtagatggaaacgggggcccagagaaatgattagctcaatgactcacagctgagagttgacccaagtcttgtgactctgagggtcaatgccacttcctatgtgccaagccattttcaggcatttcttttctatgtgtggaaaatacaggaaatcattattcctgtgggagagaaccagtggcaatatgttactggggagtcattttgcacacgctgacctctctcattttggctgtgattggctagcctttataaacagaattgattaaagttctttctcagaacctttgttgctaggaaataccttacaaagaattttggactgggcgtgtagccagtttgttacatgcttaacaaaaacaacaaacgttaaaattctgtgtagaggtccaaattagcagacttcttcaaacgttttccttcatttagaaaataaactttatgttgtggctttacacaaatggtctgagtgttgacctgattcttcatttttgaccttccatgaatgtctcccaggaggaaacaggaacagagcctttatggggctcattccaaaccagttcagacttgtcgtgggaatggttcacattggtagttgttctgttatagttgtgtttgcttgtacgagttctacttcttcttttttttttttttgttgagacagtgtttcgctctttttgcccaggctggagtgcaacggtacaaacttggctcactgcaacctcggctcactgcaacctccgcctcccgggttcaagcgattctcctgcctcagccatccgagtagctgggattacgggcatgcaccaccatgcccagctaattttgtatttttagtagagatggggtttctccatgttggtcaggctggtctcgaactcccaacctcaagtgatctgcccgcctcagcctcccaaagtgttgggattacaggcatgagccaccgtgcccggcccgagttctacttctagttactgggtaaccgggaggcatctatgctttttacagctttaggccacattattacaagttcacatgtgtgcaagctctgtggaacaatatcatatctttgagtagatattagtgtttatctgggaattgccactgtttttcttatctagaaataaaaaatttcagaaagctcttgaccaatctgtggttaaatcttataaccattacagcctcagcctgtgacctttgaaaagttaaagtccttgggactcaactttgtcataaaattggggataatactcttgtaactcacagttatgcttgaaggaatatatgagagatagtcttgatctttaatagggacacagtaataatttcccgttcacagttccttcttgttcttggtcttttacttggtaaaggttttattttataaactatatctttttgtatcttttacctccacttttatacagagattacattttttaaattaattaaataattaattaattttttctgaggagtttcgctcttgttgcccaggctggagtgcaatggcaggatctaggctcacagcaacctccacctcctgggttcaagcaattctacctcagcctcctgagtagctgggactacaggtgtgtgccaccatgccccgctaatttttttgtgtgtgtttttagtagagacgggatttcgccattttggccagtctggtcgcaaactcctgacctcaggtgatccacctgccttgacctcccaaagtgctaggattacaggcatgagccatggtgcccgactctttaaaaaatagttgtacaaatttttcagttcatttaaaaatgttgctataagaacattttgtttcttatttgagtcgttatcatcttagaaagttctaagaggtggtacctgttggttgccttttgctggtttttttcctccatttttttccttctagctttaacagtgactactgggaagttctctctctgtctctgtctgtctctctgtatctctctatctcttttctttttctcctttcttttctctcttttcagtggggtcttgctctgttgcctaggctggagtacagtggtgtgatcttggctcactgccacctcaaactctggggctcaagtaatactcccacctctgcctcctgagtagctgggattccaggctgtaccaccgtgcctggcttagtcacttttcttaatgtttttaagcattaagatacgctttcttcacaaacagttcaatgaatgagaaatatccttgattactgatattgctttttcatatttatcagccaaaccacttctgtaccagaaaatgtgaaataagaaatcatgctgaagacatcagcaaatataaaaagaatattttattatgttctggccactgttaaatttgaagctccttgagaccaagactctcgttttgtgtttttaaaagttctgtgtggtctgtgacatttctgaccctgctctatccttttgaatgatcagaaaggctttcttcaaatttgcttggcccctcgacaattcttgttttgcttttctggagatcgttttgatgcttttggtttctcttacataccaaggggctgtgtctgtagatatgatttcccttttgtaattatatttatggtatattgcctagaactacatttattgatcagacacgttcgctagaacctaactggaagaaatatcctgaaaaaatgttctaaagcccatcaagtatttgcaatttattttgctttcctttttttgtagcatgttctgtactattcaagacagtgcttaatggtgtcccgtaatcttggttcagtgggatatgatcctaatgaaaaagtaagtatttaaaagatattctcaacaactaaattaaacttatcatggttttactttctcgtctccacactgtgttcagtggacagatgagattttgttaaggctgtgtggtcattgatcactctagcattgtgtgtttctataggtgctcagtctttaggtattctgtttttcattgtgggccacagtctgaatctttttaattttgtatttatatctttagcaaaaattgaatgcatttacaatgtgtttcctttgtttccagcagaataactaagaaaacatttgttcttaaagactgggcatttgagagatttaattaaactattgagtttttctttcatttacttaatacttttttttttttttgagatggagtcatgctctatcacccaggctggagtgcagtggtgtgatctaggctcactgcaacctacgcctctggggttcaaacaattctcccacctcagcctcctgagtagctgggattacaggcgcccaccactgcacctggctaacatttatatttttagtagagatggggtttcaccatgttggccaggatggtctcgaactcctgacctcaggtgatccacctgcctcagcctcccaaagtgctgggatttcaggcatgagccaccgtgcacctggcctcatttacttaatatttatattatttatttatttatttgtgagatggagtcttgctcttttgcccaggctggagtacagtggtgtgatcttagctcactgcaacctccgcctcccggcttcaagagattctcctgtctcagcctcctgagtagctgggattacaggtgcgccccaccacgcccgtctaatttttgtgtttgtagtagagacagggtttcaccatgttggccaggctggtctcaaactcctgacctcaggtcatccgcctgcctcgagctcccaaagtgctgggattacaggcgtgagccactgtgcccggcctatatgattcatttagattgaaggtaattttgtgtattataaatttcaggacaaggggtttctaattaaaatgctattacaataatgtttgagccttgtagggactagaagaagtgattggaaataaaatatggtttcatgccttcatggcaatgaaggcatcgaagtgggcgggagttttggttaagaagggattgttcaaggtgagtgtcatcaaaatacaactgacaggaatgattatttgagaatgacatgtctgaggtatcttctgaatcatgtgctgaagtgcgcaatactgctttccagattcttttgaatctggaggcctggaggaagaaagagtctacatatcttcagttcagtagaaatacaatgtgaaacacagttgcagggtgatatggtttggctctgtccccatccaaatctcatctcgacctgtaatccccatgtgttgagggagggaggtgattggatcatgggggcagtttcttccatgtttttctcatgacagtgagttggttctcacaggatcttaagatcttacaagtgtttggaagttcctcctttgcactactctcccctgctgccttgtgaagaagggtcctgctttccttctgccatgattgtaagtttcctgaagtctccccagccatgcggaactgggagtcaattaaacctttgtttataaattacctagtcttgggtagtatcttcatagcaatgtaaaaaccaattaatacacagggcaaatgtgattttcaattttcctttttattttttatttttgagatggagtcttgctctgtcacccaggctgtagtgcagtggtgtgatcttggctcactgcaacctccacctcccaggttcaagcaattctcttgcctcagcctcccgagtagctgggattacaggtgtacgtcaccatgcccggctaatttttgtatttttagtagagacagggtttcaccatgttgggcaggctggtctcgaactcctgacctcaaatgtcttcctgcctcagcctcccaaagtgttgggattacaggcatgagccactgcacttggccaattttcaattttctaatagccacattaaaaaaaagtaaacaggcaaaattaataatatctcaatatctaaaatgttatttaagtacataatcagtataaaaagtattaacaagacaccttagattcttttttttgggccctaagtcttctaaatccagtgtatattttatacctctggcatatctcagtttgattagccacatttgaagagcccaataacctcatgtggccagtggctactatattggatagtgcaggtctattgaattagttatgataaactccctgttatgaaagctgtagtttaatttaaaatcttcatcataggtgatatgctttggggttcatgtatccatgtgttgcattccaatctcgaagtaatcagctatcctaagtggctacactcttaagagtaattaactaacatttgttgaagaggacacattatagaggggtggaatactacaaacggttcagccatctttctccttatacactggtagccttcctcattagcgtaataactgttagaagtgggctatcagccaggtgtgatggcccacgcctgtaatcccagcactttgggagtttgaggccagtggattgcttgaggtcaggaacttgagaccagcctggcgaaaccctgtctctaccaaaaaaaaaaaaaaaaaaaaaacaccccacaaaaattagctgggtgtggtggcgtgcaccagtagttccagctacacaggaagctaagttgggaggatcacttgagcccaggaggtcagggcttcagtgagccatgattgcaccactgtactccagactgctaggctaaagggcaagatcctgtctcaaaaaaaaaaaaaaaaaaaaaaaaaaaaaaaaagaaaagaaaaggaaaaaaagaaacgggctgtcattgaggaagtttgtggtattcgtcaatatatgttattggctattgctttagggaaattctgtgcctttgtactattagaatgtaataatgtagttggcctttaattctttacctttaaggataatactcgggcccgatccctaaatgaatagttctgtgttcagccacttgtctggtggattcttgatggcttagtctgacagtatggttagccaaagcagaatattgtttttttttgcctatggtgagcctttcttgcagtcttttggagccttacaaagtacaggaagttaagattccactgaacttatcaagcaggttttatgattctttttatgtcttaataaatgtttgtatgtgtggacagagtttggtctggtacttgctttcattataacctcatagtgaagttacagaaatagctaactgacctcccacattggtgaccactggtaattactaaaaataaataaatgtatgtaactgtctgggtttagcacatttatttatttatttttgagacagagtctcgctctgtcacccaggctggagtgcagtggcatgatcttggctcactgcaacctccaccttccgagttcaagcgattctcctgcctcagcctcccgagtagctgggattacaggcacacaccaccacatccggctaatttttttttgtatttttagtagagatggagtttcaccatgttggccaggctggtctcgaactcctgacctcaggtgatccacctgtctccacctcccaaagtgctggcattgtaggcatgagcgaccgtgcctggcccaggtttagcacatttaaagagatacgagggataaaggtgtagaagtggaatctccttggaattcacttagcatgtttcgtcataaatcctgaaatcaattctgctccctgctatctttgccatctcctttgctgtgcccttgcctaaggtgactgtggagaaactgtgtttccctcagtgagtgatgaatattctttggcacctattcatagtacaggtacatgttcagactaagttggtcgcttcacccttcacttgagggctgcacttaatcagacctttctccttcccggattcctgctgtccttgtaaccattcattaaatactgacctggtttgtttatacctactgtcccaagtgcaagtagacttggtctttggtgtaatacatatttgttaaataaattgattctcgtttgaatctgttattaactcatttcttattccacattttatcagtgacttacatcatgtgcaaattatccgggtgaaatttaatcattactgaaaacgttattttttttaacttgagttttaacaagctaacttgttgtcttatgtatgttcatgagaataaggaagatttaacttatggtagcttgcttggatcaagaccattaagtttcagttggccttaagttagtgtgagccagtacagtactgtgttgttcctgtcacactgatgtgagctggctgggctcagtggcttacgcctacagtccctgcgctctgggaggccgagacacgggattccttgagaccgagagttccatatcaacctgggtaacagagcaaaaccccgtctcttaagaaaaaaaaaagtgatcttaggtgttattaataacatagtgtttagagcttgcattgttatactctgattacattatatcatgatatttctgacatgaatacctggatgtgaactctctgactttgccactagtgaactttgtaagtgatttaaggcaagtgatttggcctcatcaagccttagttttcttatttgtaaaacggagatattatcagaactgacttcgtgggattattatgctaaatattgtcatcatagccattacctgatagatgagataatgcacagaagagattcatcacagtgcctgctgtatacaaaacgtgtcctaagtgtcggctgcttaatgtccttaactgaattttgcacatttggaaagcaagactcaaagcccatggatagtgagtagctgggtgtaaactcatgcctgtccttttccagagctggtggacttacccattgtgctgtatcctttctcagaagagttgggcaagtgacccagtgtccagagttctgccgtcattccaacaagtacccagtgcagggccagctcagtcctcttggtctctgaatggagtgtggtgctagctatggagttagagcctgggagagagcatctaaacctagggaagggaaaggaagaaggagggatagagagagaatgggttaagagaaaaataacaacagcaaaaaagatccttaggaaatcttttacttcagatgacattattagtacagttatagagcagctactgccaaagttcttcattatctcttctggtacctgaattctcatctatcttcaaggatccaggatcctaatttatagttgttttttcctgagtgtcttcagggtgccttatgagtgactctccacatataggatcaagtcccagttccttgaatggcatatgagtccttccatcatctggacttttttttatcctagctttatttgctacaactctcctaagcataccatgcgcttcagtcatattgagaattccttgtagttgcttagtgctaccctcttcttccagtgtcacggcctttacacatgctgttcatgtgctcccttctctgtgtgtagcatcctgcacaaagccttattagagcatttaacacaatttgttgtgtttgtgccatattttactttgaagttgccaaatgcacttgatatttacctgtaattgttgatgcagaggggcagttttaaggttgggtttaattgatttgtatgcatattcttttataggcatagcctacctggaagaatatataggagaccagtaacagtggttgccttttgggcagggacttgggtgtctcttcagtgtatccccttttgtactttaaaaattctgaattatatgcatctatgatttatttagaagaaaattttatgtatggaagattaattgatatgattagttttattgggttttatgcgctaattggtaatacattaatagcccttaacagagaagatgtgtcaggtgcaggtatttgttttgttatagcttttccccagttagacagataggggcacactcctaaattcataacagtctggcatgtagcccaaaggggtgaagaacagtagccatagctaatgctgaatgagtatatattacatgctagacattattctaaacactttaagagtgttaattcaaatcattctcacaacctcttgtggcaggtgctgtttttacccttattttacataccaggaaatgagaggcaagaagggtgacttgttcatagcaggacacacaggaggagaacatagaatgttgggagttcagcctgggtggcttggctgcagactgactcgtaatgaccattctgctgcctgaacagaaattagaatggggattcttgcttaattcttccattgttatcatgatttgttgtattcgctgtaacaattgcttaatatgtaatttctaggagtggtgtttgtggtgattatcagatgtggtctgtttcacagttaatattaacatcatattttaaaacccatttaagaaagtgtaaacattgtgttctcaggatatgcttactgtttaagaggggtttaccatgaccatttaaatacagaaaagtagatgattatgcattctcagacctgagatgtgagcaaggctctgagtggcttcgagttttatcacattagaagtttacctatttttaaggcaggggcttggctcgggttggaggagttaagacatatatgatgtaaaggttaaaccaagacctagcaagcttttttcacttctgagattctggactttttcctgtatgttaaaatactgctctaggccgggtgtggtggctcaggcttgtaatcccagcactttgggaggccgaggcaggcggatcacctgaagtcaggagttcgaggccggcctgaccaacatggggaaaccccatctctactaaaaatacaaagaaattagccgggcttggtggtgcgcacctgtaatcccagctattaggaggctgaggcaggagaatatgttgaacctgggagacggaggttactgtgagctgagatcgtaccactgcactccagcctgggcgacagagtgagactccatctcaaaaaacaaacaaacaaacaaactgctctaggttatataagagtactttttaaaaggtcatttataactctaactcttcttttagaaatataactgacactttttttctgtagttccgttgaacttaaaaataattcacaaatacagaaattaccgtgtgctaatgtgtattacatccaaattacttggaatggtgtgttttgaaaaacgattagcttgtacaattttagagtaggaagaaaaccttactaaatagctttccatttgagtgctaccagtttatgtggaaatcaaggcctacagagattgatttacttaaagttaaataggtcattagtggcaaagctggacttgggtttaggtctctagataaacacaggatacacaacttctctactgtttggtctcagctgcttcaaaatttggtggttattcaaacttaacattggattcaaatggtgtaatctgcttagtctgggcatttttggatatatgcacaattaggtacctattctgagttactgaaaatatgccctgtcccaacagagatagcagataaattatacttacttagtatcagacttccctttgaaaacaactcatgacacttagaatttcccagaatttagaaaataaattgtcaagtaattttggccaaagtgttttttttgtttatttatttatttattttttgagacggaatcttgctctgtcacccaggctggagtgcagtggcacgattttagctcactgcaacctccgcctcccaggttcaagtgattcctgcctcagcctcccaagtagctgggattacttgggattaccagcacttgggattacgggcatgcaccatcacgccggctaatttttgtatttaaattatttatttatttatttagagatggagactcgctttgtcaccagacaggagtgcagtggcgtgatctcagctcactgcagtctccgcctcccgggttcaagccattctcctgcctcagcctcccgagtagctgagattagaggcgcgtaccactagacccagctccttttttttttttttttttttttttttgtatttttagtagagacagggtttcaccatattggtcaggatggtctcgatctcctgacctcgtgatccacccaccttggcctcccaaagtgctggattacaggcgtgagccaccgtgcccagcctttttgtatttttagtagagatggggttttaccgtgttggtcaggctggtctcgagctcctgacctcgtgatccacctgccttggcctcccaaagtgctgggattacaggcgtgagccactgcacccgggcttgaccaaagtcttttagtgtctgaaatatcatttgaagattttcttttggctacagaatatgtagatacccccattgtgaatacattaacctactatgctttaacaaagtaattatagaacccgatcatatcagatgaattttgtagttccctggttgtaaacggttatactatttaataacctattttaatattaccctaagtatttatagtacatttaatattactgtaagtaatatagtatttaatgttactctaggaagtaatgtttattagggttatattcagtgttgatgttggaaaaacttggtgttttttggtcttaaaccatcggtttaaaagtaacaatttctaatgaatgtgttttttctctcttcagacttttgataaaattcttgttgctaatagaggagaaattgcatgtcgggtgagtagaattttcgtcttattttccattttactctgaaattatttattaaacccctttaagtgtgaatcactattaatagacattaatatattttaaaataggttattagaacttgcaagaagatgggcattaagacagttgccatccacagtgatgttgatgctagttctgtaagtatatttttgctttgtttaaatcaggacttaattttgggtcaagcagaaaaagtgagacatacaggctttttttcttggcctgcacaagatacattcaagtttaaaaactgtttacttgttcactgttgtgttaagcaaaacgacagtatcacagtatcttctatatgtgccgtaagtattttcttttcatagctttaaaaacttagacagaaaaattgccaggctgattgctggtcaccaagtagatttaagcaaagcatgagaaaatttgagtcaaagattaatgaaatgtttacacagtgctcccttatgagagcactttcccccagcatagcttcagtatcactaagggaatgctacaattgtttaacctttcctaaatgcttcaacgtgttcagctgaaagtttgacaaaaatgaaaggtaggctaatgctaattggatacaaacaaaagaaggtttagcataaagcagatatacttttatttggtacttttaacacagcaggccttttttttttttttttttgggacagagtcttgctttgttgtccaggctggagtgcagtggtgtgatctcacctcactacaacctctgcctcctgggttcaagcgattctcccgcctcagcctccggagtagctgggattacaagcacctgccatcatgcctggctgatttttgtatttttgtagagacagggtttcaccaagttggccaggctggtgttgaactcctgaccttaggtgatctgcctgccccggcctcccaaagtgctgggattacaggcttgagccaccacacccggcccacagcagggattttttttagtagtaatgttatgaatgagtagaaaaaaatcccatggggaaagaatgtaaattattaaatctttatggcatgaaatataagtagttgaatactaatgcaagcattgtttctcattgtctcatactacttttgataatgggaccctttggtagggtccatcagttaatgacagggatatgttctgagaaatgcatcgttaggtgaattcaatattgtgtgaccatcacagaatgtacttacacaaaccttgatgatacagcctagtacacacctatatagtatagcctattcctcctgtgctacaaacctgtgcagcacgtgactgtactaaatactgtaggcaattgtaacacaatggtaagtatttgtgtatataagtgtatctaaacacagaaaaggtacagtaaaaatatagtataaaagataaaaaatggtacacttgtatagggcacttactgtgaatggagcttgcaggactggaagctggtctggatgagtcagggagtgatcaaaggcctaggacattaccgtcactactatagacttcataaacactgtatacttaggctacacgacatttatagaaaaatagttttctttcttcaataataaattaaccttagcataccataacttttttaaattataaacttttaaattttgtctttactctttgactctttcttttttttttttttttgagacagagtcttgctctgttggccaagctagagtgcagtggtgcagtcttggctcactgcaacctctgtctcccgggttcaagccattctcctgcctcatcctctccagtagctgggattacaggcatgtgtcaccacgctcggctaatttttgtatttttagtagagacggggtttcaccatgttggccaggctggtcttgaactcctgacctcaggtaatccacctgctttggcctcccaacgtgctgggattacaagcgtgagccaccacgcccggtttactctttgactctttcataataaaacagcataaaatgcaaacactgtataactgtacaaaaatgttttctttatatccttattttataagcttttttctgtttttaaagttttttatttttcatttatttttgactttttgaacttttttggtaaaaacgaagactcaaatgcacacattagcctagacctgcagaggatcaggctcatcaagacatcagtaggcatgggatcacatcaagttagaaagcttctacacagccaaggaaacaacaaaatgaagagacaacccacagaatgggagaagatatttgcaaactacccatctgatgagggattagtaactagaatgtataaggagctcaaacaactctataggaaaaaaatctagtaatttgattaaaaaatgggcaaaatggccaggtgtggtggttcacacctgtaatcccagcactttgggaggccaagcgggcagatcacttgaggtcatgagtttgagacctagaataaataaatggatgtttaaccagcctggctaagatggtgaaaccctgtctctactaaaaatacaaaaattagccgcgtgtggtggcacacatctgtagtcccagctacttggagactggggcaagaagcttgaacctgggaggtggaggttgctgtgagccaagatcgtgccactgcgctgtagcgtgggcgaccaggcgagactatgtccaaaggaaaataaaaaggggcaaaagatctgaatagtcatttctcaaaagaagacatacaaatcacaaacaggtatatgtaaaggtgctcgacattactgatcattacggaaatgcaaatcaaaagtacaatgagataaaatcttaccccggttaaaacggcttttatccaaaagacataacgagtactggcgaggatgtagagaaagaaccctcatatgctgttggtgggaatgtaaattaatacaaccactataaagaacagtatggaggtttctcaaaaaactaaaactatcatatgatccggctgctagatgtacatctgcttctaggtgtacacctagcaccagggaaatcagtatatggaggagatatctgcactcccatgtttattgtagcatttttcacaatagccaagatttggaggcaacttaagtatccatcaacagatgaatggataaagaaaatgtacatatgtacggtaccattcagccatagaaaagaatgagatcttgtcatttgcaatagcatggatggaactggtggaggacatgttaagtgaaataagccaggcacagaaagacaagttttgcatgtactcactcatttgtgggagctaaaaatgaaaacaattggactcatagagagagagtagaaggatggttaccagaggcttggcagggtgtatggagcgggaggggtggggatgattaatgagtacaagaatatagttagatggaataaataagatcttgtatttgatagcacaacagggtgactacagtctgcagtaatttgtggtacattttagaataatttagggaatagaattgggatgcttgtaacacaaataaatgaatgatttagatgatggctaccccatttatcctgatgtgattattatacattgtatgcttgtatcaaaatatttcatgtactccataaacatatacacctcctgtatacccacaaaaataaaaaaagacatcactaggcaaataggaatttttcagctccattattggagctgaaatgtagatgcagtacattaccgaccaagctgtcatatggcgcatgattgaattctgatctacaggtagacttttcagactttgcaaaagtggtttcaaaagaattgttgttaggtttttctcatttgtaccttccctgaagcagatgtggtagttttacattttagagacttttcaccacttctggctgaaagcagtagggaatataccagagattatgatacataatttataataaaatttaccagaccccacaatggaagcaattgcacactcagtcaaaactttctcttactatgacctactttaggtcaatttctagaaagatactataagtaaaagcaggataatgatggtgggaatgtcaaaagtttcatttaaacctcaacagtagggtcaaatctgctatgtggtttctgtttcagtctcaaggaggctgaaaaggtgaattcctgtaacagcatcttttgcatcctcagcacgtgatcacagaggttactatcatagctaatcagctttataatatcagtaatatgaaaaagccatgctattcagatgtattaatttttgcatgtttgttttcaagaggtgagcattttaaatgtaacttggagtaaaaaactttataggctttgtatgttaatttcacatgtggaaatgtaaatactattccagtaggaaaatactgcaacaattgattgcaaaagctattcattgtctattataaacaactaatttttaaggtaattatgcaaggaaaaagatgaatggatactgcacatatcaactaataagtcacacaaggaaggaaagccagctaacttgcaaacaattaatgtttgatagaaaaatgttggcttttagagatgattatgcagtttacctctgttggtcccttccctccaacatgttcttcaaaattgtcttcagtattcttggtccttcgctcttccatgtgaattttaggatgagctggccaattaccccccttccccaatttttagataccatgaacaagatttttataagtataacttttgcatgtctttttgtgaacataattttgattttttttgggtaaatatctaggagtggagtagctgggtcttagggtagataaggagttggcaacctttttttgtttgaaagtaaatacatttttgtctggatagcaaatatattttagattttgcaggcccctgtggtcgctgttacatatgcttctttttgttttgttttgttttgttttaacaacactttaaaaatgtgaaaactattgttagcttgagagctgtgcaaaaacagcccttggatcagatttggccagtgggtagacagtattttgctgatgcctagaataaatacatgcatgtttaaatttataagaagctgctaaatagttctccttcatggttgtatcatattttactccctccagaaatgtctaggtcagggtgcttttgtgtccttgccaacacttggtgttttcagtccatttgattttgtgttttatttttaagtggttgtgaagcagtatgtcattgtgtttttaattttagattttcctgatgaatactgatgttgagtacttttttgtgttattggtcattcatttatatttttttctgaagcatttcttcaaacataatgaaaaaaattagaaaagtagtaccagtatattggtatcagtttactgttatataccagtataacggtatctgtatacccttcacctagattcagcaattgttaacattttggcttgtttgctttatatttgtatccatatgtacattgtgtgtgtgcattttttttttttttggctaaacaatttgaaaataagttacaggacatggatgaagctggaaaccatcattctcagcaaactatcacagggacagaaaacaaaacactgcacgttctcactcataggtgggaattgaacaatgaagacacttggacacagggtagggaacatcacacactgtgtcctgttgtggggttgggggatgggggagggatagcattaggggaaatacctaatgtaaatgacgagttgatgggtgcagcaaaacaacatgagacatgtatacctatgtaacaaacctgcacgttgtgcacatgtaccctagaacttaaagtatatatatatatgtaaaaaaagcagcattaaaaagaatcccctggacaggaaaaagaaaaaaaaagaggccgggcgtagtggctcacgcctgtaatcccagcactttgggaggctgaggcgggcagatcatgagggcaggagatcgagaccatcctggctaacacggtgaaaccctgtctctactaaaaatacaaaaaattagccaggcgtggtggcaggctcctgtggtcccagctacttgggaggctgaggcaggagaatggtgtgaacccgggaggcggagcttgcagtgagctgagatcgtgccactgcagtccagcctgggcgacagagcaagactccatctcaaaaaaaaagaaaaaaaaaaaaaaagaaaataagttacagacattgtggcattttacccgtaaatactattcatctcgcagtaataagtatggttttctacatatctataataccttatgaaacctaagaaaataactcattattctataatatcatgtaatatgcctaccacattcaggtttttccagttgaccccagttgtcctttttaatatttttctttgatccacagttcaatcaaggttcatgagttacatttgtttattatacctctttagtctcttaatctaaaatagtgcccctattctccctctttttttgtttgatttttattatgttggcttttagatattttggctttgtatggaatctattttctcatgaatagattcagattaaatatttgacaagactacttcataagtgatgttctttctttttttcttttttttgtgacagagtctctctcagttgcccgggctggagtgcagtggtgagattataactcactgcagcctgacttcctgggcacaagcgatcctcccaccttagtttcccaagtagttgtgactacaggtgcatgccaccacgcctggctgatttttgtattttttgtaaagatggggtttcaccatctttcccaggctggtcttgaactcctgggctcaagagatcctcttgccttggcctcccaaagtgctaggattacaggcgtgagccaccgtaccccagccagtaatgttattttttttaatagtaatatcataacaagaggttcttaatgttgaattgttctgttgttatgctaagtatgatcatttggtttcatcaggtcttcccattataatggtacattttctttttttttattaaataatttttggggtgagtttttgaatccttgtgaatattttgtccctcaaccacctctcatctaatgtttttgcatcgataatgaaaattgcctgagcctgattactttggttacatttgtcttgtttgctgtctgtggagtaagctgttgattttctgctcctttttgaatctgcctgtttttatgtattatcttttttcttatgtatttgaggcctttagtatatttatttttagcatatttaatttaaagaatctatcatattattgtattatttcaagtttgtgggtgtttatttctattcctgactcttcctcataacatattgtttcctcgcatgtttaaattttggtgtgtgattctatgtttggtgcttttgttgttgaatttcaagatggtttgggttatggatttggccaggtaggataggtggtatatttgtttccatcacaccctccagggtatcactcatctgggactaatttttatattaaatttttggcataaagattgtcaaattttgaagataatgggaagaacaaaatgagattgcacacacacagatacacacctgttgaataggctcatggtttctaatatctagagacattttcgtttactttgaaccacagagatacgagcatagggtttatcctctctatttcgtaggttgattcctcccccacaacctttcactgagaatgtaatctttgagcctcctggctttagacagaagggtttccttcaaacctccaactcacacgggatctgtttcctttctctgatcgttaaaacccaatcttctagattattgagattcccaccttcactctccaagactggctcttgtggatgcagactgattttcatttttatattatttatttatttatttatttgagccggagttttgctcttgttgtccaggctggaatgcaatggcgcaatctcagctcactgcaacctccatctcctgggttcaagcgattctcctgcctcagcctcccgagtagctgggcttacaggcatgcatcaccaaactactgaattttcagtagagacagggtttcaccatgttggccaggctggtctcgaactcctgacctcaagtgatccacccgcctcagcctcccaaagtgctgggattacaggtttgagccaccatgcccagccagattttcagattactttttttttttttttttttgagacagagccttactctgttgcccaggctggagtgcagtggtgtgatcatagcaaactacagccatgaactcctgggctcaagtgattgtcctgcttcagcctcctgagtagctgggactacatgcacatgccgttgtgccctgcttcctttttctttttcatcccttgtagtttttttgtgagccaagctcttcatttgaaggatgtttgttatatttaatctaggtctttagatgtttctaaggaggatttgcaggttatttagttggcttattgttggtttgtcttaaaacaatatgacatcctattctttgttgaggaaattcccttaatttctttgagaaataaagactgatctagagcagtcttaaagtcaggctttccctaggaaaacaattcatttataatgatgagattaatgtgcctgaatccaggggatgaggctatagggaagcagtataaaatactccaatgggaattggtcagggcaggagaaagcaaaatgggagttaagcctcttattaagtcatgaatttttttttatgtttcattttccaggccctaggaaagcacgcttattattctctgggaagatttgtggagaatagtttatgaagagaagacaattctagtgcaagaatgtaaccagctgggattttgattgatattgcattgtgtctgtagatcattttggagtgtatagctatctcaacgtttttaagtcttcctatccatgaacatgtgatattcttccatatttaggtcacttggatttctttcagcaatgttttgtagtttcatactactataagtgtaattagttttttaatttcaattttttaaattagttgcaagtctgtagaaatacaaatgattttcatataatgattttgattcctgtaaacttgctgaactcttttattagttctaatagttttttagtggatttcttaggttttttttttttttttttttttttaaagatggagtttctgtcacccaggctggagtgtcgtggcatgatcttggcccactgcaacctccacctcccgggggtcaagtgattctcctgcctcagcctcctgcgtagctggggttacaggcatgcgccaccacgcacagctaatttttttgtacttttagtagagatggggtttcaccatgttggccaggctggtctcgaactcctgacctcaagtgatcctcccgctgtggcctcccaaagtgctgggattacaggtgtgagccactgcgtctgggccttaggattcttttttttttttttttctctcttgagaccgagtctcattctgttgcccaggctggagtgcaatggtgcgatcttggctcactgtaacctccgcctcccaggttcaagcaattctcctgcttcagcctccggaatagctgggactacaggcatctgccaccacacccggctaattttttgtatttttagtagaggtggagtttcaccacgttgaccaggctgggctcaaactcctgaccttgtgatctgcccacctcagcctcccaaagtgctgggattacaggcatgagctactgtgcccggccaggattctttatataagatcatgtcatgtgtgaatagagatagttttacttctttccatctggatgctttttatttcatattcttgcctgatttctctggctttaacttccagaacaatgttgaagaggtgagaggaggcatccttgtcttgttcttcatcttagggggaaagcattcagcatttcacccttaaatttgatttaggctctggtattttcatagactttcattatcaggtggaagaagttaattgctattcctagtttactgagggatttttatcaagaacaggtgttgcattttttcaaatgctttttctgtgtttactgagatgatcatgtggtttttgtcctttatttatatggtgtattgttacattaattgatttttttgggtgttaaaccagccttgaattcctgagattaatcccacttggtcatgctgtgtaatcctttgtatatattgctggattcagtttgttagtattttattaattttgtgttcatatttacaagagatattgtctgcagttttcttatgatgtctttgcttggttttggtgttagtgtgatcctggcctcatgaattggaaacctttctctcatcttctagtttttttggaagaattggtattaacttttctttaaatgtctggtagaaatcaccagtgaagccatctgaatctgggcttctctttggttagtttttgattgttaaatctacctttttacttattgtaggttttttcagatattctgtttctttaatcagtgtctgtagtttatgtctttctacaaatgtgtccatttcatcaaagtttctagcttattggtatagtattttcttatttttattttataaggtcagtagtaatgtctcctctttcattcctaaatttagacatttgagccttcccttttttcttggtcactggcctagtctgttcaggcttgttatggattgtcatagtctgggtggcttataaacaacaggaatttatttctcatagttctggaggctgataagtcaagattgaggcactgttagatgttgtccctggtgagggctcctttcttagtttcttagtggagccttcttgctgtgtcctcacatggtggaaggagcaagggaaggatctcattcatgaggtctctgccacaagtgttctgaaatagcattccagaagtacaaggtgatacagttagtcaagagctataaattggtggataggaaaggcaaaaataagaagattgtattgagtttctagttatacaatgaactgaataactccttttcttttgagacaaattctcactctgtcgtccaggctggagtgcaatggcaccatcttggttcattgcaacctccgcctcacaggttcaagcattctcatgcctcagcctcccgagtagctaggattacaggtgcctgccaccatgcctggctaggatttgtattttagtagagttggggtttcaccatattggccaggctggtctcaaactactgacctcaggtgatccaccctcctcggcttcccaaagtgctgggattacaggcgtgagccactgcacctggccctgaataactctttagaaacagaaaaaatctctggtggttggttaaatagtaaatataaataaatctataaatttcctatatatcaataaggtagaaaatacaacaagaaatgtaacctcgtagaagcaatggaaatgataaaacactgtatgatgtgaatttaaaatgaaatttttaggacttacatgaggacttcttatttttgtatagggaaaccgatttttaaaaatgctcttttctgtacattttctattaaatcctaatataacaacataatggggggggattgacaaagagtaaatatgcaagaatagcctagataattctgaggaaaattgatggggagtagcctaacatattaaaatacattttaatacattgtaagtcagcaagaagacataggtctatggaatacatttgttagattttaggcagtgggatgatgtgggaggatttttgagttgttaaagagggtctcatgaatattatgtggatttagaagacaaggtaattctaggattgcttgcctctaatttactgagatttttaggtatctcagagaagataagaaatataaggaatgagaaatgtttaatggctttagtgactaggagtttctaaatggacacatgggcccatttcattagtttggtgaatagtgagagcaaagaatttgggaatttaagattgttgtacttctccaaatgaatgttttaagtataaagactagtatgtctttccacaaaaatggtaaaatatattgtcacatttatatcaaactgctaaaataagttttgatattttttaaaaaatgagatctcatcaggttaaatgaaaagagttgagaatcttcattcccaaagaggaaaatgattctgtatatcaacagaatcattcaacctttgactgtattctctatctacgttcctaaattgaacctatctatacatattttgttgctttgtctgtgtacagtcatgttggatttaaatgagaaatatctgattttaccacgttgaaacaagaacctaaaattagggaagtattcactgtgactcacatcttacccaggcagcctgctgttgaaaggatgatccctggtgcgcactgtagtctcagcctcaggattctataatgagattgagtggggtttcctgtgagcactctggggtgattgacagtaaggtgagggcagtcatcactttttatgcctacccttgatgatatgtccctgctgtctggggagggaccgaggacgaataggacttggtgatgtctaagtaattagtgtatgttggttccagctgaacaaactggagggtaatgatcaggtaaatggaaatggaacacattaatgcagactaaggtataaaagaccttagggttaaacttttcaacattttatgggattattagaatatctttatttcattttttatatttacatgtctctgtatatacatacacttatttatatttttgtcagtgtatcttcagttttaccttagatgtatatagagatgaaagcaacttaaatgtgaaaacctcaaacgcattttttctcctttacatgatttcagaatattttcaaactttttctgtttggaaaggagttaaggttcttaattaaacattttctttttaatttcacaaaaattgttaatggacttgtttggagctgatgcctatcactgatcctcaaataggagcaaatgactaaagtcaggcttggaaaacttttttggggtgttaactgaaaagtatcaggtgaccttttatttgtgtgtgtgtgtgtgtgtgtgtgtgtacttgagaatgttatatttcagtaacattttcttaaactgccttttcttagtaaaggatattttaagatgatggctgtcctggtccatgtttcacagttggtcttaattagatcagaaatatttccagacatttaggttgcaataggaaatctataggattcttaatttattcttacaaaaggtatttatagttgccattcttcaatattaactttccttatcaacagcaaaaagtcttacggcaaagcctctggagagtgactgcagtactgcatttaatgggaagggaggaattgtttgccttagtatatggttttgaatctgggagtctggtaattaggtaatcaaagggtttaaaaaatggcataatggctttaaaacttgctattgctcacttttcttataaaacttagctttcagaaatctttttagattaagaatacaatgtacctactatgcaaatttaaaacaatagacttttcattaaagaactaaccaggagaagaaagcatttaagatgtgtagacatttcttttccttttctttttttcttttattgtctttggaaaaacttattttgcagaaacagtatactgtatcaattttaagtgttttgattatctttgacttggctaaattattttctctgcatttttgggtaaaatggaataggatgggattcctggtaggtatttgttcacattaatactatatttaattggagatcctgcagaatagtagcaggaggctgaagagaattatttagcattagcaatggctcgtctgggagttgtggactaatcaaggcgctgtagtgttagtggtggggatgatgggaattatgacgattatgacatgtaagcatgtctgtgtacgaattggacaggcaatgagttaatcaagaagtatgttaaatggctcccatgctgattcattattatctaccatagtgcctgtcaggttgtgtatttaaaaaacacaatcattgccaaattcaatatgtatatgagctgaattcagccattgtttgcttttccataaaataacctcagatttccttatatgtataaaaatagaaaattgtgtcaactgtgctgtgatttgtgtttatagtatggtatcttttttttttaacagagtcatttaaacctatgtttgctttgccctttcatatattcgtgtaaatattctctggcttgttttctatgcataaagggtttgggtttgaaagtgaaatttatgtgtctttacttttcaagatgaaaaaataattccagtatttcagagacaaattaatatttaacacatgaactatggacaaatcaaagcatgaatcttttccaccatcaaaatgcttgaatttaaattgggggtgggggtggaaacctcctttgctgtagcggggggtctctttgtgccaggtagacagacccattctgtgcccagcatggttggggttatctgtcaggaaactatctattagaaatgctagaaatgtatgtattttgggggaatggaactaataaattgaattccttttagaaaataaattgaaatgcagcataaatccatgagcaaactggattatatctctaggcaaatttaaagagttattgtacagatgaacaccatttttttttattattgtgagcactgccaaatttaataaaactttctaccaaactgtgactttcatgtattaacttaattaaagcagtgttatgggtaatactcagtgttaacctgtggatggctgttattgaaatccattatcaatggagtcagtattagtggtcagcagcatcagaagtaaaacttgcaaccaagaccctcccatgggtgctgtgagctcagcaggttaaattgtcaaaaaccagtaaagcttcttaaaggactgatagcttaagccacccggagttaaaggtaaactagtcattccagtcaagatggactatgactttatttagcagtcaggcaaaaattatatttgggcaggatttatatcagtatcttcatgtatgacttattcatttgtatgttcatgtaccttgctatttaaattcaataaaaccatccagctttttttaatctgtgggaagtgacttgtggatattttcttttataaaacgttaaggagatgtcttaagactttctgaattttttgttaataacttatactgaagttactttttacttatactaaaattttaaattaagaaaaaagtgaaatattgtattaatatatctttttggttttgtttattttataatttctggtaaacttaaacaacatggttttaaagggaatttatgtatttcagtgtaattagtacctgctgttatgaaaaagcacctaatcatggatttatttttctctaagcagctatttgggaaggatcagaagtcctatcttactgaaaaagcatacatataataaaagatttgagggccgggcgtggtggctcacgcccgtaatcccagcactttgggaggccgaggcaggcggatcatgaggtcaggagatcgagaccatcctggctaacacagtgaaaccccgtctctactaaaaatacaaaaagttagccgggcgtggtggtgggtgcgtgtagtcccagcttctcgggaggctgaggcaggagaatggcgtgaacctgagaagcagagcttgcactgagccgagatcgcgccactgcacttcagcctgggcgacagagctagactccgtctcaaaaaacaaaaaacaaaaaaaaagatttgatatacagtttaccttattctatgttccagtgtttctaaggccatgacttaactcatttttacagcctccctcattcagactccttagtggagggaaaggacatgattattccaaataatgcctctcactcattcagaatctatggtgtactggaaaagcacataattacataaggattgaattactgttactgttttaaattgagaaaattggggcttcaagtataaagccaatcttcgggttgccaaagatcactgggctagtaagtagtggagctgagattcaaattatgtgtaacttctaagttgtactgtttccactgtgcatgttgcttctcatactaagtatgaggaaaagtcccctcccaccacaaaacgaagtgaagtttattactttgaaggcagagtttttattagtgcctgttggaggctgggtactatgataggtactggaactagaagagtgactggaagtgataggattgctgctttagagatgggtatagagaaataaaacataaataattacaaattgtgataagtgttatgagggaaacaagttgttgagagagaatcatggttcccttcagtaatagggtgctcagggaaagtcttgctgaggggtaaaatgtaagctgagaatgatggatgagaaggagtcagccagctaggcagacaagaccgcgtgcgcaaaggctctgagtcaccccagtctgcttctgtcctcagtactctactatagagttcttgctagtgtgaccaccagttttctcatgttaagtccagtggacatttttcagtcctcttctgtttgacttcccagaatcttttaacactattaccctttttcagacactctcatcctctggctttggtgccattttaatctcctagttttctctctacttctgtggccctcctctgtgtcccctctacaggaatcactcaaggtttgattggtgggctcttcttaaaattgttttattttttgtactttctctacccttaccctgaaagatggcattctcttccacttctgtttctgtggttttaatcaaccctagactccaactctgttttctctctctctgtgacgtctctagttgaatgttttaccactacctcaaacccagcattacccaaactgaactttgatccttcgggcttcttgtatctgaatcctcctgcagaagcacaagatgtaggaatttatgttcaccatcattctttctttcatttctcatttccaatttatgagcaagtccttttcataaataattttggaatctagtcacctatcttcacttcgttattgcttctttagcaaggtcttttaaaatcttctagtgaatcttttaatcttttagactgataaaattaatttcatctggggcagtttatctaatgtgaactgtttcagtttctgaagttttgtttgatagcgaatgctttcttactctgttttggaattttagttcataggctcttttttctggtgaaagttaaaaatgtttattgctcttcatgcttcatcttctcccttccctttgcttccttgaccttcctcttcctctctctttcctagtttctctctcaccccggccattgctgcctcccaccttctccctgaccagtagttttgtgggtgcccccccgccggcattttggattcctaatctacatccaggtcttatggtgatagtttggacacatggcagattagtcccagcagcttgttcagattttgaccctgaagctgtggttctgcctccctaggtccacagtctccaggagttgtagtgagctgtagttgcagacaatacttggtggcctcctcttcaggccaagggcagttcctctttggcctggtcttcaccagtggctctggctctcttctcagtcttgtgagaacattctcgccatctgtactttgcatttggcacttcctgcttctgaggaaccagccagtggttagcattgttatgcgtttttctcctgttttgagtttgtgaaatgtttaccatttatttctgcttacctgttttcttagttttcctttctgggttttattgtcattgttgtacatttgaagtagagagagcttttgaaatatgaactcactgtgccatcctttttttgtgctaaatttattgaagtccacaaaaaccagagaaaaatgtcagatctcaaaattgtgtttttgctcaatttcaagcatcaatttatccaagttacccacttgatacctgacttgccctacttagcaagtcgaggcattgttttgctggctctggcactctggctatagccagtcactcaccccacttgggattgcttcctttgctgcttgttcctgctgctgctcagtggcagctgccaagttggagtagcaaagggaaaagtttagtaggcatcttttaggaagacagaatgctgtctggagatggcagtggtggatttatatctgagtcattcatctgaattggaacctgtacaaaggaaaagaggttctagctcagataaatagatataaattcattgttgctatcttcaggcattcatttatttaattagatgcactgaaaagcactctcgaggtgtggggacagggtgtggtgtatccaatggagagtttgtagaaattgttaagttgaggtacaactgcttataaatagtatttgaaaatgtcttattttgtaaacaactgagtatttagttgattgcaaatcttcctgtaaatcaatgatagattagtttagtttccgggtctatagtatattcctcaaatggatagtaggtatttttgtaaaggggactttataattaaatatagcaaagtgtcttccgtggactgtattaattaaatgttacagatccccaggctgcactgatgaaactcagctgggatgctctacatgtgatagggaaatttggtttcaaaattacacaacctatttgtgaaggtttcgtgtaatttttcttttcagtaagaagtgtttccatgtatcagtttttttacatttaaaaaagtaatttattttcaattgtggtaaagtatacataacataaaagtttaccattttaaccatttgttatcaaaagatgatgagatctgtggaggaaaaaatggagagctttattttctatagaaaaaacttgcagactggggaggcatagttttcactagtgaaaatgttgctctaaagagaaaaaaaaaggggcttggcttaagtagggaaagttcttgccctcattctctgtgaggtctgtgcaaacgaaggattcaagcttgttcggttcagattgaaccctaatctggtgccagaagtgtctctgtcagatgttccttcgaaaggctggtgcaggggaggtttctgctgcaattcttcttggccccagtcacaggaactgttctggcttaagaacagttcttaatcaagagccgtgatttccaagaacgaagggtggtgaccactcttctctcactctgctatggccgcttggacccattgtctaaatgtgggtatattagccacagggagtgcatctcatctggagagcttgcagttttatttacaattttatttcacacatttttaagcatacagttcagtaacattaagcacattcacattgttttgcaggatgaaaagttctggaaacgggtggtggcgatggtttcgcattatcaatttttacctagtatgcttttttttatacagtgttttaaagtgttggaaaaaacttatgcctttacagtattttattatattagcttatgttcattgtatggggttgtaggcagtgacagatactcaacctttaacaaataccgttgagcacttgttatgtgaagatgctccacatcttttgaactaggcagttgtggttcctgcactcttgtggcttccagttcagtggaagaagcagacattttataattacatacatttatgacattagtgtaatgaaaaattatagggtgttttgtaagtgtggaacaggaggatctgaaccagcctggggagtcagggaatgcttttttgaggaattcacattttggcagagacctgaagggggtgacaagagttaggtgaagctgggagaggacaatactagggcagaatagagcttggtaatttccagaaagttagatagggctaatgtactcttaaacaggaggcctgcagtgttgttcacaatgttcacctatatgtagttgtgtttgttttttaaatttttaaaaattatcctatagtaataggatacccatctttcatacccttctgtggatatcagcacatgtgtagattatgtcactactagcacaatcagaatgcagagtagttccattacccctcagactcccttgtgagtcattacccctcagactcccttgtgtatcccattagtgtcacatccttttccaccctgacactggcaaccacggatgtgtttcccatcactatagcattgtcatttccacacagcgtgtaaccttttgagactggctactttcactcagaatatgtttttgtgattcatccaaactgttgtgtgtatcaatagaatgttccttttttattaccgagtagtgttgcattgtgtggatgcacaggtttttttaaatccatttacctgttgaaggacatttgggttgtttccagcttttgacaattatgaatagaactgttgtaaacatttgtgtacagattctgtttctctagtataaatatctaggagtgggattgctggtcatatggtaagtataagaaactgctagacttttccagagttgctataccagaatacaatgagagttgtagtggttcttcatccacttcagcagtcttgtcagtatttttttttttgagacagagtctcactctgtcaccggggctagagtgtagtggcaccatcttggctcactgcaacctccacctcccgggttcaagcgattctcctgcctcagcgtcctgagtagctgtagctggcattacaggcacctgtcactatgcccagctaactttttgtatttttactagagacggggtttcaccatgttggccaggctggtcttgaactcctgacctcgtgattcacctgcctcagcctcccaaactgctaggattatagacatgagccaccatgcccggcctcattttaaccactctaatatggtttggaagtagtatctcattgtggttttaatttgcatttgcctaatggttaatgatgatgaccttcttctcatgtgcttatttgccatccatgtatccttttcagtgaataagctttgcctgttttttaattcatttgtttgtttgtttttctgttgttgagtttagagtgttctttatgtattccgaatacaggtcctttgttggatgtatgattggcaaatagtttcttccagttggtaggttgtcttttttgtcctcttgacagtgtctactgcagatcacttgtttttaattttgataaagtcagctgatcacttttttcatctataggttgtgttttactgtcatgtctaagaactctttacctaacttcaggccacgaagattttcttcaagatttttgtagttttgccctttattgttagatatgtgatccatcttgagttaattctctgtaagatttgcagtcggtttttttgttttttgtttttttgcatatagatgttgaattatttcaacaccattcattgaaaatagtatttctctattgtgatggttaatattgagtgtcaacttgattgggttgaaggatgcaaagtattgtgtgtctgcaagggtgttaccaaaggaggttgacatttgagtcagtggactgagagaggcagacccacccccaatctgggtgggcaccctctaatcagctgccagcgtggctagaatgaagcaggcagaagagtgtggaaggacttgacttgctgagtcttccggccttcatctttctcttgtgctgcatgcttcctgacctcgaacatcagactccaagttcttcagcctttggactcttggacttaactggtttgccaggggctctgaggccttcagccacagactgaaggctgtactgtcggctttcctacttttgaggttttgggactcagactggcttccctgctcttagcttgcagatggcctgttgtggtacttcaccttgtgatcatgcgagtcaatactctttaataaactccccttcatatgtacatccatactgttagttctgtccctttagagaaccctgactaatacaattacttttgcacctctgtcaaaaatcaaatggggtgatatttggatgggtttcttgactctgttctttttcattcatctgtgtctattcccttgtcagtactacatagtgttaaaattggattcctctacctttctttttctccccccatttttccaaaactgcttcagctattctggttcatttgccttttcgtatacattttagaatcagcttatgtttatgtacacacacaaaaaaaatcctgctgagattttgattagaattttgttgaatctacatcagtttgggaagaattgacattttccactgtgttgagtcttccaatccatgaacatggcatgtctcttaatttatttaggttttctttgttggtggtggtattcttagacagggtcttgctctgttgcccaggctggagtgcagttgtgtgatcatagctcactgtaggcttgaccacctgggctcaaacctcccacctcagcctcctgagtagctgggattacaggcttgtgccaccatgcccagctaggtttttaatttttttgtagagacagggtctccctatattgtcaaggctggtcctgaactcctgtgctcaagcagttctcttgctttgggattacaggtgtgagccaccatgcctagcctgtttaggtctgctttgatttctttcattagcatttcatagttttcaatatgcagatcctgcacatgctttgttttgtttgttttttgtagacagggtcttactgtgttgcccaggctggcctcaaactcctgggctcaagtgatcctcccaccacagcctcccaaatagctcccaactgtaggtacatgccaccatgcccagcttgtactgttttgttagatttttaacctaagtgtaatttttttttggagactcttaaaattgtattgtttggccaggcgtggtggctcgcatctgtaatcctagcactttgggaggctgaggtgggaggatcattgagccaggagtttgagaccagcctgggcaacatagccagaccctgtctctacaaacaaacaaaaatatagtagggtgtaggggcacatacctgtagtcctagctgctctggaggctgagagggagaattgcttgagcccaggagtttaaggctgcaatgagttatgatcacaacacttacattccagcctgggtgacagagtgagactctgtctctttaaaaaaattattgtttaggccggtgacagagtgagactccgttattgtttaaaaaattttggtttccagttgtacattgctagtagtagaagtatgattaatgtttgaatgttgaccttgcattctgtgatcttgctaaactcattagttctaggagtattttcgtaggttccttggggttgtctatgtagataatcatgttgtctgtgaacagagacagttcgatttttttttctttataatttgtatgtcttttattttatttttttctgttgctctagttaggaattccagtatgaagaggaagaggagtagcagtggtgcacattcttgccttattcccaatcttagtggaaaagtgttcagtcattcagaattaagtatggtattagctgtgggttttttgtggttgctttttatcaggttgaggaagatcctgtctactcctaatctgccaatgaatgttgaatgttgtcttacacttttcctaaatcaattgatatgatcatgtggggtttttttccttttgattgtaatatgctattttacgctgagcgattgatttttttagtatgaagctacttttgcattttggttgtggtgtattgttttttatatattgctggattggacttcttaattttttgttaaggattttttacatcattattatgagggacattggtctgcagttttctttttgtgtactgtctttggtattagcataatgttgtccttataaaattaattgggaaatgtttcttctctgaatgagagtgtataaaattgtttttttttttttttttttgagatggagtttcactcttgttgcccaggctggagtgcaatggtgtgatctcggctcactgcaacctccacctcccgggttcaagtgattctcctgcctcagcatctcaagtagctggggttacaggcgtgcaccaccacgcctggctaatttttgtatttttagtagaggtggggtttctccatgttggtcaggctggtctcaaactcccaacctcaggtgatccacctgtcttggcctcccaaagtgctgggattacaggtgtgagccacgcgcccggcctataaaattgttcagaattctccagtgaaaccatctgggcctggagatttcttcttcagaaggttttaaatgacgtattcaagttctttaatagttattggagtattcaggttatctatcttattttgagtgtgttttgttagctttgtgttttgccatttttgaggaattggttcatttcatctaaattgtccaatttatgcacatagaattattcttagaaaccttttattatccttttaatatctgcatagtttgtagtgataacctctttcctttcttattttggatgtcgtttttttcttcttttcttagtctttttagagatttatcagttttattgatgctttagaataactagcttaggttgcattgatgtcttttttctctattttctcttttaaaaattattgatatctcctctgttgtgttcttccttctactttaggtttattttgcttttctttttctggtttgtaaggtaggagcttagattattgatttgagatatatcttcttatttaatactataattttctctctaagcactctaagtgcatctaatatttttttttatatattgtgttttcatttttgttaagaatgttttctgagacttccttttttgcacataggttatttaaaattgtttaatttccaagcatttggagatttttctactgtctttctgttatttatttctaatactaattctctttgttcagagatcatattttgtattattatagtttttttcagtgtgttaagttcattttctgatccaggtatgacctgttttgttgcatgtttcatgtgcacttgtaaagattgtgtcttctgttgttagacttcagtactgtataaatgtcagtgagatacaactggtttgtggtattgtccagttcctctatatccatgccaattttctactacttgtctttcttttgagagtcttgatgtttccaacgatgactgggttattgtctgtttctcctctcagttctgccagtttttgctttatgaagcactgttgttaggaacatacacattaaggattattgtatctttttggtgaattgaccctgttactattaggtaatgttcttctctatcccttgtaaatttctttgctctgaagcctactttttctgatactaacctaggcattccagcctttatttgcttgatgtttgcatcgtattttttcccatcattttacctttaaactacatatgtcattatatttgatgtgactctcttgtacacagcatatacttgggtcatattttgacaatctcttttaatttgtatgtttaagtcttttttttttttttatttttttcgagacagggtctcactctgtcatccaggctggagtgcagtggcgcgattatggcccactgcagcctcagcctcctgggcccaagtgatcctttcacctcagcctcctgagtaactgggaacacctctagctaattttctttcgtggagtcgtggtctccctatgttgtccaggctggtcttgaactcctggactcaagcattcctctcatttcagcctcccaaagtgttgggattaaggcatgaaccaccacacctggccacttttatgtttaatgtagttattgaaatgtttggcttttgggctactgttttattattttgtttttctatctagtttttttcactgtttcactctttgtgtcttcttttgcattatttgaactttttaaaagtattcctttgaaatttattgtgtttatgactatctcgtgtagtttttcttcaaattaatactttattgattataatatacatacttaacttcctatggtctattgaaaattcatattttaccaccttaattggaatatgtcagtcttaccatcatgcaggtatctacattctcttcttatgttatggttttcttacgtgttatatctgcatgcattgaaaaccccatcagacaatgttaaaatttttgctttcaacagttaaacgtatttcaaaagcaatgttatcatttctgttgctcttccttcattccttatgttccagatttccttctaatgttattttccttctgtctgaagaacttccttaagcagttttagagctgatctgctagcaactaatgctcttagttttcctttatttgaaaatgtcttggctgggtgcaatagctcacgcctgtaatcacagcactttgggaggccgaagcgggtggatcacgaggtcaggagttcaagaccagcctggccaagatggtgaaactctgtctctaccaaaactacaaaaaaattagccaggcgcagtggtaggcgtctgtaatcccagctacttgggaggctgaggcaggagaaaggcttgaaccaggacagtagaggttgcagtgagccaagatcacaccactgcactccagcctgggagacagagcaaaactccatctcaaaaaaaaaaaaaaaaaaaaaaagaaagaaagaaaatgtctttatttcgccttcattcttagaggatatttgcactgaatatagagtactgagttgacagttctttctttccagcacttgaaaaacattatgtcacttccttctggtctttgtggcttctgatgtgaaatccatagtagtttgagtatcattcctttatagttaatgtgttgtttttctttgtttactttcaggaattttgtctttaattttcagtggtttgattatgttttctgatttctttttgttaccctgtttgagattcactgaccttcttgaatatgtaggtttatgtcttttaccaaacttgggaagttttcagtccttattaaaaaaaatattttctcagcatggtgctgagaacattttttttcttcttttctctgatagacatgtatgttagacctttaagtattgttccatagtctcttgttaattttttctactctttttttctctcttgtttcagattgtataatttctgttgatcagtcttcagatttattgactctttcctttgtcatctgtagtctacccttgagcccatccagtatgttttttttaatttgattattgcatattttagtttaaaattttccattggtttctttttacaaattctgtttcttttctgatactttcaaagtttccatttgtttcaagagtgttcataattgcttgttggaaaactttaataataacttccttaaaatctttgtgagataatttcaacatttttgttactttggtcttggtatttgatttttccttccctgtaagagatttacttggttcttgggttaattttagatattttgagtatgatgttatgagacataatcctctgaatttagttcatttctttttaggatgttaatatttttgtttcagtagcaattaacttggttggcttcagagtgcacattccagtttttttttgtttttttttttcctgtgggcggtgggtctttgtactcctatacagatccaccccacatatgtgtcaacaactcatcagtctgggatctgtggttagttcagtgtttaaattctttggtatacttattagaattacatccatacatgcccaacctagggatgagctcagaagttcataaacaactttattgtgtcacttctccatgctagcttctcccattctggttctttaggccttcacttttcagtcttcttacttagaaatctgaggttttattaccttgctctgctgttcaaattttgtgtttgtgtccaggacgtgtaaagagcacagagagagcagaaaaaaccttggggttttacctgccctcttgagactgcagtttcactgattgaagaagaatgtttcttctctcattgttttggctcttgctggcatctatgtctgcctctggtaccacagccacaaaattacttgggggttggggcaaaaaagaatagagcaaaaggaaaaaaaatatgggaattgagatttccataatgttgtaagtatcaggagctccctttcctgccttttgagtgagatgaataggggttctcctggagttctctccatcagtgtccccatgcctactttgcatttcaggcttttccaaggtcggtcagggagatcatgggaggaaaagaaaatgataaaactcaccacttgtttatagtaatttgaattcttttcttccttgatctgcctgctactgtttgcttttccaagtctataaatacttgattcgtgcattcttttgaggtttcatagttgaattcagtgggatagttggggtggagcatgcttagtccatcttacctgcagttagaatggccaggggtgtttcttgaaagctacttagaaaacaaatgtgggaaggaattagcagaatgcatctttgcatcctgtatactatgttgtgtatcctatattatggtaaaagtttggttagataacagaggaaaataaaggaggttttcattgttgatagcactatgtcctaaccttcatctgaggttactgggagagaaaggaaagtgttacagctaattgcttgaatgactcaactgcagtaatatatagtaagctgctattaatgatgcagtatagcttgcctcctgtggatgttattttctttccataggagataaacattgagaatcacagacttcccaaaatccaaacactttaccgtgacattcaagatccattcaagttcctactgatttttcttctaccatcctttcccatcagtcccttttcatacactttattttcaagccatctcacagatttctatactggcacctttcacatttccaccatttcgaatgtactctttctctgttagttctctctcactttttttcatttattagaaatccagttttattgttcaatagccaattctctgtgaaaccatttgtacatgttattttttattacatttatttatttatgtatttatttatttatcagacagagtctcactctgtctcccaggctggagtgcagtggcgtgatctcggctcactgcaacctccacctcccaggttcaagtgattattatgcctcagcctcccgagtagctgggattacaggcatgcaccaccatgtccagctgatttttttgtatttttaatagagacagtgtttcaccatgttggccaggctggtttcaaactactgacctcaagtgatctgcccgccttggcctcccaaagtgctaagtttacaggcgtgaaccaccacacccagcctttattactcttaattgcagttggtgtataagtctttcataccagaccaaactcctggaggggtagaggactgtgatttatcatctttttataccttgctgtaataaagtatacctgtaataaatttttgagtggatcagggaaaagaaaggaagtgttcatgatttagttaatgttaaagggatatgatgggtggaacatcaaatagttgaattacataagagagtggaaaacaaaggcaagtactgtttaaatggaattaggaactaatgttttgggaaatatgtttcgatgactttgagtgttggcaataatacttggaaattcattttttctgatctttttattatatacagtttttcttccagtagggcagattttttttttctctagtcttttctcttctgagggccagctgccacctcctataaggtagagtttttctaccttgtgctgtccagatgtttctttttatttgaatttatttatttactcttttacacaaaagaggcatgccaacagctgcactaagtgttctttcctaagccagccagatgtttggacttggagaaaagttagattttgaaataaaagacaggtggattatagcccttcattcaaccattcagtttttccttgcctattgctgctgccaggtagggtgtctttaacccgtctttatagtacctcttgtcacaaatttagttccagaaattaaaggactaactcctcctgaaatctctatgagatgaaatgagccttctttttttttttttttttgagatggagtcttgctctgtctcccaggctggcgtgcagtggcatgatctcggctcatgcaacctccgcctcctgggttcaagtgattctcctacctcagcctcccgagtagttaggattacaagtgcgtgccacgacatccagctaatttttatatttttagtagagatggggttttgccatgttggccaggctggtctcaaactgctgacctcaggtgatccacccgcctcggcctcccaaagtgctgggattacaggcatgagccaccacacccagctgaaatgaaccttcttacagactagattctatgtggttgtcctagtatgaggctggtaagcttgctgacatcatgcttgggttttcatctgatgaggttcagctggtggcccagcatagcgtatcaggctccctgtgtatgacagtgccgctggagatgggtcattcttcgactagtaggtgatttgatctcccctgatacatttatgttttttcacattttgggctctgattctcccccttacatgggcttcaattccaaggaaggtaggagttgagatacaggtacccttctgtttttcaatcctgctactcttgctgtgtttatctgagtgtggttctcttatactctgtaaactaagtccctaaagaggaacttctgttcctggtagctggacctacttaaggagttgcaggtaaattcagtgaatggcatagtcactttgggtctttaactattgagttaaaatatctttggccaggtgcggtggctcatgcctgtaatcccagcattttgggatgctgaggtgggtggatcatttgagggtcaggagtttgagactagcctgaccaacatggtgaaaccccgtctctactaaaaatacaaaaaaaaattagctagctgtggtggtgcacgcctgtagtcccagctacttgggaggctgaggcatgagaattgtttgcacgtgggaggcagagattgcagtgagctgagattgcgccactgtactccagcctgggtgacagagcgagactctgcatccacaaaaaaaaaaaaataaaaaaaaaaaataaaaatctttattaattattagtcttggatgaataggaagaaataaaaattgtttcttgagctccttcaaagtacttattctgtcttcgggtatagaatgattttcttttttgggaaatggggagaaagaatatttatttttgaagagaaaataaaacacttctagacatttttgttttctttttgttgttgttgtttgtttggttttgagtcagggtcttgctctgtcacccaggctaaagtgtagtggcacgaccatagctcactgcaacttccaactcatgggctcatgcaatcattctgcctcagcctcccaagcagctgggattacaggtgccagccaccatgtctggctaattaagagaaatttttttttttttttgtagagatggggcctctgtgttgcccaagctggtctggaactcctgggctcaaatgatcctcccatcttggcctccgaaagtgttgggtttacaggcatgagccaccatgcccggccccagatatttctgatgtctttaaatttcataccactgcttggtgaaaaatgactgtgctaaggaaaacttcttgagctccgtaactgcttttcatgattaccttcaatgtctgggagctaactataccaggaagcttttgagtggttgattttgctgctatttgtaatactcatctgatagtttttggtaagaaactaaacagccatataccgtaaatcaagagctgtcctgtcttttgggatcccagcaaaaatattggataatgtgggaaatggaatctgagcccagaaagccagcttttagagtttctaggaatgccatgatgtctgcatagatactaggagaaagatactcaccattaagatacataaatagaggaatggctgtagtaatttaggactggtatgatcactttcatgtactcatttttatatcatattagatgctcactagattagttgatgcttttcatgacagtcttaaaaataagttttaactgattaattgtagaaaactatgttcttgtttataatctttgatttttaaattaaaaatacatacactatatatttcctatgttaagaaatgaaaaaatttaaaagtcctgacttataattaaggctgttgggatgagccagacttcatcttcctgtcccaaattcccagggatgagaaaaagttgaagagaaaagacctaaagataaacaacaaaccagaattttgatggaaaatggtaaagagtactcatgggatcctggaaatgctggtcctggaaacagtgaggaattttgcaagagagatggctgatgggatcatgccccaggaaaccccagtctgaaacacagataggagaggatggctgcaaagatgggagcagctccagaggagacagccttgagcacaagaagtgacatccagctaggtgattcttccacactcagtgtccatgagggagcagatgattcgtaaacaggtagagccatatcttggaattctttagtagttaaaaagactgaggtggatctctgtatatcaacagagaacatctctaagacattaaaaatggaaagagaacttgtgtaaggacacatatggtataatgataccattaatggtaaaagaatcccaacctaaaatatctttatagttacctatgtaaaagcatacagcataggttctcaacagtggcattgttcacattatgggttagaggactctgtcatgggcgactgtcctgcacactagagggtttttagcagcatccctggcgtcttaccctctagatactagtcgtgtcccctcaggccccagtagtgacagccaaaactatctacagacattgccaactgtgtcctgggggacaaaattgctccaagttgggatcccttggcatatattgaagtctaataatgcatattcacctgttaagtgattaccggagagagacattgtaatggggacaggtgtggtcagtggagttgttagctttattttgaataagaatgtttaggtataacggtagggcgcagtggctcacgcctgtaatcccagcactttggaaggccaaggcaggcagatcatgaggttaggagatggagaccatcctggctaagatggtgaaacccatctctactaaaaatacaaaaaaatagctgggcatggtgacatacacctgtagtccctgcgactcaggaggctgaggcaggagaatcgcttgaacccaggaggtggaggttgcggtgagccaagattgcaccattgcactccagcctgggcgacagagtgagactccgtctcaaaaaaaaaaaaaaagtttagctattacatatatttacatatattacatgtaattaaaaacaaaacaaaagatagttttgcttttttttttttgagacagagtctcactctatcgcccaggctggagtgcgctggtgcaatctcggcagctcgctgcaatctctgcctcctgggttcaagtgattcttgtgcctcagtctcccaagcagctgggaccatagatatgcgccaccacactcggctaattttttgtatttttagcagagatggggttttgccatgctggccaggctgatctcaaactcctggcctcaagcgatctgcctgcctccacctcccaaagtgctgggattacaggcgtgagccaccgcaccggccagctttgcttttttataagatatctgttgtattaaatttaaaaatggttaatggtggctgggcgcggtggctcatgcctgtaatcccagcactttgggaggccgaggcagacggatcacggggtcaggagtttgagaccagcctgaccaacatggtgaaaccccgtctccactaaaactacaaaaattagccaggtgttgtggcacatgcctgtaatcccagctactcaggaggctgaggcaggagaatcacttgaacccaagaggcggaggttgcagtgagccaagatcgtgccactgcactccagcctaggcaacagagtgagactctgtctcaaaaaaaaaaaaaaatggttaatagttagaagaaatacaggtagcttacaaacgtgcaaatgtgcccaaactcactaataaccaggaaaatgcgaattaaaaaaatgaatcatttttctccattacattaataaaattagaaagataaatcatgttcagtgatggtgtagtgttgggaaattaatctctaatagtagtgtaagttgacctaagattttaaatgtgtagtttgtggtatttgtatttaaattaaatatttttcttatagaaatatacatatgtatgcagattggcatgtttagggaagcttattgcagcgcacaatacctgcaaattggaaccatgtccaatactaggagaatggttaaataagttatggttcatctagattactagaaatactgggtagcagttaaaaattatgaggtagaattctaaaaaaaaaaaaaactgagtgataaaattagttgtagaataaaatgtagtgtgattcagtttataccaagaaaaatcttaaacatgaaataaaactctgcacctttatttctgcatatccatatgaaaatgcttaggtaagtttggaaggacacatgcaaaactgatcatggctggataacaggaaatgggactaggagcctttaaaacggggcagggaataatggttatctggtatctatactgcttaagctttttttctttttaaccaaaggagtaactcatacattacttgggtaattacaataaaattgaaaaatgtaagaacatctaaatgacttgctttatatgcatagtgtcatcatttagtggcctgtgttgagcagtgatagctgctgctggggctctggtagggctttaagatcccatgacttttggtggctctccatattttgtggaattggcattagctgttcatatggtttggaaacacttttttaaaaatattgatttcagtggagattatttcccaaccctattcctagaatttcactctgttattgcttcagaaagatgtattcagaaatatatgcctgtgtatttatgacttcatcactagactttgaatgcatgtgtgatagctttctctttagtaagtggaaattaatcttaaagattgcaagctagagctgagcccacactcttactggtattttcttgtttcctcccctaacctaacttgtcatagtttttcttaggtagtattatttatttctttttttactacgtagtgacattcttcaaatgtatactttcactctggcttgtccgtaattggctggaaattgtgatggatctatatagttttttttgtgtttttaataaaatctgtataacataaagtttactattttgctcattttatttcatttatttaattattattttatatttttacagatggggtcacactgtgttgcccaggttggactcgaactcctgggcttgagtgatcctcctgcctcagcctcctaagccgtggggactacaggaactgggccactgcacacggcagttttagtctttttattttttattttttgagacagggtctcactctgttagccaggatggagtgcagtggtggaatcacagctcactgccaccttagcctccacttgggaagcctcttgggtctgccactgcttgtcagaaactttttactctgaattatgtcatatctcaggtgtttttacctagttattttgcacattacccttctcaaaggcatttgttcaagtttttcctaagctaatgaaggaaaacaaacctgagtcatctcttggctgtcactctgcctctcctactctttacatccagccatatgtacagtcctcaccccacccaccccacccctactctactttttcctctgctttattccgcagtcctttcatttgtggtctggtacccaccagctacactgacatgactcttgctaaggttttgcttgaatacttgatgtctcctttctctctgtcattcctccccttctcccttgatgcttctactaaggggtcagtggtatgagaagatagttctcctcctgctggttttcattattttgttgtttactgtatcgtcaggaatgcatgcttgcaagacaaagactaaaacaaaaaacaaaaaacccaaacagcaaaaaaaccccaaaacacctttgttttggttccgagatcgattcagtattagttcccttttgtgaaatgaaaacaggattgtagaaaatgggctgggaattttgcaactggcaaaaacgtattctctttttttcctgtagtttaaaattttaccactttgaaaatcatgtaagttatcttagaagaaaaatagtagtccactaattctaccatccaaaataaccatgaataaatatgtcttggtgctacacatgtagtttttcaaaatggaatcaaagcgaatctttaaaaaaaatcattttgttttctatgatcaaattgcctttctgggaaaggacatgccagaatgttagttttttaaaacttataaaagtatctttagatactttgaatgaaatagaaagagttctattctttttttttttagaaataggattttatctggttgtttgattttttttttttttttcagttattcaaatgaagattgatgcagttggctttcctttaaccttttagtctttcagggtaattttctttctttttttttttgagactcccaacaagtttattattttttaaattgtggtaaaatgcttataaggaaacttgccatcttaactatttttaagtgtacagttcagtggcattaagtacattcacattgttgtgcagccatcactataatctatctccagaactctcttcatattccaaactgaaactctgtacccatttaacagtaactccccattccaggctcgccacagtctctggcaaccactattctactttcaggataattttcattggttagtaatgtttggataatttgattagatttggtggatactgaagactggccgggttatgtaagctgttgctactttcagccaaggagtgcatctagtccgtattacatcatccttggagtgttctacccagtgtcttgcattgaaggacatcagaaggaaaactcctgtattctcagtcgtggtaaatagtgtccacttcattacagatctccttgagtgataggtttcaaaatatctctaggcatgaagaaacatttccaaacctgcttgtcttctctacctttctcagtatgtactagtttagaaggtattcaaaatgtttcactgagaccattgagttttatgctaaatataacatctggcctagcactttttatcactcatatgcaatctatttgataaggacagggaccaaatagaatgtctttttcaatgtattttaggcatctaattgactaatatgaaattttctattaatccagagtttttaaatgcaggcataattcccccccaccccgcccgcaaagattcagtcttgctctgttgcccaggctggagtgcagtggcctgatcggctcactgcaacctctgcctcccaggttcagcaattctcctgcctcagcctcccgagtagctgggattacaggcatgcaccattacgcccaggtaatttttcttttgtattttttggtagagacagggtttcaccatgttggtcaggctggtcttgaacccctgaccttgtgatccacccgcctcggcctcccaaagtgctgggattgcaggcgtgagctactgcacctggctgcaggcatactttttaacctatttatatccaaacatttaaatttattttttatttttattatttttaatatttttatcattgtatatgtttatttatattattatttcaaattgtttattaggtatgaattttacaaactttacttatattagcggtaacggtggagcgggagagtattgcgccttctccaagctccccggcgagaaccaccaatagtgtggtggaacttacggccgtttccaagggccagggctcttttggcctgcagatgtcagcccacacatctccctgtgctgtggactgatttggtgatccattaggtgtcaggatttcttctgatagctttatggaatggatcagtgaggataacctcaaaaaatttgtatgtggaatcttcaccaacccagtaagaattcaggactctcaaagccccacagtggcgtccagcttgctcctctgcaacggactgaaggcttggagcaaactttagctggttaacaccatgatggacaggcttgccataagttgcacccttaggaactgggcgttttcggccaccacggcaaacacgaatcctatatataacgtaaccttgcttggcctcgcagcccagtcagcgcgctttatcaggctgggtggggcggagagccctgtggagagcagagagctggcggtactgccagcagcggaccctcagaagaaagcgcatgacatcagactgctgctttctccgtagctcctggatgtactcgtatgcacccatcttggcttacctgatggctgctgccagacggaagaaaagaagtttaatttattttttaaaagttaataaagaagatgatttttctcagtcctgtaagatgaaaaacacatctgttgttctagttatttggaaattaggctcatacgggtaatagttgatgctagtaatttttctctgaagaataaaataattcaaaatagaaaactaaatgcttggctgggcgcggtggctcacacctgtaatcccagcactttgggaggctgaggtaggcggatcacctgaggtcgggagttcgagaccagcctgacccacatggagaaaccctatctctactaaaaatacaaagttagccggggttggtggcgcatgcctgtaatcccagctacttgggaaggctgaggcaggagaatcgcttgaacctgggaggtggaggttgcgatgagccgagatcgcgccattgcactccagcctgggcaagagcaaaaactctgtctcaaaaaaaaaaccaaacaaacagaaaacaaaacaaaacaaaaaaaaccctaaatgcttgatgggaaagctaataatctgctttaaaaatctctattggttttctgagaacggagaagtttatgaagacaaactatacttagtgttagtatttaaaatgctttacttttctttttgaaacatatagccagtaaatcctgcttagttgattagtgtacctcagtttaaactttccatggttgttatgtatttcctttgccattaaaatatataaaaaggaatttatatttttcaagatgttgaaatttttgaaacaaatatatctactcagcctatgcaatattaagtcattctgcagaatagcatctgcattgcttgaatattgtttgtttgttttgtattattaagccaaaaaaaacacctcacacatttcatacaacaatgacaacaaaattgaaatagagtttcaaaagtttgttagattgttctttccaggttgactcttaagtgtctctttaactaaggcagtagagaattcaaatgttttcttttgcatggccttttgctactagtgaccctgggctagactgtgggcttgttgagatgtgaatgtaccctgccccctgaagtaagatttgttcctgcaaatggaggaaaagaagccaaccaatcctttataaacaatttgtgtttagtccttctttgtaaagtccatagcagttttgacctgcttttaatgcatgatttattcaattgtttattggagcactcttttttttttttttttaaactggaacaatcttaatcacccagtaaaatatattaggctctgagctagttcttgataggtttattttatttatttatttatttttttgagacagagtctcactctgttgcccaggctggagtgcagtggcgcaatctcggctcactgcaagctccgcctcccgggttcacgccattctcctgcctcagcctcccgagtagctgggactacaggcgtccgccaccacgcctggctaattttttgtgtttttagtagaaacggggtttcaccatgttagccaggatggtctcggtctcctgacctcgtgatccgcccacctcagcctcccaaagtgctgggattacaggcatgagccaccgcgcccggcctagttcttggtatgtttataaaacgtttgtgataacataggaaaaatgtctattatgctagttaaaaaacaaaagggtgaaaattatatatgcggtatcattacgaaagtgtatttagagaaaagactaaaaatgtcaatactattaggattctctctctcctttttacttttgaatgcatgttcattatagaaattttggacacataaacacatgtgcctatgtgtatcttttaatttcttttccttgataaaccaccaattgccatatgtattgccaagattaagaagactttatgtaggtgtagatttttaccttaaacataatgaaaaaaaaataataaaagttgcaactttttgtacctcaaagacaatggcttttaacatttgataatgaaagttattaagcaagctgctatccaagtgtatctatgagtaaatagctttaatcacataacattgggctaggggagattaaaaaaagaatttaaggcgtaaccttatgatctggtggaggagaaattgtaactgtgcaaagcagttaaaatgagattgttgggtagatgagattatatgctaaaatctgcactaactactctcagagtttagattagaggagattcatcctaaattgaagtacttgggaaagatccagtggtagatgtgaaacttggagtccatcttctataataggtggtatctgaggacaataaaacaagtgtggatttaagtttaaacaaagacttaaatgtattctttttaaaggattgtgaagtactcaatttctttcttacagaagaaaactacaatcacaattacaacaacaaaattgacagtaacaggatctgaagtggacagagggcaatagggcaatagaggagggggcatcctggtctgagggcagaagagcaacttgaggttgggggcataccaggcaacgataaccacgaggaaggccttgctttgaacacagggatatttagaagccctttgcaagcagggctgcttttccctacaattggtattattaaataattaccgaatgtatatatttggatattttatagtaagatattgacctgaaaatcccttgggcatttacctgatcttttacctttcaatactcaatataattttttactaaagtggaaaatatttattgaattgacaaagagaattcttagctttctaaaagactacttttttagttttttaagatctcatttaaaacaaagtatttaaaaattatttcataactgaagactctaacagaaatactcaggtatttgccacctttgacttttttttttggtagaaggtgggtcataaatgtttaggtatatgtttgtgttccagtttttatatctgccttgcaaaataattgtaatctggaagtttctgaaactggaaagccattaggaaattaggaaaagtcatttaaaaagatagtaatcctttcatcagttaaaaagaatagactccttttagaactaagcagtttactctttttcatattgaatgcttagcttctattatgcaaaataaatagatttaaacattatagagtgagtagtcttaaaaatggagcatacattcctgaattttgagtagctttagaacttaatacacatatcatttcttttaggaataaatgtaaaatggatgaagattgaatgtgagagtatttaaatgattctcaagattttctggttcatgtgttgtgatattgaactctttctttcgtcttaggctttaatttgtgcctggtgctgacctgatgctgtgcagggacactcactgcatccctccattcagtccctctaattatcccaacttcctggggagcttgcttagaactgggcatgagtgctctttattaaaatattgggctaccctggctacatgtaacaaggtagtttttgatatcaaatttatgtattgatgaacggaataggaagctaaaattgtttgctgtgattttacataaagagataggggatattatggaaattatttggttagacaatgaattaggctgtaataaatgaaatcatggttaatagagttcctgagtttatttgttgcattgttgctttttagtgcatactcaaaaagaaatacgactctataaatgataggcagaacaatcagatttgcaattttgtgtgtatttgcagatgatggtaattctttttgctgggcgcatctgttaatgcagaaatttgtctcctcaggttcatgtgaaaatggcggatgaggctgtctgtgttggcccagctcccaccagtaaaagctacctcaacatggatgccatcatggaagccattaagaaaaccagggcccaagctgtgagtctgaatgaatctatctactgcagctgtttcatatgtagtgagcagaaagctagagtttgtatttaaaaaaaaaaataggaaagaatgattgaaaatgctgttgcagttagttcatgtcacatgagttaaatgtggtcgaattcgctactggaaatcaaaggctttgtagcatctggcagtgttggttgctgatcctgcaggtggctgctggattcagctttcacaccagggagcagtttcagttcatttccaaatttgctaggaaaaaagaaatcccaattagttttgagtattaaccctttccgtgtaataagagcattttaaaaaattctgtgttataaacaggatccaaagactgtgttcaaattccattttaataatttaaaaattacttatacctagtacacttccagaaataaaaacagcacatttggtaattattttagtttgttaatgtcagtagaatgctcataatttacaaggataaatcattctctccacccccagttctgtttgaatagagtggaatccaaggaaaaaaatgatttctgatatcagaaacagtgttttttcttctattttcttttttctttttttaattatcagaactaattatatatagtgttaaaaactatgcaaagttatctctaaaactggatggaaacatccaacaccagcaattaagcctggagcgcttcaattagcgctcacatttcttttgaaagaaatgttttagtaagatgaatgtttaaataaaaagcctaattcgtgaacccatattatagatgtttacagtttattagcacagttagtgaaggtaaaacactttaaccttttaactatagcttgccaaaataaatatgtagttgagtgttgataaaatgaagttggtggaatgaaaactcttcttctctgatacagtagtttaaattcttctgtaccatgctcataaagcttagttcagctttttttttgttttgttttttgagatggagtttcgctcttgttgcccaggccagagtgcgatggcgtgatcttggctcactgcaacctctgtcccgccaggttcaagcgattctcttgcctcagcctcccaagtagctgggattacaggtgcctgccaccatgcccagctaattttgtatttttagtagagaaggggtttcaccatgttggtcaggctggtcttgaactcctgacctcaggtgatctgcctgcctcagccttctaaactgctgggattacaggcaggagccactgtgcccagcccgagttcagcatttaaaagtcgctgatacgtagctatttctggattatgatactggttcctttagaaatttgactctctttttagcagaattattttactagaagtatgttcaacactggctgatactgaagtggcgaaatttatgtttggccagtctgggagagccaaaaattacttgattggatcaggctggtagattgtagcaatgtggcttgtgggtgaggatagtataaagtagttgtggatggcaaagtttggggtgaggaaggaaagaagagtagacattagaagaaaaaaaattcagagcacaaaataaaagtaaaaccacacctccattttagttcagtttgatagaaacggcttgttggtagttgccgagtattattaatgccatcaggaataaaatgtgttagctgtcctagtagtctgggttttggaaattaccagttcgtgagtactgtaaagaaaggagaatttagagtttttcatccatctttgccaaggttccttttacataattctttgatgcaccagccattgtgaaattctccagaattgtgggcaaagttagcctcaggaaaaggagagagagttttgttgaatagtgtagacaaatgccagtgggcaggaagctatgtgggcatatactccccattgtggttaggacaaaggtagtgtgtggaaaatgaatcagttaggacaaagggagtgtggagaaagtaaatataagaggcagtttcttggaatttgattctgatcctagaaatgtgagttagaactgatcagtgtataagagaagtgtacttattcaagggctcttgaacagtaaatattaatacataaatgcactgtacattttgcttataaagcttttgcaatatgataaaattgaaagtgctttttgctttcatttctaaggtacatccaggttatggattcctttcagaaaacaaagaatttgccagatgtttggtaagttggtaatgaaccagaaactgttcatttctttttcagaaagcagtgtggtagcatggctttgtaaatgtgggtagtgatggattatagaattttaattaacccagcagttctttgaaaattgtgacaagtgaagtggttttagtctgaaactcaactgtttatttgaagagtaattataaaaacagaaaagtttacaaaatcaccattacactgaatgaatgatacctggtttattatatactgcatgatatttgaattaaagttaaaaacttcagatttttaactgtaaatatgttagggagtttagtgagttattgtagtgatttaattattttgtggcatttaatatcaaatcttaccaatgcctctattttgggtgaagttgtttttaatgatctaaatgtccccttccagctaggtgaattaacgtatgtttgttattaaattgatttttccaggtatatttataacttcattcaagatggtactgaaaccttattttttaggtactagaatatgattttgattaatgtttgtacatatgtttgttattagatcaattatgccaggtactatcttaatttattctaatatgttatacttgtttctgtggcatacagtcatgtgttgcttaacagcgtgaatacattctgagaaatgcatcattaggcgagttcatccttgtgtgaacatcacagagtctacttacagaaatctacatggtagagtctcccacacacttaggctaagtgtgttatagcctattgctcctaggctacaaacctatacgtgttgctgtactggatcctgtaggctgttgtaatacagtggtagatatttgtgtatctaaacatgtaaacagggaagatacagttaaaaatacagtattagaatctatggaaccactgtcatacgtgtggtgcctcattgaaatattctgtggagcataactgtactcgtattctgttcttccacggattggaaattatttgtgaatgttgttattttctagatggaatttccacttaaaatctataactttaacttgaaacaattattaagatcacagaattgtctatttgaaccaccttgctttgtgggtccaaaactaaggcctaaagagatatcctgagggggcaaattacatggacacatccagaggttccagtttcccaggttttatgcagcatatctacatttttttgtttatatccctttttattttttatcttccttggaattttgaccaagattctgttattataaaaactatttgaatataatacttaaatttagatgtgtatgtgtgtatatatataatgtaatgtattacatttaagtccgtatagatgagaggtcggcacactacagtccacaggacaaatgcagcctgctgcctgtttttgtcaataaaattttattgaaacacagccatgctctttcatttatgcattgtctatgctgcttttgtcctgtgacagcagagttgagtagttgtgacagagaccatttggcctatcaagcctaaaatactttttctatggtcctttatacaaaaagtttgggaactcctgctataaatgaatatccaaatccaaattatatgagtaggataagtgatgtggtgccagtattatacatttattcctatacagttaatacatttatttattttatatattatatataatattatatacagtttatgcattttttcagttattaaaaaaatgctgcctttttttttttttttttttttttttttgagacatagccttgctctgtcacccaggctggaatgtagtggcatgatctcggctcactgcaacctctgtctcctgggttcaagctattctgcctcagcctcctgagtagctgggattacaggcacacaccaccacgcctggctaatttttgtatttttagtagagacggggtttcaccattttagtcaggctggtcttgaactcctgatgtcgtgatccgcccacctcagcttcccaaagtgctgggattacaggcgtgagccactgtgtctggccaaaaaatgcttctttaaagtctgtttaaggcctttgagaaggatatattaataaaaatgaatccaatctggttcccgcgcagaatgctgcagtccatgggtgctatgagtcctgggtgctcatagtcatgttacggaaaataagttgatacacaaataacttcacttcagggaagaaaatactgtgagataagatcaatatctttgtaaatgaaagtaagaaggatgatttccatctggggttctacattagagaaaaacctgtagaatatacaacctcctcctttctttcacacgagttttctttccaaacctatttccccatttcccttttatcagtgctgtgcctccacccagcctgactgtgcgctgctcccatgcgtggctggctctgccctcagtgctttcctcactctctctgggtgggtgtgcctggcctcccacccaccgtgtctaactgctgcctgcccttgaaggcacagttcatatgcagcctctgcggggaaagggttctagatccttctgttgagaagtaatttctttccttggactttttgtttcagtttgattggaatgtttttgtttttggaaaaatgatttgtgctttatctgatacattgtttttacttaatatccaggactaaaatgattttttgattttttttgcataactgctgtgtatttgctttagaaagtgtacaataggccaaattcccccaatgtaaaaacacaccaaactttacaagactgataattttttatgctgagtttacgcgaagtgggattggattttatacagtccctgctgtccatgacttgaaaaagatcatgtgggccgggcgcggtggctcatgcctgtaatccctgcactttgggaggctgaggtgggcagatcacttgaggtcaggaattcgagaccagcttggacaacatggcgaaaccccatctctactaaaaacataaaaattggccaggtatggtggcacgagcctttgatcccagctacgtgggtggctgaggcaggagaatcgtttgagcccgggaggtggaggttgcagtgagctgagatcacgctactgcactccagcctaggcaacagagcgagactctgtctaaaaaagaaaaaaaaaaaaagatcatgtctttttgttattgcttagatagttcatagaaaaaacaaagctacacataatcctcataaaaatagcaattttcaataattttaatgtgctgagctaacagattttatttccaagctgttttctattctgtattttccctgcaggcttcttttattatgagcattaaaggaccatccatgggagactatgaggattgttaggatgaggcaaagacatcttaacagagtttacaaagagctttgaaacgtgaaactaccttctctggaaaaatgggatgttggcttgaagatatttcttagtattctgtgttttctttctggtttttctatgttgttttaatcatattatcataccttgtcatttcaggtaacatagcataagttatagtaattagtttcaagagaaacatatgttagaatttgtgttttgtgtttggatcctatctgtgtacttgaaagatacacgtatatgtagatggatagtgagttccatcaggatgctcagcgttgaaagcataggagggaactgtgctgagcgtgtgaggtttggcgattgtgctcttttatcttctttctttcttgagtttttagcaagataagacatgtaactactgtaaaatgagaggtaatttttaaaatagccactgggttaaccaaaaaccttttaaatagctgtggcatccagtgtgggcaagggtcacatagttttgttcctggaagtgtaaattgtttcagacctcccccggcccccagaaatttgctagtatttatcaaaatttaaaacatctatatgttctttaatttaacagttccacccttaagaatctcacttacaaagatatacttgagaaaatgttcatggtaaggtgtttcataatagcaaaatttagaaagtgttcaaaagtaaaatgtggagaatggtggcttccctgcagggtcattggtcctcagttacaaggctgcagtccatgatgtgttatagtttaaagtgtgttgtaagcactttgtaactaatactaaaattctgaagttagcaagtttgccagtgactttgtttaacaatttttttgtttataaaataaagtggattaaaaatgatccatatgatactctactcattcatatttggactttttttttatttgagtaggaaaaaataggagagacttagaccttgcaagcccagggttgtttataactcttattttcactatatgggctataatctgcatagctcatggaaatacattatttttatatatcgcagcttaagaagggttgagaattgttactgtagtgtattttgtgtagacatcattttaatgacataaattttcttattaacattattatattttccattttggacacagacctttgattttagtatcttaaaatttttaatttttgagaatgtaaaatgctaagaaatttaagcacatgaaaacattgaaaattaggatttctttccatctttgaaccttcgaaacaagaccccaatttaagtctttagaggtcaccactgttaccttctggagcatgtgtgtctgtatgtgtgtgtgtgtgtgtgtgtgtgtgtgtgtctgtctgtctgcgtgtgctagaattttgctatcatttgttttgtaagatactcttagttgcttaagtaggacttactttttttatatgaaaagaagtggcatagaacttttcttatataagaaaacagtggtccctaggcttttaaaaataagtatggaatacctacctgcaggtaagttatttaatctttatgacaacttatgatgtattcttatttttattcttggttttatggaagagagaacaatctctgaaagtttaaataaatgccttgtccagtgtcacatagctggtaaatgagagagtatggatccgttgtttagtatatgttccagactgactctcagatgcattggaactgggctgggccgttagtggtatttgtttttgatcgatagctttagctggcatctgttcttgctgttggtggaggcttctctctttctgcttccttcccctcttccccattggtgtatcatcatagagatctaaaaagtagagttgtttcttttgtttttctcatcttgtaacttggatgccagtgaaggcaaatcctcacttggatttgctaacttactaagtaaggtaactgagtgagctttgctcagttaactgagtgccagagctacagcatagagatattgatgcctttaaccactcgttgatattcttaagtggaactaataaagtctccctggatttggaggagaaagttctgtgactcctttttccttttcataataattttataatatttttctagttgtgacttgtacatatgtgatgttcaaaagaattgataagaactaatgaatgcaacttcataaaacccttattatgacagaatatcttttgaaatgtttgagaacgtttcctttcctatatgttggcttaaggtcagcttttagaatatttgaagattttgaatgcgatgtggaatactaaatgctctaaagtgaatgcctgaaaaaggaaaactctccctttacagttagggagtcttttaaggatgtagataggtcagatacttttagggcttgtgggattttggggagtggtttcaataggaaaagtctgggatttgatgaggctgggatttttttccctttgcttgaggttaaaacagattgaagtgttacgttctagttttcctattacgctctctccttactgccctatgtatctattagctcattctggagtcagaatgacagctaaattctttctctgccacttagtagctgtgtgatcttggacaggttgtttaatgtcggcctctgaagattgtgttttattcttactatttgcatgatatgtatttctccatctgtgattttatgttgaaaatactgtgtgtttcttgtagccaggatgtagttgtgtcatgcttttgaaataattctgatggtctctatttttaaattgtagtgtttagactatgaagttttttcttctttagtttgccttagtgtattttcttaaatagcagctttattgagatttaattcatgtgtcatcaggctcaccctttaaaagtatacaattgagtgatttgtagtatagtcacagagttatgtaaccatcactgctatgcaatgtcagtaaaatccattaacatttaataaatgatcaaggtggttggatttatgtctagcattttattatttgttttctctcagtctcccctttttttccttctgttttccttttctgacttggattattttagtaatttttgaaattccattaaaatttatctattggatctatctatttttcagtgttttttctaggattgcaatatccatcctaacatttcatattctagttagagctaatatgataccatttcaagtaaaatgtagaaattttgcgatcatatagtccatcctccttctcttcccatcactatcctctatgttatagttgtcatatgtatttcatctgcatgtattataaattctatgtgaaaatgttataattttgttataaacatgttgaggtgagttaggacatttctttaaattgatctgtcaaatttaaaatatagagacaaatctctagattaaatattttatttgagaatcacagaattggaatttgagacatacacatggggtcttcagtatatccaaggaacaaagagaaggttgaaggttttattagatagaaaaaaaatgttactgattattttgaaagaaagttcattggtacttgaaaagctttgggagctggcaggctcggataggagagtggcagtggtagtttaaaaactagtcttagagtgatagcaggttgtttcagcagttactaggtaaagctggtcttagggttacagcaggctgtttcagcaactgggcctctggatagttcagttcttggagcctgtgctatgtgccctgagtgcttttttcccctgactccttgactcttatgtagttgggtatacaagaatgacccaattcatgtaatcaactttcacagatccaaatatcattcagttgaaattaagactcattttattttggtccatttaaaaaatgttgtcttttaaaattacatatgtatttttattgtggtaaagcagacataacataaaatttaccctttcaccaattttaagagtgtggctcagtggctttaattttattcacaatgttttgcaatcatcagctccagaactttataatcaccccaaactgaaactgtacatattaaacactaattccccatttcccacctactcctagcccctggtaaccttccttttactttctgtctctgtgagtttacctattctaggtacctcacataagtggaatcatataagatttgttcttttatgtctggcttatttcactcagcataatattttcaaggttcatccaagttccttcctctttaagactgaataatagtctactctgtggatataccatattttgtttcttcatcacctgttgatggacatttgggctgtttgtaccttttggctgttgtgaataatgctgctatgaacactggtgtataagtatctgtttgggtccctgcttttgcttctttttagtatatagctaggagaggaattgctgggtcctatggtaattctatgtttaactttttgaggttctgccctactgttttccatagtggctgtaccatttctcattcccattgttttattgtttttaataaccaccaaatcatgcctttccttaatgcaagctctgggtaattagttgactcattggatatttgtaatgtccgctttacataagtttaagaggtttaatttgacagtatcttcctaaccaatatgtttatgcttgttagtctagtgttactgccagagacctattgcacagacttgtgggagtattaatattttttcccctcacattttctttaatgaaaaatttaagaaatacagaaaagtttgaagaattgtactactacaaatgccagtagattctataattaacattttcttatttgtttttaacatatttattcatttgtgttttcctctactcatctatcaatctcattttcattttgcacgtcaacttaagttgtagataatagtacaattcactctcctgtacacttcagcatgcagtttttaaagcagagttcaggccaggtgtggtatcttacacctataatcccatcactttgggaggccgagataggaggatcacttgaggccagaagtttgagggtgtagcgagctatgaatccagcctgggtgacagagcaagaccctgtctcaaaaaaataaataagtaaataagtacaataaaaaaataaaccagagttcattattcatttacagcttttccaagaaagccttattgaaatataattgctattcaataaagtgcacatatataagaaattaattgtacacttatatgtgtacacttatgaaatcataatcacaatcagaataaagaatgtatccttcaactccaaagacttcctggtgctccttcgctggctctttcggccacttcctagccttcctcttcccctttaggcaactactgatctgttttcttatcatagattattttgcatttactagaattttatataggtggaataacacaagttatgctgttttttggatttttttttcacccagcaaaattattttgaaattgatgcatgtaattgtgtcagtacttcattccctgttttgttttgttttgttttggagacagagtttcccctcttttgcccaggctagagtgcagtggcacaacttccgcctcctgggctcaagtaattcttgtgcctcagcttcccaagtagctgggattacaggtgtgcaccaccatgcccagctaatttttgtatttttagtagagacgggattttgtcatgttggccaggctggtttcgaactcctggcctcaagtgagctgcctgcctcagcctcccaaagtgctgggattacaggtgtgagccaccgtgcctagcctgcattcctttttattgctgcattcatttctttttattccattgtatgggtttaccaccatatttttagtagccattcatctgttggtggacatgtgagttgtttccagcttttaactacaactagaggtgctatgaacaagtagttatgtgggcatatgctttcatttttttttggtaaatgcctaggagtggaatggctagatcatttgtatgttttatcttcttagaatctgcaaactcgttggtacaattttacatttccgccaacaatgtatgagtgtactagttgctccacattcttaccaccctttaaatttaactgttatactatgtagtgatgtcttattgtggttttgatttgcatttgtctgatgattaataatgttgagctcatttgctttatatctttgtcgatgtgtttgtgaagtcttttgtccatttttaaattgagttgcttgtcttatttagacatattagggttctttattctaggaaaaatcttttgtctggtacatgtcattgcaaatattttctcccatgatgtggttctgttttcatttactcagcagtatcttttgaagagcaacagcttttagtcttgttgaagtccaggttattaatttttttttcttttatagtttgaaccttttgagtcttaaaaatatgggccaggtgcagtggctcacacctgtaattctagcactttgggagactgaggtaggtggatctcttgagtccaagagttccagactagcctgggcaacatggtgaaaccccatctctacaaaaagtaacaaaaattagatgggcttggtggcatgcagctgtagtcctagctgcttgggaggctgaggtgggaggatcacttgagccttggagtttgaggctgcagtgagctgtggagtgttactgcagtccagcctgggtgacaaaagaagaatgtgtctcaaaataatgaattatttaaaaaaatagatatatgtaatttcttgccaaactcaaggtcactgagactttcttgttttttgttttgtatttttaatgttttatagttttagatctctgatcaattttgagttaatttttatatgtggtgtgaagtagggtctaaattaatcttttttgcatgtggctattcagtttgctatacaatctcttgaagaggttatcccttcctctttgaattgccttggcacccttgcagaaaaagtaatgggacatacatgtgcgatctcggctctctgcaagctctgcctcccgggttcatgccattctcctgcctcagcctcctgagtagctgggattataggcgcccaccaccacaactggctagataatgaactcttaaaaatactttgtccacaccccctttcatttactcccatgtattactaatcctgctgaggccgtcttggtgtgacctccttcctcaccactgaccccctcttttctctctcagaacttccttactttaacaatccagttgaacacatatgccaccttattcagcagttgaatctcaacctgagagattctagtgttcattcttcagttccacacataaccatcgtgagtaagagaggctcattcccatagaaggatgaggtttaagattgctccagtcattaacagtatacaagatgtcagatagcgttttactgggtctaagataaattaggctgtaaccaagaatatttatatatcaaaccagcctctccacacatcccaattataaattctggacaaaatagaaaaagctacataatacctatgggtaccagagagcagccacaattagacagaaataggaaggcgactacccttggaaggaggaaatggcatgggggcagtttccttttttggccttttttgaacagttcctggaatgaattctggagtgttccatgtatgcatgggtcagattccaagcactccagctgaggctaaaagaaccaaagagaattattagctgttacttatgctagtattgggggaaaatattcaagttctacctaggtgactcttgaaccccttttgaaatgtgacaacgtagcagatgctgttgatgctgctgtccaccctttctgcccggttgttagcgtcaccttaggtgaccatcccttccctgtgagtctcagtggtaaattctgactagtgaaatcctgaccaggattcattctcttccttaccaatgaccagtttatgggaggctcatggtccagtttgattcctggcaagtgaggggacctttcaagaaaaggtttcttttcattgtgtgaaataagcctttttaaaattattttaagccattgtaaactgagggtttttattgttgttgggatttttgttttgttattttaattttggccaaaactaccgggttgaaagaccagtgttttacagactgacattctattgaatcttaaaatagaatatagcttctgattcttgtgttaagctttctgaagtaatttagaaacaaaaccctctatggattacatggcaaaaaaggcatgtttcaaccataaagtaaattgttttaaaaatttcccttaatttggccaggcgcagtggctcacgcttgtaatcccagcactttcggaggccgaggtgggcggatcacctgaggtcagcagtttgagaccaacctggccaacatggtgaaaccccgtctctactaataatacaaaaattagccaggttggtggcgggtgcctgtaatcccagctactcaggaagctgaggtaggagaatcgctggaacccaggaggcagaggttgcagtgagctgagatcgtgccactacactccagcctgggcgacagagcgagactgtctcaaaaaaaaaaaaaaaaatcccttgatttatgtaaggattagtcacttttgtatgcaagtagaaggctgaactcatgctttttattttttattttattattattttttgagacggagtcttgctctgttgcccaggctagggtgcagtggcacgatcttggctcactgcaatctccgtctcccaggttcaagtgattctcctgcctcaggctcctgagtagctggaactacaggtgagcgccaccatgcctggctaatttctgtatttttttttttttttgagatggagtttcgctcttgttgcccagctggagtgcaatggtgcgatctcagttcgctacagactccgcctcccaggttcaagcaattctcctgcctcagcctcctgagtagctgggattacagatgcctaccaccttgcctggctaatttttgtatttttagtagagacggagtttcaccttgttgaccaggctggtctcaaactgctgacctcaggtgatcctcccacctcagcctccggaagtgctgggattataggcatgagccaccacacccagcctgaactcatgctttttgattcttctgtatcactcaggctttctggaggtgcttattaactctttgctagattagataagttgctgaattcaaatttagaattctggaaataaatgtagaagggatgctttgagaagcatccttgtgctttcattgtgttatgctattttaaacttacggtaacttcgtgatgtcttaaaatttattttcattgatttatttgtatgtgactcctaagcttagaattcagttggaaagatttttgtttttgttctagtgaaggaagtacattgctcgaggatttttttgggttaactgaagtaatgctagttatctctgttacatgtagttaatgattcttgttgcccccagatttgttctaaacttaaacttttaaatgcatgctttctaaaacaggcaaagaagcagaaataatgaaatgatcactggggctttgtttctgtactggtccttatttaaggatattacaatgttcctaagttaccattttgactcataatatgtgatatgctaatgttccaagcacagagtattcttttctgtatgtttccacttcccaacctacctatggtgtagcgcctgtctgtaccactacgtgtgtgcatgtgtacatgttcctagctttttattcagtcctttatgtgctagttgattgttgagtgcagataaaaataatgtgttgtatttcttaaccacaatatttgatttataaggaaatattttgataacagcatttatagtaatatatgctcttactgattagaatgccacaattgatagaaaatatattggatgtaaattagttacatatttacataatctatacacaagtaacagcatattttgtcagcatagcgtacagtagccataaaataagagtgggtgatacaatagagcattggttcccagtatgttctgtggtacctggggactcttgagaccctttcagacactctgaagtaaacaattttccataatagtttttcctgctctcattctctgaggattgtgcagtagagttttccatgtaacagtagagttatatgatatatgttatcacagcagattgaatgcaggaaccagatttgagaatccagctgtcttaagccacatgttaaagagatttgtgaaaatgtaaaacatttctactctaatgaatttgtcataaaaatgttacttctaattgttaacattaaatgggctattcttttgaaatacatttttaaaaatttcttaattttaacatggtaaatattgatatatacaacatgtataagccaaagctccttgagattgtcaatatttaaaactgtaaagcccagaaaatttgataggcactgtcctgaaaggtgactgggtagcctcttgagatagggtgatgacagtcttctctgagagtgtggcctttaagctgagattctagacagaatgagcatgcctcctctgactactatgccccactccacttccacattcttttttagccttagtataattacttccatgtcaagtcaaggacttttactcattcatttctgaattcctgttgcttaccactttacttactagtcattaataattctttacggccagacgcagtggcctacgcctgtaatcctagcagttcgggaggctgaagccagaggatcacttgagtccaggagttcaagaccagcctgggcacataggaaaaccccatctctacaaataatttaaaaattagctgggtgtggctgggcgcggtggctcacgcctgtaatctcagcactttgggaagccaaggtggacagatcacgaggtcaggagatggagaccatcctggctaacacggtgaaaccctgtctctactacaagtacaaaaaattagccgggcgtggtggcaggcacctgtagtcccagctactcgggaggctgaggcaggagaatggcgtgaacacaggaggcagagcttgcagtgagcggagttctcgccactgcattccagcttgggtgacagagtgagactctgtctcaaaaaaaaaaaaaaaaaatattagctgggtgtgttggcatgcgcctctggtcccagctgcttgggaagctgaggtgggaggattgcttgagcccaggagatggaggctgcagtgagctgagattgcaccactacactccagcctgggtgacagagcaaaaccctgtctcaaaaaaaaaaaaaaaatttacctttcagtggaattatttatatacatttctacacatgagacaaacttttgaaggaagtttaatgtctttggtattcacatcaaactaatttgacatatatttttatttagttttttttaaaaacaaatattttttaggatctgttatttcctattaaattccttttacatgaaagatcataaattgatttttaaaaatgacttctaatgttaatagggctttgtcttttagacatatttgttaatgataaatttgtttctgtaatttttatgctttgtagctttaatttgggcccatacgtaaagactatgtagttttattatcattcctgccgtcatcatccttgatcataccatttaaaagcaatagaagttttaaatggagtagtagagaaagacaatcaggaattaatgagtttagataaaataagagtacaagcaaacaaagttgattgtggccatgttatgaatgcgtgagatttcaacttttaacaaattaataactttttttgaacacttagtgtgtgccaggcactattcccacccctctgcatgtactaactcatttgctcttcctagcagccctatagacaggtactattatttctgcttttcaggcgaagaagcagaagttgctcaggatcacacagctgttagtgccagggcaaggatttgaaccccgtcattaccatgctcataactaccggactatgctacctctgaagaagagattatacagcttgttgtggcacaacacaaaaccttaaaatgttttcagctcttttttttttacccatccttattttttccccatatgactattatttattcagccttttggtatctagcttgcagaatatttcagggtcccaaagggactatataaagagctgtctgtaaaagttctgctttcctcccaaaagctagcagtgggaaaaacaggcaggagagataaggtgcaaagcacagggaggaagaaagagaatagtggaagcagcagtggtgatctgtagtggtgtctacagtgtgctggttctggttgagttggtacgggcagccatgtcagcaaccaagtcttcacttgttggaggactcgctttttacatgctctggctgggatggttttagttactaggatgtaggggacaggaataacggcatttggtagagattcaaaacagcaaccagggatgacgagctgcagacattgatcgatatcaagtaaataataagagatagaagataaaacagctctcaggtgccagaaagcaacttggtaatggagaaatacatatcctagagaaaggtagacaagtgtatttatcctctcaggaaattacctggataagtgtacatttctgcaaagcaaaatagagtcaagctcctgaactcctgctgcataggctggtaggtgttaatgggtgtctgaatggagaaggatgaggacttcaggtttctagtaaacttaaatgtgatatggtttggctgtgtccccacccaaatctcatcttgaattgtagctcctctaatccccacgtgttgtgggaggaacctggtggaaggtaattgaatcatggggggcaggtttctcctgtgttgttcttgtgatagtgaatcagtttcatgaaatctgatggttttataaatggcagttcccctgcacaagctctcttgcctgctgccatgtaagacatgcctttactccgccttcacttgccaccatgattgtggggcctccccagccatgtggagctgtaagtcaattaaacctttttctttataaattacccagttgtgggtatttcttcatagcagtatgaaaatggactaatacataatgattcccttgtttggaggattgtcagatactatatgaaaagcggtttcacatgtgcttaaaaaaacctgtatatgtgccttatggtgtcattatttctaatttatagatgtagaaataataatatttagagaaataaaatgctttttctaatcacatgccagtaggagatcagcaagctgggactagaactcaggttattttgattgaaattcttttttacgaagccctgagggttctaaaaagctcgagtttcactgtgaaccattgtatggaaaacttaaatgtagccagaaaccacatagagaaaataaccaggttttaaatgttttatagtataatatttgttgtggtactcttttatgggctttaagaatctagtatgctggagggctggggtggctcacgcctgtaatcccagcactttggggaggccaaatcaggcagatcacttgaggtcaggagttcaagatcagcctggccaacatggcgaaaccccgtccctactaaaaacacaaaaattagccaggcatggtggcgcatgcctgtagtcttagctactcaggaggctgaggcaggagaattgcttggacctggaaggtggaggttgcagtgagccaagattgcaccattgcactccagcctgggcaacaaagcaagaccccatctcaaaaaaaaaaaaaagaaaaaaaaagaaagagaatttagcatgcatttaggtaaccacagagataaaatcatattcaaatgtgcttgtattatgagtattactcttctttatgagtattctttggaaaaactattgtcacacaataacatattaattatatctttattcatttaccatatttgaaattctcattaaagttttaaaatgtattttaattataaaaataatttacttaaaaagttaataaatactagatgtctgttcacacttcatttttccactgtaagttgcagattagattatgatgaacagactataatcttctaatattctgtgccctagtaaatgagtccttgcttatgtaagtcagatattttgttattttgatatctaagtaattggttattatgatttatttttttcttgacaagcttctgagctttgttcagtcttgtcaagtccctggtgagttttagatctctgagtctagagtttgttgatcgaattaatgaataaaccaatagattagtacattgttgatttttttttcccccaaaccttagatcctatttgctctcttaggaaactgtttgaaagtattgcaacttttagagaagttttgcaaatcttagccacatgtctactaatgttttgcacactatttttagttgatgaaatgtaagcaatttatatttgtcttaactttccatctataaggtagtgagagtggtgacaggctgctctgttttgcagctagcatctttaattgatgttgaattgtggctttccgtgcacacagggttaagtgaaaaggttgcagtcatctagtgagcattttcctttaatgtgctcattagtggtggcaagtccaggtttcagcacatgtcagtaatttacatttcattgtggagaggctgcccttgttcaagagttgtttctaagcctgatgaatatatattgggaataaacagagtagaagaattgaaagccaaataccctgccaggcctttcagttggttctgaagcttccagtggatctctgattagcaatgcataaagcaggatgaaaatgcaaagatgaggcctacaaaagttgtcgcaggtagcttctccccttaaatcctctttttgtgactgcttttccatttcatcttctccaaattcttttttcatggcagacttcgttaaagtgaaaatactctgtgttagacgtaagatgtgaatactacaggatctacctggttcctgtaccccttctaactatgaagccaagtctgatcgttatgcaatgagttttcagaagcaaagggcttgataggcctcggttcttagggatcagatgattgtgattggaatctttgtgatgattccttctgggactcattttttccatctttgcctgattggtaggtaccagcttgttctggcttttgaaagcttgcatagatcagtaaagaataactgtggaggctgtggtcagtgttgttggggatagagacaggactctgaaattgtggtgtttgggaaaatccagaaattttctttttgtagaaaaacttcatatattaaaatgaagcatttttggaacttgggatttgattacaagttacttcatgcatagatggtgtagctttagaaaactcaggcctagctgtttttagaagaaaatgttataattctttatacattttaagtttaattatttacatgtgtataaaaatttgggtttattgcaagaaggtacgttttgatattgctgtttctgtgtgtttgtatgatacatctacccatgtatctgtctacttatttatctttgtggtgctagtcaaaacttgcagcttaagagaatttgttcagaattggtggttagaatcaaaagtgagtgaatttatgacttacattattgaaaaacattgacaaatgtcaggactcaagtccgatttttattattttactgtaaatccagttagatgtgatttagcacttggatcatttaaatataaaggcatgttagtcacagtttaagtctttatattagtttttttaattaggtagagttttaacagaggagcaacatggaaaatgtttatgtgtatgaggataaaaatgcaagtcttgagaatattagtttagtaatgttctgattagtgtttgtagcctttgtaaaaaatgtaaatttaccttctagatgactacttgaaactgttgtttttggatgcttgccagataaaagccctgtgggattaagttctggtaaatcgcttgcaaatttgtgagggatatcagtgactttgagtgtttaactgtccaagctgtcatctacatgcgtcctatcactgcattgggtgaaaaaattaagtttctcagccagttagaattaaaggtgacatctgcttttaattggtgttttattttcttccaagtcagtaaaaattcagtaagacatgaattatcaaattttgcaatgctaagcaacttgtcaagtgacagtaagcactaccttgagcagttgtacagatgggaagtgttaaaatgttgattaatcttccagagttctgattatgagaagactaaagcttatatcatcattgccagctttctagtgtcagagtagtatttatttgttaattttgtagacctttttcaattactgacaaattgtgtcttgcataatgaaaattttactagttttaataagacttggtctattagactaagggtcatagatggcaatgtagaattcatgtttctgttgtctattatttagtaaacatattagattctttttagtaaaaaactgaaaaaaatctaaacgtgagctttaagttttattctgttatacacattcatcctgtgttgagaagggagtatctgtttgaatcttggcaaaggaagtcttgcctgggccccctgttgaaaaagaaaatggattatttctgtttttaccatttataaaacattttaagatgtaaaacataaggacgaaaaaaatcatcaccttcaagtagtccatgtaaaaataactcaagtcttcaaacattctcagaactaaaaaagaccaaagaaaatattcccatcatactgattatgtttcaattttctagttactaaaaattagaacatggcactaagtagactatataaagtatgtctttaaaaattcaactgtgaaggagatcttttttttttgataatcattaatatgaaagtgaagtttctcttttccctgttataacagttctatgtagtagtagaggtagaattctgaattgaaggtggttaggacttatagcaacatttctgggatgagtttttcagtattcccagacttcaatttaattcagggtttcttttttgctctccacttatgaatatgtgataaatattttatgtagtcgtgtacttttgctatagaaaatcagtggattatttaatttgattcaggaaatctaccctgtatggttatttcgatgttgggtagattttatttcaacttaaaacgtagaaaagatgcttaggcaaatgatctaatagttttagatacatttggtaacttgtatcttaaaccccagggccaagtttagcagtcttacacatgtttagaaaatagttgaaaaatagaaaatttaggtctttttaggtaaactatacaaaacacttttatagtcattttgatgcctgataacttcagggttcattgcccctgtacatttttcaaattatttgcttctcaatccataaggctttaatttaccccctactgacaaatcccaaatgggtttttaagaattttgagagtggtctgctgtagttgtgcttcagcactggcttcaattgctgacacagaatctcttaagatgcaccaaatttagaaggataggaggttcaggcagcatttcctctggcaaatactaagattttatttgcggagggtggggacggagatacagaattactgttttctgtaatatttttctttctttgatcctgttttaatgcctgtttattaaaaaaaaataatttagacacaagatttagccacatttttttaattaattaaaatgtgtgggccgggcgcggtggctcatgcctgtaatcccagcactttgggaggctgaggcgggcggatcacaaggtcaggagatcgagaccatcttggctaacactgtgaaaccccatctctactaaaaatacaaaatattagctgggcgtggtggcaggcgcctgtaatcccagctactcgggaggctgaggcaggagaatggcatgaacccgggaggtggagcttgcagtgagccgagatcgtgccactgcactccagcctgggtgacagagcgagactccttctcaaaaaaaaaaaaaaaatatatatatatatatatttgtgcttgtttggatgggcttttttaatcttgaattttatagaataataaagttaagtatttgtaccttgacataccctaacacaattaagtattgcttccataaataattttgatcttataataaacataccttacatactgacgaataatattaacacaaatgtatactcccttagaggtgctcaaaatgactttcatgccacccttcatgcctgctgggttttaaggcataagagaaacagatgatttctgcattttactggaaaaaaaagactaaaatgtacagctagtattgaattggggtaataatctgccacttttttgcccttcaatgctgtcgtgatcttttagggaagtgaggtcatggtagacccgcttgttaatcatttctgcgttttcagctcagtttggtcatgaatacttgacttgctacctatagtcttgcttctgtttgcctctttgcatgcagctccttaaattgtttaaattaccatgctttctttatcatgtgatcctgtcatctattgacaattgattggatcaaggattagtgcctgacccaaggcagacatctacagaagggtcatcctcttcccacaatggtttattttcctgtctgtgtgtgtgtgtgtttgtgtgtgtgtgtacgtgtgtgtgtggtggtcatgaatggtggtggtgccaagaaggttgtgacatttgactaataactgatgatgagagaagcagccagcacttggagatctagagtaagagctctccaggcagagggaatagcaggtttaaatgttctgaggctggaatgagatttgagacatagaatatagagattggatatagagaaaggaactggtgtggcaggagaatcatgaatgagaaaacacgtggtacaagatgaggttgaaagggtaggtggctcagggcagatcagttagggtcattctaagaagctgggatttaggtctgagtgcattggggagctgctggaggagttttaagcatgtggtgcacttctgtatcacttctgacctaatgtgatgcacttctgtatcactgtaacaacagtgcatatcagactgaagaactatgtgattaagaacactttgctacataggagcagaaaaatttaaagaagaaacagtgccctagaagaagttaaattctcttgggcatccacctgtagacgtcctcactccttaatttgtcctgctgttcttagcatcatagctctctgtgaaaacaaagctatcttctaatttatactttgcaaatcatttgcttttccgtaaaccccattcttgcctattggggttaatctaataccaagatccaagattcctcttcccacaatggtttattttcctcaggctggattattcagtattgaaaaacagccccataagacaacccatgggaaccattgaccattcaggtcctaagaacagttagagttagggggtaggtgtggatacagaggttgtatgtatgtggtattccagtttaaggtggccactctcttctgatttctttctcctctgattttgtctcctccgatttctttcccctggtattaattactaatacgcttctttgactttctgtctggctagtaggtgaggttacgttgcacaaatgcttaaatgaatgcatgtatattggcatccttgtatatgggcttatgtttgcacacaaatactcaaattccagtgaagtttgctttgccaacatcctttccaccacaggtgatttgtggaagccagtcaggatcattttatcttccctgacaattattgattcagggattaatcaaggcttaagccattgtgggccactgaaacatgatgaaaggctttcctgggattcctggaaaaggaacctccttattcttaagagaaagacattggaagccaggttctcttgcattctcccccacccaccaccttgtgaatgagagagcttagttgctgctggcagccatattgtgaccatgagggtagctagcctgagggtaaagctgacttacagaataaggcagatctgagagaatggcagagaaatccagaattgggagatatatttttggaagaatttctgtctaaaagtgttggtggggtatgtgttatggcaagaagagagctgggatgtttaatgggttaacagcattttgttctttatcatatatttattgaaaaattttcctatcccattgtgctaggcactgaggaaattatttaaaaaataaagtagggcacagaacttgcctttccaggaaactcatttacaggtattgggttttgattctttctttctttcttctttggaaacagggtgttgctctgccgcctagccggccaggctagagtgtggtagggtgctcatggctcactgcaccttctgcctcctgggctcaagcaatcctcccaccgtagcctcctgagtaactgggactacaggcgtgcaccaccatgcctggctaatttttgtattttttgtagagatgtggtctcgccatgttactcaggctggtctcgaactcctgggctcaagtgatccgcttgtcttgattccttgtataactgccccttgtattggatttggggactgaaagaacacttagttactaatattcttttttttgtttttctttttctttttttctttttttttttttgagatggaatctcgctctgtcgcccaggctggagtgcagtggcgtgatcttggcttactgcaacctctgcctctgtgttcaagcgattctcctgcctcagcctcctgagtagctgggattacaggcacgcgccaccacacctggctaatttttgtatttttttgtagagatggggtctcgccatgtttctcaggctggtcttgaactccagggctcaagtgatctgcttgtcttgattccttctataactgccccttgtattagatttggggactgaaagaacacttagttactaatattgtttttttctttttctttttttttttttttttgagatggagtcttgctctgttgcccaggctggagtgcagtggcttgatcttggcttactgcaacctccacctccccgttcaagcgattctcctgcctcagcctcctgagtagctggaattacaggtgtgcgccaccacacctggctcatttttgtatttttagtagagacggggtttcaccatgttggccaggctgatctcaaactcctgacctcaggtgatcctcctgcctcggcctcccaaagtgctaggattacagcactgtgcctggccagttactaatattcagttttaaattttagaaacctagtacttaaagcacattaaactttgcttactgtggaaccagtgtcagggctgtgagttgccttcagtgatgttgctgggtagccaggcttatctgtgcgttatacgtgggtgctttgaggaatccaacaatgagaagatagctagccttgaagacagcactggaagcagagagtagccagcagtcagtcagtcttctctctgagtttatgctccattctttgaggtgtttctgcaagcctctctgctttccacctctgcttgtctggcttgcggccctgttggaacatgctgacttcattgctcctaagcctacatgatatagaccagggatcctgaaaagaggaaagcctctttttctctctgtccccatgccccattcctaggaaagggaccctgataggtctagtttgggccagctgccttttgccactcccgtctgttcagagagcaagattatgccattcacaaggtctacaactgaagaggtcttttgctgagtttgggaaaagggcagttcaggaaaatcagactaactctgccaccaaatgtctcttaaaccacataattatgggacagtatgataattgcagcaatcaaaggctgttgagtgttgtgtacaggaaggtagtggttaactctggtaggttgggggttgggtacagctgaagagaagattgtcaaacttcacataaagggtctgtgtgtgtgcgtgtgggtgcatgcatgcgtgtgtacgaaggattcatgagggggagtattttatattggtgtaggtgttggtttcctccccaagaatttattcctatcataaatactctctgtgcccctgtgacagtttcataactgtggtatcattagcgttacaaagtacagaagacagaataaaatcatggactttttgagctggaaagaccttgaaacttatctaatttgtttgacatacatcttttgatgtggcagattctggtaaatataaagacaaagcaggttccctaccctgaagaagtttatagggggactacagcagggaagaaatactgggaggagtttctctgattcccaggagaggatagctggccatcgggggaagtcagatgacgaagtcatccattttgatggaggagatgtgcccagaaaggcttcatgacgaaggtggcatttgaagtaggtcttgaagataggtagtgtttaggcaggggagatgatagaggagaagaatgggacacacaggtggaggggacattccaggaaggggctgtagtgtcgggatggcagaaaaaggggtgctgcattgagccatgagctgtgacagacctttgagtgtaagagtgtaagagtaagcccggaaggcgaggggccctgggtactgggcttgaatttgtttataccattcaagctttccagaaaacccctgtgagctttgaaatgcttcaggggagcattctgtgtgaggctggctttttctgcccttttcctcaattcagcaaatggcaagaaacttggtatcatctttgcccacctttgctgttaggccgtgtgctagtctgttcttgccttgctataaagaaatgcctgagactgggtaatttataagaaaagaggtttaattggctcacgattctacaggctgtacaagaagcgtggtgtcatctgcttctgaggaggcctcaggaaacttacagtcatggtggagggcaaagaggaagcaggcacgtcttacatgaacagagcaggactaagagagagagggggaaggttataactatagtagttattgcttcctgatagataatttgtttgtttctctttctcctctgctgaaatacagcctacacaaccataggagttcctgtctcttgattgttgctgtttcctcagtacctaggacagtgtctggctcatatatatttgtttaatgaacaaatgaataagagatgggttatttagctttaggccattcatggaaagtttaataccataaattctctgttaagtaggcagatatttataaatacagaaatggcttctaaggtgtctccgtaagatagctattcaactgttgcacgagcttatgatgactggaatcgtacgccctttcatcatatagaccagcatttggcaggctttttttctgtaaagggccagataataagtgttttaggctttgtgggccatactgtcacaaccattcaactccattctaaatactcagctcttctgttgtagtgtgaaagcagccctagactataggtaaatgaatgggtatggctgtgtttcaatacaactttcattatgaatacttaaatgggaatttcatgtaattttaacatgtcacgaagtattactctgcttttgatttttttcaactatttaaaaacataaaaaacctttcttagctcatagactacaaacgtggtgggctggatttggcctgtaggctgtaattggccagtacttgttatagagctttctgtcttcctcatctttaatggttagaaaattcttcattgtattaactgaaatctatctgtttagaatatttacctattttttcagtagtgaaataggacatatataccgaaaaatgcacataatgtaaatgtacagctttacaaattattgtgggcacccacataatattacctaggtcaaaaagtaagacaaatgtctgcaccctagaagccctttgcatgttcccttcaaatgatgctccttcctcccatcccaggaacactgtcctaactattatgggaatcattttcttgcttctctttatactttcacctccttaatatgcatcctatgaccctggagtttagttttgcctatttttttgaactttctatagatagaatcatatagttaaaaaaatttgctttctgtctttgtttctttctctctttttatcttttctttctttctaatattttctttttttctttcttttgacagttttgctctgtctcccaggctggagtgcagtggtatgatcatggctcactgcagcctcaccctcttgggctcaggtgattctcccacctcagcctcccgggtagctgggaccacaggcacaagccaccgtgcctggctaattttatgttttgcagagacaaggtctcaccatgttgcccaggctggtcttgaactcctgggctcaagtaatatgcctgccttggcgcctcccaaagtgttgggattacaagttttcttaaatttctttttctttttttttttttttgtgagacggagttttgctcttgttgcccacgctggagtgcaatggtgcgatctcggctcaccgcagcctccacctccgaggttcaagtggttctcctgcctcagccgctcaagtagctgggattacaggcatgtgccaccccgcctgactaattttgtatttttagtagagatggggtttctccatgttggtgaggctcgtctcgaactcccgacctcaggcgatccacccgccttggcctcccaaagtgctgggattacaggcgtaagccactgtgcccggctaaatttctttcagtaacatttattagtttcctgcttagaagtattgtgcattttcactgtatttattattagaagtttgagtcttaaaaattattcagttttctctttgatttcagtcttaccattccatctagttaaaatagctttgaatcaatattttatcattctttttcagcattggttcatcattgaattaggcaatcagtgtctttgtgtggcgttatacaagtatttagtaaaaatatccattagggaagggccaaaagtagagtagggctttttagttagacaaaaatggactattcaatgatctggatatggcgtttgaaacaattgtgtatctgtacaaatatatttagtttaatacacacttgtctgtgttgtccataagcacacatttgaatatggccacgagaaagattttgggtgaccatgtggataaaaaaattatttggtacagttatttctgctaatggatggggaatgtatagtaatatggaaagtacaaaataggggccgggcgtggtggctcatgcctgtaatccagcactctgggaggttgaggtgggtggatcacttgaggccaggagtttgagacctccctgggcaaaatgacgaaaccctgtctctactaaaaatacaaaaatggttcaggtgtggtggcacgtgcctgtagtcccagctactcaggaggctgaggcaggagaatcacttgaacagggaggtggaggttgcagtgagccaagatcgcatcactgcactccagcctgggtgagagtgagattccatctcaaaaaaaaaacaaaaaaaaaaagaaaatacaaaatagggatagtgtagaagaaatctgagaatgttttctacaatttaatgtgtatcacctagtaactatatttaataatactagatttatattctcttaagtatatgccaattgagaattgtgcagtgagttcagggatgctgtgaaggaattattttcagaattcaaaattttcaatggataattgagaattaattgcaatgatgaaacatatgtaacatgtagtagcttatgtaaacattagtgttagattagatttgtaaaattcctagttttcccaaaatatttgaattatgctgtagaaaagtccagggactcactcctgcaaccctaaatgtagctatactgatacaggatttggcagcctaatagatgtagggttggagcacaaagaagtttaaaaatactccattccatggatgtttaatagatttatacctgttgattattaatttttgagtttgtggattaggtattatcctccatgattaaaaaaattggagaaagaggataatcactgtaagaacgaatcaagattatgactttgtatgttcagaccaacatgggaagaagaaattcttggtaatacgtcaattgggatctgcgataggctggagaggtttttgggcagatatgggaaataatgctatttttagtctgttcactttcatcaagctgaccacaaggtggggaataatacattatatgaggtctggatgacctgcgatatcatccagagttataatagagaattatattactttaaagaatgtattttttaaatttggatatttacacatgagttagagtcaaacagtgtttttatagctatatcttgactagttatgccaacaataattattttttaaaattgtttctcagtactgtaaggttcttattttattgttgaaaaaaacttattttaagttcaggggtacatgtgcaagttcgttacataggtaaatgtgtgtcatgggggtggcactctttttatttcagtaaatttttgggaaacaggtggtatttgattacatgaataagttctttagtggcgatttctgagattttggtgcaccagccacccaagcagtgtacactgtacccaaggtgtagtcttttatcccccgcccccttcccaccctttcccccaagtccccaaagtccattgtatcattcctatacctttgcctcctcgtagcttagctcctacttatgggtgagaacatacgatgtttggttttccattcctgagttacttcacttagaataatggtctccactttgggaggccgaggtgggcggatcacgaggtcaagagatcgagaccaccctggccaacatggtgaaaccccgtctctactaaaaatacaaaaaatagctggatgtggtggcacatgcctgtaatcccagctacttgggaggctgaggcaggagaatcgcttgaagccgggaggtggaggttgcagtgagccgagatcgtgccactgcactccagcctggcgacagagcaagactctgtctcaaaaaaacaaaacaaaacaaaacaaaacaaaacaaaaacacaaagaaagaaagaaagaataatgaattccatctggattgctgcaaatgccattttttcattcctttttatggctgagtggtcgtattccatggtgtagatataccagtatttatctactcgtcaattgatgggtatttgggctggctccatatttttgcaattgcaaattgtgctgctataaacatgcatatgcaagtatcttttttgtataatgatttattttcctctgggtagacacccaataatgggattgctggatcacatggtagttctacttttagttctttaaggaatctccacactgttttccatagtggttgtactagcttacattcccaatagcagtgtaaaagtgttcccttttcaccacatccacgccaacatctaatattttttgattttttgattatggccattcttgcaggagtaaggtggtatctattgtattgtggttttgaattgcatttccctgatctttagtgagcatatattgaagtttgttggccatctgtatatcttcttttgagaattgtctgtacatgtccttagcccactttttttttttaaattatactttaagttctggggtacatgtgcagaatgtgcagttttgttatataggtatacatgtgccatggtggtttgctgcacccatcaacccgtcagctacattaggtatttctcgtaatcctatccatctcctagccccccaccccctgacaggccccggtgtgtgatgttcccctccctgtgtccatgtcttctcattgttcaactcccacttatgagtgaaaacatgcggtgtttggttttctgatcttgtgatagtttgctgagaatgatggtttccagcttcatccatgtccctgcaaaggacatgaactcgtctttcttatggttgcatagtattccatggtatatgtatgtgccacattttcttaatccattctatcattgatggacatttcggttggttccatgtctttgctactgtgaatagtgccgtagtaaacatacgtgtgcatgtgtgtttatcgtagaacgatttataatcctttgagtatatgcccagtaatggaattgctgcttagcctactttttgatgggattgttcatttttttattgctgatttgtttgagttcgttgtacattctggatattagtcgtttgttggatgtttagattgcgaaggttttctcccactctgtgggttttctgtttgctgattgtttattttgctgtacagaagctttttagtttaattaagtcgcatcttttatctttgtttttgttgcattttcttttgggttcttggtcttgaagtctttgcttaagctctttgcctaagactttgtctctatatttaaaaaaatatatgttgcccaggctgctcttgaactcctgaactcaagcaatccccttgctttggcctcccaaagtgctgggattacaggcatgaggcactgtgcctggctgcattattattttaaatccataaaatcacacctttttcagcttaagatcatttctagactgtcctctcactaaaaataccctggaatcaatatacatgttgttagtttgaaaattctttgctaggttgaacagccatattggaaaagtaccaaatccctttagggttttgttattggtaatataaagaggacagagaatgtatttcaaattagttgtcatttcatgaggtgttgcccttcatttcttggcaggtcttaactagaatctagcctcctcttataatagttgaaaatgtgtcatgactaattaatatgatacaatgagagcactgttttctgattaataaggtgggtggaccttatgaaatgttatctgaagatcacgcacgtaatctttgatggctgttattgcgttatattgacttgtgattcctgtgtgttcaacttctagtgtgaatagtaaggccaaaaattcaaaagggcttttgaagttgatttgtaattaaatagcattattaaaataaagagtcaaagcattgtcaagtgtgataaattcagtgtcaaaactgagcctttaaaaccaaaaagcgtggctgggcgtggtggctcacgcatgtaatcccagcattttgggaggcctgggcaggtggatcacttgaggtcaggagttcgagaccagcctggccaacatggtgaaaccctgtctctactaaaaattagccagatgtgatggcatatacctgtagtcccagctacttgggaggctgaggcgggagaactgcttgaacctgggaggtggaggctgcagtgagccgagattgtgctattgcactccagcctgggcgacagagcgagaccctgtctccaaaacaaaacaccaaaaagctcatgcctgttatgctagcactttgggaggccaaggcatgaggattgcttgagcctaggagtttgggaccagcctggacaaaataaggagaccccatcactacaaaaagtaagaaaaaggggctggtcgtggtggttcacacctgtaatcccagcactttgggaagctgagataggtggatcatgaggtcaggaattcgagaacagcctggtcccatggtgaaaccccatctctactaaaaatacaaaaaaattagccaggcatggtggtgtgcgcctgtagtcccagctactttggaggctgatgtgggaggatggcttgagccctaggtgtcaaagctgcagtgatcacactactgcactctagcctgggcaacagagagagagatcctgcttccaataaaacaaaacaaaacgccctcctcaaatcagaaagcattctcaaccatagtacttccaagcaccctatttgtgttagaagtgtttaaggcaatgataaagtcagtaaactatttcaagctgttggaagtgcatctcagcacacgacagttgtgatttcataagcttcttaaggtttcaagtgcacagcattttaccgcagaactattactgtctcaggaatgaggcccatggaacacaggaaaattctccacccagggaggaaggctgggaggcctcagcagccaatagtggtgtgactgagactctggagtcccttcacacttgtgtcgcagcttactacgggtcacctccgtcctaagtgtcttacatttattaatcatatatcctcacagatagggaaactgaggcacacagcagccaaggaactcgtccaaggccaaccaggtagtatatggtggaactggagtgaaggcaggctccacagtccctgttcttaacctttatactccactgcttctaattccttactttcttttatacaagaatataatttaaaatcctgcccaacacttgttttgtaagattctagtggcatgggaagtgaggggttacagttggtgtcagtcatatttcaaatggctgggaataggggtgataacatacacccaaggaagtcacgctggctgctacaacattgtgagaatatcattctgctgagattttacgcttgctggtagttgacataaaatgaagcttagtctattatatacaatgccagctttttccttcatcagttacaaggcttgactttaatgaaaggagaagactgcattttcaagtttgatctagaaggctatgaaggctctggttggaattattgagaaagacaaatctcaggtgatctgaacgtgttaaattgtaagagtacttaatgtgaattggaggaagcaattctctgaagcaaagggggaggaatttgtatcttggaaagaattgcctttgtcttttattatttatgcagttgataattgcaatattgccacttcacatatgaaaatatcattgtagtaaatttatgtagagttggctaacaaagttcccatccatctttgctttagttcaattgccattagtttcccagagtactttctaattcctctaccacagtactcatgctttattttgattttaattgtgttatattttctcttctagttagtcaaataagcgaggtcctggtgcacctctgtcttgtccatcattgaattcctaggcttaccacagtgcctgacgtagagttggtgttggcagctatttgtaggatgaatgaatacatgactgtgttaagcagacatcaaaggcgtataaaattgaaatctagttgttgtaagacttaaaaagagaggagatccttatagatgagtgctggttgtttgcaggatcattattattctctgatgatcaaaaaactgtttacgcatgcaccagtagtcccagctactcaggaggctgaggcgggaggatcccttgagcttgggaggcagaggttgcagtgagctgagatcacgccactgcactccatagagccagaccctgtcttaaaaagaaaagaacggtttacagatcagtgagagaggtgttttcctaaatatttaaatgtttgcttgcccatgctacttttccaaatcctaattgtccttttccccctcaaatgctccttcctttgtgaagccgtccttgattcccttgttggactctgttcaccgtgtctgatttttacctcttctagtgcactgactattcttaccgtgtattgtttttattttttggtacatgtgttgttgtttgttctactagactataaactcttgagtgtgaaaaccatgtctacttaaccagcctgcttccgagagtgaaaagggacgctaatcagataggacaccgagtaatagatgtgttcaaggctgtgcgaggcaaacctgatggctggttactctccagtaatctttagcttattgaaaaagcagaggccacttgcacctgtttacaagcaggtgagatgggcctgagaaggtgattgaattgcagattcaaaacgctggtttgtgtcttagtcttatctctgtcacttcactagtctaatgactgtgggtaatttatttcatcttgaagaccctcattttactgacatgttaagtagtgatgaccatttatttcctgctgtttcttaggccccctcctttttgtgttttgaggaagagaagatataaaaaaacgcccttgagagctgtgaagtgtcatagatactacaatatcgttttagaatcaattgaagactttctaactttgtaaacaaatttgaatctgatgactgaaatgctaatctataaaatggttttttagtaataaagtgagacttaatacagtgcttttaaatagtatgaaataagtaaataaatattgtagtttttgttagtatcattatattccttgttcttttaattcatttttaaacttagaattgtttcctacagataaacaaatgtcagcttgggtccatctactacatcttattgtcactttcacttcattgcatcattgctcttaatcagaataaagggtgaatttagcaggttgtagggtttgagtagtgctaagtattgtgaggaattgtgctcaaggtaattaattataaatcatagtccgggtgcggtggctcatgcctgtaatcccagcactttgggaggccaaggcaggcagatcatgaggtcaggagatagagaccatcctggctaatatggtgaaaccccgtctctacaaaaaaattatcctggcgtggtagcgggctcatgtagtcccagctactcgggaggctgaggcaggaaaacggcacaaacctgggaagcggagcatgcagtgagccgagattgtgccactgcactccagcctgggtgacagagcaagcctccgtctcaaaaaaaaaaaaagaaatcatgatctctgctattttaatattttgctcagtatttgaaataagctttataatgtaggctatagtaaaacacagcaattaagtgcttaaaacaagaatatcccaactgtaggtacagcatactttacctaaactatatgactcttatttctatccagcaatgggatcaaaaacttgatgcatttcagaaaacacgaggttaagcaagacgtgggaggattttgacttgtggtaaattttgaaagaaattgtaaatattttcaaagaaaatagaaaaagcacacaattcagagaatatacaaagccaattaaaaagttgtaaaattattattattattattatttttgagacggagtctccctctgtcgcccaggctggagtgcagtggtgcaacttcagctcactgcaacctccgcctcccgggttcaagcaattctcctgcctcagcctcccgagtagctgggattacaggcgtgtgccaccacacccagctaattttttttgtatttttattagagacggggtttcaccatattggccaggctggtctcgaactcctgaccttgtgatctgcccaccttggcctcccaaagtgctgggattacaggcgtgagccactgcgcccggccgtaaaattaaatttaatatctgatctgacggactaaacaaaagatctcttgcctttcaccagtttaccagctttctgttctttttcactcttagttcactaagtgtgagtggactgtgaggcatgagcaggaaggggtggcattgggcatttacagcaagagaccctcatgctaagtgaagtgttatcaaatcttcatttttttgcttatactgtaaaattgccaattatattcatagttattgtaagttatattccaaagtttaactggaaaaatattattttgcaaccaaaaaggtaccaattaatattcctgttcatgaaacaataaaaagaattgaatcagggagaaatgaaaacagctcattttaaatattcaaatttaaaatgatataaaatagggatataaaataaaagcattttatatgaggtatagaggaaagaaattacaacttcaaaacaaatccttgtgatcagcttccatgaggaggaccttagcaatgtataccaaatttaaatgtgaagcttcttaccttcttcttacctcatcttcttaaaagatacatctaaaagaaaaactaaaatttgtatcgatatgtttaattaaagcattattgttattattatgtaaagcagaaagaaacttctgaaaaatagttgagtgatacatttaagcatttcacctaaggaaatttagtgttatttaaactgattaacagtatttggcaaagtattttcattagcgttctaatattaaagctagcatttccttaaaggagggaggctaaaattcatcccaaagcttgtttttgttaactcaaattttctcagtgttattgctgaacaagttactgaattttctctgggtatcttctatattgcctttctttgattcttgtcagtgcaaccagtctaaggttttacatgataaaggaaatctgtggagctaatcctagaaacctctttctattttcttacctaacacctccaggcacagagaagacaaaatacttcatttgcattcttaaacattaggaactcagaataagtctttcaactggaaatgttattgcatctacatttcccgaagagaaaaaggttaacagcctactcaggtttatgttaactcatctctttttagtatcctgatgtgcacaaagagtgaagaatgtgaggcttacccacccaggctctttcttctttacaatcaatgagactctggaagtggtatcagtgctgattacagggaaataaaaagaaaaaatcaaatatgcacaaaagaaatggaaaacactaacatactttaatcttagtcttctaggaatagaaagaacatttccaaaattaataacgaacatagtaattcaaattttttaaaataaaaagtttcctccataaatttgaaaagcttaccaggaaagtacaaagatattgagatttatagtttgtttgttgaaatggtttttattaaagtaatcaataccaaaaaactcttgtttgttctaagtaccttggtcagaaacccgaaacatttaataaaagaaattgaacaattttttgacttaatgtttgctaaaaagtagaaatggaaatcatttaattgccagatattaaaaacagaaagttttctattgctgtaatactcactccccatcagtgtaggagaaacaaggttttatatttaactataatatattccttaaaatatacttaagtgggaaacttaacttctgccgacagttacagtggggaaagttaccactgttctctttccctaactaaataccgtacatagctatcatctggaagtaatagtattacttcagtgcattgtgccagtagacacttaatacagaatatactttagactaaatgaaatccagatcccagtaatactgaaacagaaagacacaggttcctttggttaaactaagtcatagtgtacagtgtactataaattaaatacagtttgtgagtatgtcattagattttaattgaatttgcaattagcatcccaaacatttaaaaatcgtgtgggtttataagtttttacttttgaattttaaaataatagaacctttacccccttccactacccatctcccatagcaatcacatccatttatgttcttatcctaatgaatcagctaaattgggttttaatttacaatgagctggtaagagttaaagaaaatgactcctataaatgtagtaggtgagaggctgagggcatcctcttctaggttattctgctccttcctacctttgttgatgccccacagtcaatgttggggaaaattaattaggatttatattccagtcttctctaatgtgttgtcaccattgcacagactcaggacttccagtgcagtgttgactagtaccagtgcacatccttacccaggggactggaacttacccaggatcacaaaaatgacactaggaatgtttctcccctctcagcattcaaatgttctccttatcttttatttttatatatttatttttgagacaagattttgctctgttgcccaggctggagtgcagtggtgtgaacatggctcactgcagccttgacctcctgggctcaagcagtcctcctgccctggcctcctgtgtagctgggaccatgcctggttaatttttaaatttttttttgtagaaacagggccccactgtgttgtccaggctgatcttgaactcctgggctttaccttttattattttaatttaattttattttttgagacagagtgtcgctttgtcacccaggctggagcacagtggtgtgatcttggctcactgcaacctctgtctcccaggttcaatagattctcctgcctcagctcctgagttgctaggattacaggagcatgccaccatgcccagctaatttttgtagttttagtagagatggtttcaccctgttggtcaggctgtgatccaggcaccttggcctcccaaagtgctgagattacaggcatgagccactgtgcccagccttatcttttatttttaatgattattgtttaaagtacactgagttcaggttaaaaaccaactgccaaagtaaattttaacacctaaaagctgggagaaggggccattcttcttttatgcagtaactctttggagtccagatactaacatgccccagatttcatcctggtgctaaactgacttgttttccaattaaaaaaaataaaagtctgagtaatattgcgtaggagtaccagaaatggccttgttggaaaccaaaactatttacattcgttaagaaatctgtttgcaggtgtgtctgccacatttacagcacagtgtacagctcctggcactcaatacacagtgttgcacagcttgccgcaggagcataaagtggaggtagtaaaaaggtaaggaagaaagagggaggaggatgagttgttctctattcatttgcttctcatttcatcactgatttggtggtacccagacctttacagagccggtctccataatactggtgcaggtggcctgatgcccagtttctgttgctcagataatgcagtctcatctcgtctgtgatttcagcagcactcatggcaatgggaacattcttcttctttgcaacccaggagtgagattgaatctctgattaaagagcaaagcttgagtgttttggacatggtaatgctgcagaggtgagttcctgttctggctgtccatgtccaaacaagtgaaacaaatgttttcatactttgcagttgccacgttcattcattcattcattcattcattcattcattcattcattcatttttgagacgagtttcgctcttgttgcccaggctggaatgcaatggcatgatcttggctcactgcaacctctgcctgctggctcaagtgattctcctgcctcagccttccgagtagctgggataacaggtgcacaccaccatgcctggctattttttatatttttagtagagacggggtttcaccatgttgaccaggctggtctcaaactcctgacctcaggtaatctgcccgcctcggcctcccaaagtgctgggattacaggagtgagccaccacacccggtctgcagttgccacatttaacctttagtgctaagtaaacatttcaccatggttcactttgtacaaaatgagaatctttactgaagcatcccagccaaacataagaatgtactttacaattttttttttttttttttttaagcctaaagtccctggaagaggctggcaaactggcttgagaaacacttcactgggcatagagctgctgaagctgctcctagtccgtgtgttgatttcactcctataagttggtggctactctgaaatagttttcaaaatttttattgtaaaataaaaggcagttacaggagaactatacaaaagaaacctatggcttaatgaactattatagggcgaactattttgaaatcatgaaataggtccagacgcagatgtttaccctgaatcctggaaagctgtgtgacccatctcagtgctaacctccggcctctctctaaacatacccattcctttggcttttatagtaatcatttttttttgcgtttaaaaataattttattgtccaaatgtgccaccttggacacaatatttaagtcttgtccatttatttttaaatttgataagtctttaaaatcttagtctgtaggctcctcttgcttccttttcttcatgacttatctgttgaagaacttgggtgtttgacttacagagtcttaccccagtcttgacttagctcactgcatggcgatgctatagctcagtggtttcccccattcttggtgtttcctacaaattggcacttgaattcagagatgggatcagacttggatttgatgcctttgatgaagactataggaggcacataatgtctttttagctctttttaagatataagcagactttgatgcttactgcccatatctagtaatttattggattacaaaattttggtagtttaatgctaacatttttttcattagttaattggaatatatttagaaagaaacccttcttctcatttactgttttattaccactggtacaattcatatatgagaagcaagataaatgcttaattctttacctttatttactatttctgaagtaatgattggttccttatcatccctcgaagttagccaattcttttgaagaaatcactatgaagtcatactgttgaaattactgtgaagtcaagttgttcctctttggtccgtggggcttaagttgactcacgggtctttttgacttgacctcataatcttctctagcttccttactatctgatctgacaggacattccaggctcatgttttacattttctgttccaactctttatttttatttatttatttatttatttttgagacagagtctcactctgtcacccaggctggagtgcagtggcgcaatcttggctcactgcaagctctgcctcccgggttcacactgttctcctgcctcagcctcctgagtaggactgctggagcctgccaccatgcctggctaattttgtttttgtatttttagtatagatggggtttcaccatgttagctagaatggtctcgatttcctgacctcgtgatccacccgccttggcctcccaaagtgctgggattacaggcgtgagccacagtgcctggccttctgttcaactctaatcagccatcttttcaaaatgccttggcttcttctaatggtatttggagatcacagttggggtactaggcatggtcattgctactgattggtcattttaagcctttttagttgcaggctaggaaaaaaaatatacatatatattaacaggtttttaacatatacgttttatgttatatatgtatattgcttataatacaatatgttatcttaactatattatattaataaaatatataccatatggcaatatatttactatataaatatgtttaaatataatgccaaccctaacccaaaatagggtatgtatataaaacaaatttatattataataatcatactgtattaataaaatgcacataacatttttctcatatataatgtatataacaatatagaagtataattaaataaagtctacattttatgtgagacaaaacaactcctgtgttcatagcaatattttccattacaattcaaaattgcagaactttaacctctttgttgcctctgtgtatcttcattcttctggattcagaattctgactctcaaggataggggaaatgacagaattagagtatctcacaattgcttatttgtcttgtcctgtgctatacacagagcaatctcaggataacaatgttaataccactaccaatatgattactaaaaacattaaaaatgtatttgtacataatcttcctgtaatattaaaaaaaaagttgtactatatctatattgtcagaaaatgtggctgttatctataaggttttatatatatatctccttagctttcatttagttttagctctacaagtaaatcccgactctttttgttgatatctcttttgtcattttagtttcctgaagctcattctctagtacaggagtgggcaaaccttttctgtaaggagccagaggggaaatatttttggctttgtaggccctatgatctctgctagtactcattcttattcttatagtgagaaagcaatcacagacagtgtaaactatgagcatggtggctacgtttcagtttcatataatttttatgtgtaatgatacagtatttaaaaaaatttttgcctaacccccacccccaataattagtaaaatcttttcttagatcatggactgtacaaaaacaggcagtgaggctaggtgtggtggctgtcacctgtaatccctgcattttgagaggctgaggtgggcggatcatctgaagtaggagtttgagaccagcctgaccaacatggtgaaaccccgtccctactaaaaatacaaaattagctgggcgtggtggtgcatgcctgtaatcccagctacttgggaggctgaggcaggagaatcgcttgaacccgggagctggaggttgcagtgagctgagattgcaccattgcactccagcctgggcaacaagactgaaactgcgtctcaaaaaaaaaaaaaaaaaaaaaaaaaaaaaaaccaaaagcagggagtgaatgggccagatttggcctacacactagtttgcaaacctctgttgtattggacttctcagagtttatgagttcttgcatgttgttaaattttctctgcctttcatagttgcactgacttctatggatttaaaattcttagcttgactcagcctggtggctcatgcctgcaatcccaacactttgggagactgaggcaggaggatcacttgaggccaggagtttgagaccatcataggcaacatagcaagactccatctctacccaaaaaaaaaaaaaaaaaaaactgggcacagcagtacacatctgtaggcctagctacttgggaggtcaagatgggaggatcacttgagcccaggagtttgaggctgcagtgaactataatggcacccctgcactccaggctgggtaacagagcaagaccctgttccacgaaaagaacataaaattattagctcatactttctttccttgaatttcttactcaaaagagtttattattccattttcttttggtataaaatgttgctgtcaaagtctgatgattatttaaatttctcttttgtataagttacctattcctgtttttttttttttcattttcttttacttaagtaatattgctagaatttttcttggtatgttggtcatcctggaatgaatttctcctgtagtgtggtcttttaatatgtatttttagttcaagtaaattttcttgagttgtatttttaatatttgctcttttttttgctttggttctcttcaaggattcctattattcatatgttggatgttcttttttattttcaatatttctcatcttctgtattatttattcattttttatatttaaattaaatatttttattttcaatttgtctttctcataaggcattgtctgttttccttattcactcttacattctttgtagctgttttcatttctggaatgattttctttttcatttctagttgtatcctgagttctgtcatctcatttctgagcttttctaaatctgatttatactattttatgttatgtgtcacttaaaaatgtcttttaacttgttttgaaatattagatgataggccaggtgcggtggctcacgcttgtaatcccagcactttgggaggccaaggtaggcggatcacgagatcaggagttcgataccagcttggccaacataatgaaactccgtctctactaaaaatacaaaaaaaattagccgggcgtggtggtgcgcgtctgtagtcccagctacttgggaggctgaggcaggagaattgcttgaacctgggaggtggaggttgcagtgagctgaggtcgcgccactgcactccagcctgggtgacagagtgagactccgtctcaaaaaaaaaaaaaaaaagaaatgagatgatagttttgatctattgtattggtatgtttttctcctgtgctttcctgccctacatggatgttactctggtccctttttctttgccttataaaaacattgtattggggccaggcatggtggctcacgcctttaatcccagaactttgggaggccgaggcgggtggatcacttgaggtcaggatttcgagaccagctcggccaacatggtgaaaccctgtctctactaaaaatataaaaccatattagcccggcatggtggggggtgcctgtagtcccagctacttggaggctgaggcaggagaattgcttgaacccaagaggcggagattgcaatgagccaggattgcaccgctgcactccggagtgagacttcgtatcaagacaaaaaacaaaaaaaattatgttggattttaccttgatattttatttcacttagtttaatgtgtaaaattggtttttctctacatttctttttaaagagccatgtattttaaaatcagtgactcatgtccaagaagttcaaacacgagtagagatagcaggaagtggtttattctgaggtcttgaaaagaatgaattaaccctgtaatctccccagtattctttttgatgttcctattgacatcactatattcagtgggtgctcctttctatctgctacattagtttttgaaagctttctttctgactcagtttatctcatgtgctaacttcctgaaccaatcctggaactggccttttctaccagaaacactcttttcttttatcatggaatagtattaaaaaccacaatctggatcttttggacagttcagctgtttttccgtggcttttttttttttttcgagacagggtcttgctctgtcatccaggctggagtgcagcggtgcagtctcggctcactgcagcctctacccgctgggctcaagcaatcctcctacctcagcttcctgagtagctgggaccacatgggaccacaggtatacaccaccatgcctggctaatttttatattttttgtagagaaaagtttttgccatgttgctcagcctggtttcaaactcctgagctcgtgcagctcacctgcctcggcctcccaaagtgctgagattacaggcgtgacccactgtgcccagccccatggctgtctttttcttctgaccctggttttgtagttatccaagtagcaactcttggtaagcctaaaatctatacgctttaaaatctgaattcataatatagcaatttactaacttgtggtatttctaagaatgaaatatgtatcatacattttaatttttacaatgattctttctgtccttcattcctgacataaagcctatggtaaattaaatctcatttccttaacatactgctcaaacccaaccctttcccccattcttctattaaaatttgtccagaaccatagagtcacagaatttaggaaatgagtagaattttggagcagtgatttcagcttttcataatttctttctcttcttttgtcttgctgtgttgcccatgctgaagtgtagtggctagtcataggtgccatcatagcgcacaacagctttgaacagtatctgggctcaagagatactcctggctcagccttccaagtacctgggactacaggcacacttggctcataattttttttttttaaatgaatcactttaatgatgaaaaatgcccactttttgtgatcataagacatttacttgtattcagatattatatgtatcatgcaaggtaaatttaaaaggaccttaaaaagcatatttttggaaacaaatttagttgctattgcataacaaaaaacttacagtgattaagggaaactgataattagatggataacaaaaaataccgggttaacagaagagtatcgaaggttactagtggataaaatctggccttttattctaagtcacaccgctgcctggtcaagaactgaaaacatttgaaacatgctccatcacactgcagttaccatactctcttatcctgacctcatcctttttggttacagatttatgggagccaagagcctctaatgttgctttctcattttgctttaattacttttaaaggccaatctagggagcacttccaaaacacattgataaaaaggaagttaagtctttgaaacatttgtagttatccagcatactactggctatttttcttttgtattgggtgggacaaaaaatagtcactaaatacttgatataagcttttttttttttttttttgacaattttacatttttgggtgagtaattttcctcaaattagaatgcacaagaaaaatctggttaatcagtgttccaggtcgttgggctcctgttaatcagaagttttactgtataatcataatgtattttggatgttctcatttatgttatttcttcaattctttgtgtgggtactctgattgcttgattacatctgcctggcatagtcgtttttaaagcagcatttataataaaattttccatctttgcaagtaaaatgagaatatggaaagacaattgatggttgaagcatgattgtttcctcttgtctttacttagtgtttagtgggtttcaggttttggataaagagaaatgaatatgattattgtcctggtccgaaatgattcatgtatccacctggagacgtagagttgatagaggtgtaggcttacctctattatctcctcatacagagcagcgctacttcctacgtatgtgctttacatttttggggatttgcataagattttttttttccatgaaaataaggttctactaaaaccaaatacagaaacatttgatagagagatactttataagcacctcttagggctgaaagggtttcttgtctagcatcctgccacttgtaacaccagcaaattctaggcatttgggttcctataatattattttagagtcctgtggacctagctatcttattattctagtgtcctcttttttttctggagacagagtctcactctgttgcccaggctggagtgcagtggtgcaatcttggctcactgcaaactctacctcccaggttcaagcaattctcctgcctcaacctccagagtagttgggattacaggcgtgcaccaccatgcctagctgatttttgtatttttagtagaggccactatgttggtcaggctggtctcaaactcctgacctcaggtgatctgcctgccttggcctcccaaagtgctgggattacaggtgtgagccactgtgcccggccattctaatgtcttctttttatcaagacttctggagagtggacaaaaactaacagttgtggcactcaacttggtgctttatattattattgatggggtttaggacatgctactcccaaatttggcaccttggcatataagctgaaggatttggagaaaacagcagaagcacgaaggtctctgaccttccccttcctctcttccctgaagcaggtcctaagacctaggagggactttctgaccttctctgaaccagatcctaagaccttcatgtgagagatgcccttcctgtatctggaagagaggagcatcctcatccccatagagaaaaggacgcagagtaatctgagtagtttcccccagtttatgatacttacctcttgctctccgtgctatcatttctccataactcaccagtcctcatcaaccctgtataaaaacactcaagtttaactgtttctttggattttcatttccttatgcaggctccggtgtcacgtacaacttacaattaagtaaatgtgtatgcttgtttttttggtaaactatcttttgtaataggtgccctagccataaacttagaagggtagaaggaaaataatagttttcctcctgtacattattttatttaattctttaatcaaacttaaaagtcagatattatccacattgtcactcaaagaaatgggtgctttagactcagggtctaaaatttcccttttcttttgttttgcttttgggtaggagagaagcatacctcttgaatttaaagacattggcttttctactcattttctctgaatgatttcattcacaacttttatttttgtatttatttttttgagatggagtctcgctctgtcgccaggctggagtgtagtggctccatctcggctcactgcaacctctgactcctgggttcaagcagttctcccacctcagcctcccaagtagctgggattacaggcgcatgccaccacgcccagctaatttttggtagttttagtagagacgggctttcactgtgttggtcaggatggtctcgatctcctgacctcaagatctgccctcctcggcctcccaaagtgctgggagtacaggtatgagccaccacacccggactgccattcacagcttttaattccgtcctgtatttgatgcctttaaaaatctgtattttggccaggcgtggtggctcatgcctgtaatcctagcactttgggaggcggaggctggtggatcatgagattaagaggtcgagatcatcctggccaatatggtgaaaccccatctctactaaaaatacaaaaattagctgggcgtggtggcgcgctcctgtagtcccagctactcgggaggctgaggcaggagaatcgcttgaacccgggagacggaggttgcagtgagccaagattgtgccattgcactccagcctggtgacagagtgagactctgtctcaaaaaagaaaaaatctgtgtttcagcctggacttgtctaataacccctatacctctatatctgcctcctgaacatgaatacttgactattgcagaggcctgtcagctcagcgtgtgcaaagttggagtcatcatctcgcctcttaaatatttatctccttgtatattctttgtgtttattccttgttctacttctacttcctgctcggggtgggtttaatcctcttggtcatgatggccaggagagcagtccaagcaacaggctactcagctgccctggtcaccaggagaatgaaccttttttcccaagtcaagattctttgcaggcagcaacgctaacatggaatgaacaggtgatgtaaaagtgatatacaaatatgcagtttattgtttataccaactctgacaaggtcgtaggacaatcagcagttaggcgccttcctcgaggaaggcctgcatataggtctggtttttcccattttatatttaccttcagttctttatgtaatgacttcatcctttatctcagcaaatacccccattacttttctagaccatgccctgtggtggagctaatggcatcatattttgttctgtctctagatctatttaagtcactagcttttttttttaaattagagtggcataaacaagagaggtagatccattgtcaaggtattcagtgtggtttgtgcagagtggttttgattgaaactgaactctacccagttaaattcccactggatttttgactcatcttttatagtcacaggatgcaaacatgtactttcttttgtctatttctctgaggtgtcagtgatctgttcacgtttcctggaaattgttgatatcctgttgtcttcatccatgttatctcctgtgtttagctcagagcctggcacagaattggtattcaggaaatatggatatttgtgttatactaggcattatgctgcaggctattgagaacacagagatttataaggtgtttacgggtgaccttactggctagattaggtggtgtaggacgttatatacaaatacagtgtcatagagtgacttttccgaggcacactgtttacccagaaggagttcttcagtgcttttggttgttttcatttgactttgttgcatgcatctatccacacatgtactatatgcaatatagtattttaatgtgttggctcaaaaactgttgtttctgcaataaaaataattagaaaatacacatatgggcttttcttttataaaattgtgactccacatcatgctccgtaatgttcttgttataaattttgacttgtttttctccacaggcagcagaagatgtcgttttcattggacctgacacacatgctattcaagccatgggcgacaagattgaaagcaaattattagctaagaaagcagaggttaatacaatccctggctttgatggagtagtcaaggtgagaagctactttaacttttattgtatatgtcttcaagttaaacattttgtcaaaagtataagataaaatgtaactattgcttttttgggatatacacacacacacacacatatgcacgcacatacatacatgtatatatgtttaaaaaatcagtgtttttacatttatttatttatttatttgagatggagtcttgctcttgtcgcccaggctggagtgcaatgatgcaatctcggttcactgcaacctctgcctcctgggttcaagcgattctcctgcctcagcctcccgagtagctgggattgcaggtgcctgccaccatgcccagctaatttttgtatttttagtagagacagggtttcaccatgttggccaggctggtctcgaactcctgaccccaggtgatctgcctgcttcatcctcccaaggtgctgggattacaggcgtgagtcactgcatccggccagaaatcagtgtttttaactggattattttattatttttagagatggaggtctcactctgttgcccaggctggagtgcagtggtgcagtcatagctcactgtaaccttgaactcttaggctcaaatgatcctctcgccatgactcaagaatccctccttctttagcctcccaagtagctaggactgcagacacacaccaccacacctgactaattatttttattttgtagagatgagggtctcaccgtgttgcccaggctggtctcaaactcctgggctgaagtgattctcccgccttggccttcccaagtgttgggattacagatgtgaaccattgtgcctggccaacttggattgttttaaatagcataagttaaaaagagtgagaaactgtttgagcattgtatttaatgaatcagcagtgactcagactttcataggaaaaaatttggtgattaaaaaatgtactgtcagatctctggactgcatttaatagtggtatgtgtttcatgtgttaaacattaagagtttctctgtatatctttatcttgagcttctctccatgtgcataatatgtaagttaggatcatgtttctggtgaaagtggtatagctataggtaattgtatattgcaaacatttagcaagggccttctgcagctgaaggcttctgagggagaaatgcagaaattgaagtatgcaacttctccttttcccatgagaaattattctgtttttttctagttagaagagagtcctcatgtagagttttaaccttgcgatttgacttagcctgcaggaactcttcatttcagcatttcgtattgttacttttggcattctgtgttgggttgttcttcattgtgcaagatcatttcatgcattagaggacgattagaaaacttgccccctagttaataaatatcctcagcttcttgcccatatttacctgcatttacttttatctatgtgtatccatgttgtttcttcccacttgttacaaggaagaggtgttccacatcctctggaaagccagttcctcctcctacgctccaaatgtattctttatagccttcacaggctatggttttactgattatcttttctctcttctgtgtcttaaaattctcctcatcttttagctccttttgttatcattgctattaaaaatgctcagtgaacaaatgtgttggtcactcagttatgtgggaaggatgtggtgatgagatacacatgatctgcgtatcatagttctcacagtttagtgggaaagaaacaaacatttcttccattcgtaaagcaccatcacccctatcactctacagctagttgccaccttctttctctcttcccctttcagtgccaaagctcttagaattgtccttcctcactttcatttctgtatctttcacttaatcttttcttgccgtctagcttctttcctcattcctactgaatttctcttgcaaagctaccagcaacctcttccctttgttaaatcaatatgtaattttgaattctgatcttatatcaatctttgagcaacatttgagtctcttggtcagtccatacttctctcatgagatactcacttttggcacattactcagttctagtttttgtgttttttggcttttttgaatgccattcttagattccttcccgattgttcttcctatctttgttccttaaatgggggttttattctgggtcctgagtaggacatttcctctttttattgtgctaacttgccctgggcaatcttactttttttcatggcgtcaattgccaccttttcttttttcttttactattattattattttttgagacaaggtcttgttctatcacccaggctagagtgcagtggcatagtcatggctcactgcaacgtcaacctcgtgggctcaagtgctcctcccacgtcagcttcttgaataggtgagactataggtgtgtgccaccacagctgcctacttttttatattttgtagagacgggggtctcactattttgcctagactggtctcaaattcctgggctcaagcagtccttcccctcggcctcccaaagtgctgggattacaggcatgagccactacacttggcctattgccacttttctgaccaatctcaaatgtatgtatctgttctgaacttcaggattacatatccagttgcttcttatatagctctcactacttgatgcctctgaggcaccttgaaactaacaattaaaagctgaactcatctttctcctgaaactagagattggtactatagcccatgcacacctatttttataaataaaggtttattggagggcaaccatgttcatccctttacatattgtctgtggttgcttttccactacagtggtagagctgagtagtagactcaatatgtggagtagactcaactacatgggacacatagtagactatgtgactcacaaagcctaaaatatttacttcctgatccattaagaaaaagtttgcctatccctgctctaaaattcttatccttcattcttttccgcctaggaaggtggtggctagaaacatagagtaattcttaacaaatgcgactgtggagaattcactcagatagctttctaatccatttacttctttctttgcccgtactaaccaaccccagattccagctactatcatctagtctggattacttcatctgccttctaattagtctccttgtagtcattcttgcttccatccaattaattttttaaaaattcttcacctcaagtatttataatgtctttgtgttacaaacagtctaatatacttttagttatttaaaaatgtacaataaattattgttgactgtaatcactttgttgtgctgtcgaatactagatcttacccattctatctaactggacccatttttgtacccattaaccatccccacatcacccacccccactcctccccactacccttcccagcctctggcaatcatcattctactctctatcactgtgagttcaactatgttaatttttagctcccacagatgagtgagaacatgtcaaatttgtctttctatgtctgacttagttcatttaacataatgtcctccagttccatctatgttgttgcaagtgacaggacctcattctttttggtggctgaatagtactccattgtatatatgtaccacattttaaaaatccattcgtctgttgatggacatttaggttgcttccaaatgttggctattgtggatagtgttgtggtaaacatggtagtgtagatatctctttgatagactgctttcctttcttttgggtatatacctagcagtgggattgctggatcatatggcagctctatttttagtgttttgaggaacctctatactgttctccacagtggctttactaatttgcattccccccaacactatacaagagttcccttttctctatatcctcgccagcatttgttattgcctgtcttttggataaaagccaatttaactggggtgagatgatctctcattgtattgcatttctctgatgatcagtgatgttgagcacctttttatatgcctgtttaacatttgtatgtcttcttttgagaaatgtctattcagatcttttgcccatttaaaaaattggattattagattttttttcttgttgagttgtttgagctccttatatattctggttattaatctcttgtcagatggatagtttgcaaatattttgctcccattccatgagttgtctcttgactgttgatttccttggctgtgtggaagctttttaacttgatgtgaccccatttatttatttttgctttgcttgcctgggcttgtggggaattactcaagaaatttttgcccagaccagcatcttacagagtttttgcaatgttttcttttggtagtttcataatttgaggttttaggtttaaattttcaatccattttgatttgatttttgtatatggcaagagataagggtctagttttgttcttctgcatctggttatccggttctccgagcaccatttattgaagagaccgtcctttccctaaggtatattcttggcacctttgtcaagtgaattcactatagatatatggatttatttctgggttctctattctgttctattggtctatgccagtactatgctgttttgattgctatagctctgtagtataattttaagtcaagtagtgtgattcctccagttttgttcattttcctcaggatagctttgcctatcctgggtcttttgtggttctatataaattttaggatttttttttctatttctgtgaagattgtcattggtattttgataaggattatattgaatcggtagattgctttaggtagtatggacattttaacaatattgattcttccaacccatgaatgtagaatctctttgcatcttttgtgtccttttcaatttctcgcatcaacgttttatagttgtttttttgtgtgtgtgtgtgtgtgtttttttttttagatggaacctcgctctgttgccaggctggagtgcagtggtgcaatctcggctcactgcaacctctgcctcccgggttcaagcgattctcctgcctccggctccctggtatctgggactataggcatgcaccaccacgcccaactaatttttgctttgtttttagtagagacggggttttaccatgttggccatgatggtcttgatctcctgaccttgtgatccacccacctctgcctcccaaagtgctgggattacaggcatgagccactgaacctggcctatagttttcattgtagagacctttcacttctttggttaagtttattcctaggtattttattttattttattttattcatagctattgtaaatgggattattttcttgatatcgtcttcactgttggcatataggaattcccatccattaattaatgatacttcagtttgagtgaccaaaaatccagatttgatcgtatgcctatctttaataacttttgaatgactactcatataaatgttttaaatggttggattttgcttagctctccaaactgatactgtgccagtctatcctttgcattgtatgtatccgccatacttgacatcgttcagattcttgaaacttatgtgcttagtcatatctgcttctgtcttcattcctgattgtctcttagtcattgtttaggtcttggcttaaatgtaaattcctcacataggcattccttaactgtcttcattagattaggctctctgctgtatttttccttaggaccctacacttaactcatcacattttaaatcatttattcattcatctattcagtagatatttaccaagtgcacgcaatttgtctgacactgtttgaagtgctgttgatatagtagtgaacaaaagagactgaacatatttttatgccctcaaggagcttacactatagaaggaaacagatgataaataataaaacatatgttctatgttgaaacataagagaaaaagactgctggaaggtggggctatattcacaattttatatacaggcatgtcttcatatctacaagggattggttccaagacctaccccctcagataccaaaatttgttgatgctcaagtgccttatatgaaatggggtagtgtttgcatatatcctacgctcatccttctgtatactttattttattttttatttttatatatttatttttttgaggtggagtctcactttattgcccaggctagagtgcagtgtcatgatctcggctcactgtaacctccgtccaccctgggttcaagcaattctcccacctcagcctctcaagtagctgggattacaggcatgcaccaccatgcccagctgttttttgtatttttagtagagatgaagtttcaccacgttggccaggctggtcttgaactcctgacctcaagtgattcacctgccttggcctcccaagtgctgggattgcaggtgtgagccactgtgcgcagccctgccgtatactttaaatcatctctagattacttataataccctaaaacaatgtaaatgctatgtaaatagttgtcccactgtgttttaaaatatgcagtattttaattttcctccctttcccttccccttcccctccccttccccttcccctctccttcccctttcccttccccttcccttttttgggtttaatccatggatacagaacccaaggatatagagggccaagtgcatgtttagcagaccatctaaggaagtggcaggacaagtcatgttgctatcctggagaagagcaaagcatattaggcagaaagaataacaagcgcaagattgttggttgaggttgaagtgtacctgctactgaataaacaccgaggaagcatgtgattggaatcatcgagagagacaatttagagataaggtaaaaaaagataatggtgtagtagggagcttagatttttagggccttacaggccatttcagtattaggtaaatgtctccttcctacacggagcgtaagcttctgatggcagggatgctgctctctttattactgtatcacatgcacatggtgcctgacatattgtcagtgcttaagtcaatgctcagtcagtgctcactaggtatttgttgaatgaataatattctaggagataaattttatacatatactcattttatatacgttgccatttagtacatattgtttagtcacatctattagaggcaccaaaagaaaccaaaaaccaagagaaaaaattaaaagacaatagaaacatatccacatatgcttcagatattggaattggctgagataactacgatttatatgctaaagaaatccaaggaaaatatggagaaaatagataagtatataaagaatttcatccgggtatggtggctcatgcctgtaatcccagcactttgggaggccgaggtgggcggatcacctgaggtcaggagttcaagatcagcctgatcaacatggcgaaaccccgtctctactgaaaatacaaaaaatatttgagtgttgtggcaggtgcctgtaatcccagctactcgggaggctgaggcctgagaatcccttgaacctgggaggtggaggttgcagtgagccgagatcacgccattgcactccagcctgggcaacaagagcggaactctgtctaaaaaaaacaagaatttcacaagagaatttgaatctattttaaaaattaaatacaagactgggtgcagtggcttacgcctgtaatcccagcactttgggaggccgaggtgggtggatcatgaggtcaggagttcgagaccagcctggccagcatgatgaaaccccgtctctactaaaaatagaaaaattagctgggcgtggtggtgcgcacctgtaatcccagccactcgggaggctgagtaggagaatcgctggaccacaggaggtggagcttgcagtgagccgagatcatgccactgcaccccagcctgggtgacagagcgagactccatctcaaaaaaaaaaaaattaaatagaaattctgtaactgcaaatatatgaaaataaggactttagatagacttaacattggactcaaccaagcaaaatatagtatccatgttatagcatgtatcagtttttgtgtgtgtgtgtgtgtggctgagtgatattcagttgtatgaatatgcttcttaaaaaaatccacctgaggtcaggagttcaagaccagcctggccaacatggtgaaaccctgtctctactaaaaatacaaaaaaattagttgggcgtggtggcaggcacctgtaatgtcagctacttgggaggctgaggcaggagaatcgctagaaccctgggggcggaggttttttgtgtgtgtgtggctgagtgatattcaattgtatgaatataccacttaaaaaaatccatctgaggtcaggagttcaagaccagcctggccagcatggtgaaatcccgactctactaaaaatagaaaaaaataagctgggcgtggtggcaggccctgtaatgtcagctactcgggaggctgaggcaggagaatcactagaaccctgggggaggaggttgcagtgagctgagatggcaccactgcactccagcctgggcaacagagtaagactctgtctaaaaaaaaaaaaaaatccattcattagttgaaagacatttgggttacattttgaccattgcaattagtattgctacaaatatttgtatgcaagtatttgcttatatatttgtttgttttgagatggtatttcactcttgttgcccaggctggagtgcagtggcgtgatcttgactcactgcaacctctgctgagttcaagtgattctcctgcctcagtctcccaagtagctgggattacaggcacccaccaccatgtctggctatgggttgtttttttttttttttgtatttagcagagacgggttttcaccatgttagactggtcttgaactcctgacctcaggttatccacccgccttggcctcccaaagtgctgggattacaggcgcgtgccactgcgcccagccatatgtctgttttttaagttatttggggtatgtacccaagagtggaattcctgggtcatgtggtaattctttgttcagctttttgaggaactgtcaggcatccaaacctttatgtactcccttcctcttgtataatccactcctcttcaatttgggtagaacctgtgaattgcttctctaactaatagaatatggcaaaggtgatgtgatattactcccttaattaggttgcattatatggcaaaagtgatgggatgtcactgcattcaattacattatgtggcaaagtggttgggtgtcactcttgtgattatgtttcattatatagtacttgatcttaacagactagagaacaagattctttttgctggcttgataaagtaagcagccatattaaggaagcctacttggcagtgaatggtgggcagattctaaggatctatgtaaggacagtctctacccaagagctagcaaaaggctggggtccttcatcatgcagctacaaggacataattctgccaactacctgaaagagcttggcagcaaatttctccccatttgagtctccagtgacaatgcagcctggttcactccctgattgcagccttgcaaacccctgagcagtgtatgatgaaattattattattatttccttatgaggtcttgtcctctttacctttttgttttagacatttgtgtgaatttgggtaggggtttggatgtgtcattatgaaccttgatctactcagcctgaatatttctaccagtataattatatatttttttgatgaggaatgttgcctttttgatatcttcaatttggacttgatttattcccaagaatactgatgtgtcactgtccaaattatttctggcttgatgatgaatggtggagtcctcaagggttcaaggaagagaccatcaggagagtgtttgatctggaaattctgtttacacgggagatttttccttatgaaattagtgaatgtagtgtctcctaggaagggaatgtttcttggctaaaggtccaaaggtgaccgttgtgtgctgggacatgggaaatgtgacgggtattatccatatctgtcaactgagtagtttgttgattccgagggagagcttgtggaacaatggcaggaattaaggtaaatatactgccacccatatcaataaaatttttacttgtttctccgctaataattagtgaaaattcgtcttgtgagttgaagagtaaaaggagaaatgggtacttgatttgctgttagaacatttgcctactatcattttttcccaattctcttgaataaaacagaacaattatttttccattgtaatttcttcttacaatctctgcaggtttctttatcaaaagactggtgtttaatttttggagtgggagcatctagttttatcttcaagggtatcatcttattctgggtcttatactgcctttgttttcaggctcttttgaaatgtgtaatatggagttacattgtttgacaatgtggtgccttcccagccagtttttgcttgtttataacattttctttttctggcttaaggctgttcacaagaagtgaggaaggagctggggtcacaactacttgagggcttactcctgaatgctaactgaaggtagtaagagcccaccctggaagtctgcaaggggcttatccttcgtctgctagaacaactgaattagagttacctgttttcacaggaaagattttggtaatagccttcaaaagaccgtgtccaatatttacagtttcttttttttgtttttgttttttttgagacaagagtctctttctgtcacccaggctggagtgcagtggcgcaatcttggctaactgcaacctccacctcccgggttgaagcagttctcctgcctcagcctcccaagtagctgggaccacatgtctgagccaccatgcctgactaatttttttttttttttttttggtatttctagtagagactgggtttcaccatgttggccgggtcttgaactccttacttcaagtgatccacctgcctcggcctcccaaagtgttgggattacaggcatgtgccaccgcgccccgtcattcacagtttttctaaaccccactggctttctgtgcatttggggtctgaagtcactctcaggatatttgtttcccctttctaataggtcttcctatttccctctccttgctccccactttgtaactatccttggtgaaatgatgccatttataaagagaagaccatgaatttgcattacatatttaatgcatttaaagaaacagaagtctgactctgagagaccacagacttagtctgagccaaactcatgggagtctcctaatggcatattgaatatgttgtttgtgcacctcctgtcttgggctcacagcctaatggttggccatctctaactgcaaacctgacagtgccttgttggtttaagatttggagagactgtctctcctaggcccagacttccatggacaaagcaagtcaagacagaggaaaatactcaaggttcccaggtaaattgtgttctatttggatgatgatctgatgaaaccttctgaactcactggcttctagagtcagcatgaaaatgggcttatgaaacctatgcctgtcttctttcaggtgaactttgacttatggacttagaataaaaaatgttgaggacagtatattagtaatatgggaggtttcttccaatattaaacattttcaaatgtgataagaaattcagtgggtctttattcctacagttgttgaaaaggaaattggacctctacccagtgtgactcatctcaccattgtggttggggagacccctgagggggtcgctcagtgggcctcagagaagcatgcagatgccagatctaagatcttgaactgtggcttttagtgggcttcgaacatgtgtctgtgggtaatacacttggttttgcttgttcaacaggttattttggttatcttcttaggaggctgcatctgaatttgcagcctctgttctagtaaatttggaaaatatggaaaggtagacaggagaaaagaaatctcatcttttcagtttttttccttgtatgcattagatgatttgtaacatcctattacactctcaaatgattgattctcattatctgcactaacgactatttctgaatttgtgacgccacagctgaacctgcaggttatagtttccagataagcatttacaaataatttttaaggaatgtccttttgtttccctgggaaatttttttttttttttttttttgagacggagtctcaccctggagtgcagtggtgcgatctcagctcactgcaacctctgcatcccgggttcaagcaattctcctgcctcagcctcccgagtaattgggattacagacatgaaccaccatgtccagctaattttgcatttttagtagagacagggtttcgccatattggccaggctggtctcaaactcctgacctcaagtgatccacctgccttggctccccaaagtgctaggattataggtgtccaggtgtgagccactgcgcctggtggaaataattttttttgagacagagtctcactctgttgcccagactggagtacagtggcacaatctggactcactccatccccgccccctgggttcaagcgattctcctgcctcagcctccggagtagctgggattacagatatgcgccaccatgcctggctaatttttgtatttttagtaattagtaattttttagtaatttttgtatttttagtagagatgaggtttcaccatgttggccaggctggttttgaactcctgagcttgggtgatccgccctcctcagcctcccaaagtgttgggattagaggtgtgagccaccgtgcctgactggaaataatttttaatactagttttatttttagtttgtttttatttctgatacaagaggctgtacatatttttcttttaaatttggctattaatttaggtttctggtatagtgactccacattcacttggagctacaccattcacatttactagtttagatatattgagtataagattacttttgagagtatctatgcagatagaagtttgctgatggaaataaatagtaccgaattttggaatatcttgggtttttagcaacagtttttcattggcagagtgcatatgccaattacaggtaattctgtcttttaaaaaatgtttagtgttctttaaaattagtctacagtgtttttaagactaaagtcttttccttgataactatattctattttttttccccaagtagtttccaccagttatgatacaattttagtttgttacatttctccttcaaacatttgttcctttcttatttgaatatgtaggatgttacatggagacagtttacccatacccctttaaagcattgtgtgcagtacttcagtggtcttctgcaactcttctttttaatggcttattaatctgtccttgaatcatccttttccttagagagaaactaatgttttaaaatgtaattatcaagtaatcgtttggtatcaagtatttgcctttaacaaatttaattttattcaacatttcattaccttgatctcaggaactggagagcagagtgaaaggcatgcacattaagatattggagacaggaattgggatcacagcttttttttttttaaatcaatgaataacatgccacagatcctgctttcaaagagcttaaagccttctgtgtccggaattggtgggttcttggtctcactgacttcaagaatgaagccgcggaccctcgcggtgagtgttacagctcttaaggtggcgcgtctggagtttgttccttctgatgttgggatgtgttcggagtttcttccttctggtgggttcgtggtcttgctggctcaggagtgaagctgcagacctttgcagtgagcattacagctcttaaggtggcacgtctggagttgttcgttcctcccggtgggcttgtggtctcgctggcttcagcagtgaagctccagaccttcgcggtgagcgttatagctcataaaggcagagtggacccaaagagtgagcagcagcaagatttattgcaaagaactaaagaacaaagcttccacagtgtggaaggggacccgagcgtgttgccactgctggctcgggcagcctgcttttattctcttatccggccccacccacatcctgctgattggtagagcctggtggtctgttttgacagggcactgattggtgcgtttataatccctgagctagacacaaaggttctccacatccccaccagattagctagatacagagtgtcaacacaaaggttctccaagtccccaccagagtagctagatacagagtgtcgattggtgcattcacaaaccctgagctagacacagggtgctgattggtgtatttacaatccctgagctagacataaaggttctccatgtcctcaccagactcaggagcccagctggcttcacccagtggatcccgcaccggggctgcaggtggagctgcctgccagtcccgcgccgtgcgcccgcactcctcagcccttgggtggtcgatgggactgggcaccgtggagcagggggcggcgcacatcagggaggctctggccccacaggagcccagggagggggtgggaggctcaggcatggcgggctgcaggtcccgagccctgcccggcgggaaggcagctaaggctgggcgagaaatcgagcgcagtgctggtgggctggcactgctgggtaacccagtacaccctctgcagctgctggccagggtgctaagtccctcattgcccggggccggcagggccagccggctgctccgagtgcggggcctgccaagcccacgcccacccggaactccagctggcccgcaagcgcagctagcagccctggttcccgctggcgcctctccctccacacctccgtggaagctgagggagctggctctggccttggccagcccagaaaggggctcccacagtgcaggggtgggctgatcaggtccctcaagtgctgccaaagtgggagcgccaagagcgagcgagggctgtgaggactgccagcacgctgtcacctctcacttcttcaggaggactgcaagtattcaggcaattgactacattttgataatgctaagctcaaggcgcaggggcctatgcatataggatgggcatgtaacctagttttaggtatcattgcagattttccaatggaaatgatagctaagtgaaacctcaagtctgagtggtagtgagttagctgaaaagtgagattgatgatggacacagctctaatgtcagtgaaaacatcttattgcaaaagcctggaggtgagagacagtgagaactctggaaaactgcagatttgtagtatgaggggctgcagttagaaagggagctagagagaaaattaggatccagatatgtatgggctggaatgtgatgtaacttattttgaaggctattcttgtggtttggggagcctctgaataatttcatgcagaagagttaacatgacagaattgtggcattagaaaactcattttggtttgttgtgtggaaagtaaattggagcatggcaaaacttgaagttggtagacaaattaggatcctcttctaatccaggatagaaacggtagacccctaaaataaagtattgtatgcaacaaagtagatggtgttgagaaagatagtggaagtggaatccatgggattatgtgatctgttcaatgtcaggtgtgaagtggagggaaggatcattgatgattattttactgcatttggttgtaatacctattaacacaccagtttcagaagaaatttatttaatgtcctttagttctaattgttcgttaagaggaaatagtaatacccgtttacaccacagaacagagtatggccgtgtatttgaatgagttttgtaaattaggcagtgtagatttaaagtagtaattgtttttatcacctaattggccagactttaaaaactgtactcttgctttagcagaaggaggcaaataactaagaaagctagtgtgaaggaaatcatttaaaaaagaccctaaaaacaaaaaccaaaaaattggagacaagctgtgtctcagcaattagaaagtataacattaaacattagtgtatttgtccctgctaaaccaagaataatcagttttcctgatgaagcctcaaaggttttatattttggaaaaaaagactcaattatttttactatgctgtttttacaatgatagaaaagtgtactaaattttagaaagcttttttttttctttgagacgaagagtgtcgctcagtcacccaggctggagtgcagtggcgcgatcttggctcactgaaaagcaccaccttccggtttcaagtgattcttgtgcctcagcctctcaagtagctgagtttacaggtgtgggctgccacacctggctaacttttgtgtttttagtagagatagggttttgccatgttgcccaggcttgtctggaactcctggtctcaagtgatccaccttcacgacctcccaaagtgctggaattgcaggcatgagccactgtgcccggccgaaagatttggaagtatattaaaacagaaagaatcttctgcctgactttgagttaactggattatgtggaagctagaaagccattcctgagcccaggattgtttaaaagtttctgctttactttatatatgaatgcagaatagtttgaggacagcttttagggtacagatataactcttacctgtagtgtcttgaaacaaattattatttttttttaataaacagtcactgattcccttctagaaccagctgtaaactcctaagtggctttcatatgaatgggtagcaggattctcatccacagaatagaaaattaaggattggtaagtaggcagtagcaagtgagaaggatgtctgaatcatgaatggtggtcggcgttgacactaataccactatcaaaatgtatgggtgtttagcatctgggaagaatgattcgaatgtgcctgtctttgttgtagtgttttctgcgcttccttgtgttttgccctgttcaccagcaataccgagttcgtagatcgtctgatccagtgcattataagagaggaagtacatgttttttccagtattgtagcgccagggttagttctatgttatctaggttcagaagatgagtaatgacacaggatataacaagtaaggccaggcagggaaggtaccaacatggtagtttggggtggcgggctgcccattttctcataattactaaccttaattgagtacctactgtgggccaggtgctgttctaatgtgtttcagccttgactaatttcatcttcttaataaccctatgagatagatactgttattatgtccattttacagatgaggaaaccgaataccagagaggcactctagtaactcagtcacagtcacagaagcagtattggagcccaagccttctggcatagcgcctgtgttctttttttctttgagacgaagtcttgctctgtcgcccatactggagtgcagtggcactatcttggctcactgcaacctccgcctcctgagtagctgggattgcaggcatgcgccaccacgcccggctaatttttttgttttttttttggtagagacggggtttcaccatattggccaggctggtcttgaattcctgacctcaggtgatccgcctgcctctgcctcccaaagtgctgggattacaggcaggagccgttgtgcccagcccacacctgagctcttaactgcaaggcttggttaccccacaggccatgttctaggtattaacaaataaatgacatttgcagaaaaggcaccagatttttgttaactcttttcacgttttttctggttagtttttactaccatttagttagtttttgtagcatcatccaccactcccatcatattcacagttaaatagtactttttactgttactattcttgggttgggtgatagagcccacttaatgtgagttgttttgtaatagaggaataagaggaataaaagaaatgggtactggtttgcttggtttctttcccttttctccgtttcttaagctactcttttggcattgtattcttagtactttcctgtaactctttccccatcggtgctcaaaagagttaaatagcttcagaacctgagtgtgccttccctcaggacaagctgggattacagaaagaatggaccaccaggtagtttatcacttagaagaatagaataaaatgatatcattggactcttttttccctacctcctgattggaaaccatcaggaataccatcatctgagcattgttgctgacacatttttaatttttttgtgtactttttgttttctcaattgtattacttgtgatatgaaaataaaactattctaaagacttcaaatgaaaaatttttaagggaaaatgaatagcatcaaatttgttttaacaattctgctgaaatttttatatttgactttttcttttttttttccagacagggtcttgctctttcacccaggctggagtgcagtggtgccatctcggctcactgcaacttctgcctcccgggttcaatcaattcccctgcctcagcccccggagtagctgggattaaaggcgcatgccaccacgcccagctgatttttgtatttttagtaaatatgggatttcaccatgtcggccaggctggtctcgaactcctgacctcagatgatccgcctgcctcagcctcccagagtgctgggattacaggcgtgagccaccatgcctggcatatttgacttttcttccactttggggaggattattatgtaatgtgtcagaaattttcttttaataaattataggatattattgaacattatgttaacagagtttattgttctaagccctttcatattttcatgtattgtgtgtcatgtaatcatagatgtgagagctgtcttaagaatattttaaagagtgttaagaataatcagctccactttttcttcaaatattgccaagctgtatttgtgaagagataatgttgttttgtttaaaatatatttattttatataaataaagaacaaaggctgggcgcggtggctcactcctgtaatcctagcactttgggaggctgaggtgggaggatcacttgaggtcaggagttcgaaaccagcctgccaagatggtgaaaccccatctctactaaaaatacaaaaaaaattagtcatacgtggtggtgtgtgcctataatcccagctacttgggaggctgaggcaggagaatcgtttgaacctgggaggtggaggttgcaatgagcggggatcgctccattgcactccagcctgggtaacacagtgagactctttctcaaaaaaaaaaaaaaaaaagcacaaagtatatttagtaaaataaagtttaaccttttacatttttatgaaataaagtttgatatctatacattgaaatgagctgctttcttttgttttgtattataacttaaacttgtggcttttcaatttgaaaacttattgccatgtagaatttgattttttttttttcctaatgcaacactttacttaaaaattatggagtagaactatattttttagaagagcaggttttacaaaacctaaaattcaaactctggaagttgcatgatgtggtggaagaagtgctggactgagaatcccaaaaatattgggcttggttttgcccaatgccaacagtatttcactgagtgcaccttgttttaaactgaagcaaaactgaagtgtaaaaagtaaagtagaggttcctcttcaaagactttcctccccatctaattaggaataaatagtaacttctcttagaagcaaaatttattctaagacctgtgctaacattcttaaatatctgctagctgtaataaagaaatcaatgtactttatgttctcagctcccacaatttagcctaaatatttgccctggcatgcttatactggtccaagcaagcattaagtcatagcctgttcctcttccttatttgaaggtgtttttacctttctcagtattccacaagttacttcctccttcctttgttctcctctgccgttgcctcttttaaaaagttctatgttgttagccaattgggacaaatacaaaatgtgaggtcctgttccagccaatggaaaccggacacagcagtagggtgggcgcctcaggttataaatgaccctgtctcctttgttcaatgtactctcgtggcaaaactgctggcgaatgtaccctttctgcagaaagtaaacatggccttgctgaggaaattaaatttatgttccagtgctgtttctttacggcactggggaacaagcatttctaacagaagcctgtctggttctgagtccctgccctgaacccctgcctttggatgtcagttaactcacttataaaaccgctgctctggagatgaatagttctgttggcatttgtgagattgtgtcttatcctaacagactaatttttatggaagctgatgcggatagttgtttattcatggaagaaataatgtgttgattgcgttaatttgctaaactctggggatttagtagagagtaagacagctagttgttgccctcatgaaggttaagtgtgaaaagggctgcataattgcagggcgtggtgtatgtgttcatgtggcaatgatacctagccaggtgtgggaggactggaaaggcactctaaagaaagtggcaggctgggcgcggtggctcatgcctgtaatcccagcactttgggaagccgaggtgggcggatcacctgaggtcaggagttagagatcagcctggccaaaaatggtgaaaccctgtctctacttagaatacaaaaattagccgggtgtggtggtgtttgcctgtagtcccagctactcaggaggctaaggcaagagaactacttgaacccaggaggcaaaggttgcagtgagccgaggtcgtgccactgcactccagcctgagtgacagactcccatctcaaaaaaaaaaaaaaagaaagaacgtggcattagctgaaactggaagcatgccaccctggactctgggaggaaatggtcattttcctgtcacccagactactgcctcccagcctgactcttcagatccctcttgcctctcaaagtgttcatttgtttgttcattcattcatttattcttccaacaactgttggttgaataacaactgtgccaggcgtgtgctcgggatttgaaatacctaacttgaaccagctggacaagggtttctgtccttatggagcttacattttaatgggctagggaggtgcagagggtggacagtgcacatcataagtaagcagatgctatgccagaattctccagcctgcaaccagagctagcccttcatttccttgctctgaggctacagttcagtttctctcatgtggctgtgaggcccagccttcccctcgcctctctcttcaggtcccagacactgtttttcactacgcttctatttctaaggtgtcttttcagttaccacgcctgagaaagttttcaggaatctatttttggattagagatcccctgttgtcacatgccctctttaaaacttgtacataacatgcaccacataatcattccttagctgctgtgtggctgtatttaaggtttgtcttttccaccagcctgtaaattacctgttggccaagatgatgtctttcttgttccgtcccgtgtcttcagggcccagaattgggcctattgtaataaaagctggtttggtaaaaggggagagagttactggctgaggctggctgaactgagaaggctgtgcaaggctggggagcctgcctgggccttgggctgcagggtaagatgcaagatgaacaggggtggggctgagactcatgcttaggcggacaggatcaagtattgaaaccagcctagggagttcaaacttggttttgaggcaatgggatgtcatgaaaagcttaagtgattttggggactcctagtttgttttgataacatttaatattctcaaaatcattaataatttgataacttcaggcatggctgatttaatttttaaactatgaaaatatgaagtatgaaattatgattcttatggtaaaaaagttcaacgtgtacctaagagcatacaattttaatttcccttttcctacaacttttaatcctaccttttacatttatttatttatttattcttaaatatagacaaggtcttgcgatgttgcttaagtcagtacagaactcctgggctcaagtggtcttcctgcctgggcctcctgagtagctgggattataggcctgagttaccatgcccggctgtctgtcctacttttgagcagtaaattggtttctgtagctgtctaatgcttaaactttcctgtgcgttcaaatgtgtatttctgtcttaatgtaggtaaggtcatacgctatgtactccaacttgctacccccgcccccagtatatactttattttgcttatttttacagtgtaagagttactctcttaaagcttaattgtcatttgtcattgccttgtatagaaccaaggcatcttggactgtgtaccaaatcccataagatctggccagaacagggccacgccgtccatacctccttatcttgtgctttgctgccacttccttactgtgtttcagctttagctgcctgatattctttccctatgaaattgcttcctcatctaggatttttatatgtgtggttccctctgtctaatgttctttctccctgatctttccatggtagctagctgtttatgtttatgtgtgtgtgtgtatgcgtgtgtgtgtgtgtgtgtgtgtgtgtgtgtgtgtgtgtgtggttttagagacggagtctcactttatttcccaggcaggagtgcagtggcgccatcatggctcactgcagctctgacctcctgggctcatgcaatcctcctgcctcagcctcccaagtagctgggactacaggtcccaccaccacacccagtaatttttgtatttttttgtagagatagagatcttgccatgttgcccaggctagtctcaaactcctaccctcaagtgatcctcccatcttggcctcccaaagtgctgggattacaggtgtgagccactgtgcttggcctggctagatgtctttatccttaggtttaaaattttactccagaagggccctttctgagcagcctgtctgaaacaagttctccctagtattcttgcctgagtactctgtttctatgtaacatttattttagttatcaattgatttgtttattttctgtttctctcattagtttgtaataagctccatgaaggcagaagatgtatttcatgtagtgttgctgggcagatagttattgaattaatgtataagtggttgaataagaacatatagatcaactgcattctttttaaaggctaatatttcattttatggatgtaccagtcctttgttgaaggcttactaaattgtttttcagaatttttttcttattaaaacaccaccaacgaattcaaaataatgaatttctttgtatgtctctctgtgttcactcatgtgggtatatctgtaggatgacttcccaggagtaaaatttcagaacaaaagataacgtgtcctcaaacttttggtagatactgacaatttctttttaaaaagattatcccattttctatgacaccagtaatatgagaagtatttaactttgtcatcctggccattatcagattttaatttgctagaggaaaagtgagatctcattgttttaatttgtatttctgtaattaggagcaaggctgagcacagatattgtgcttctggaactgtttttctgtgagcttttaatttaatcttttgtgatgattgttggtcctttttttagttgattcagagtttgattaaagttttttaaacttatgatgttataggcaacctttacagtgtgatgtcacttagtgccattgaatttggagctatatagggctttttatctcttcaaaagtaattttgtagagcctgataataaaacttcatgttctcaaagaccatattggggctgagtgtataatatttagtagtttattattgaaacagtaatagagattttaatgtccagtgcataataggtcctcagtaaagtatttttggatgaatgagtgacaagtgaaaagttaatttttaaggcagcttgattttatttgaaagttcatttagaagaatctaattttcatagtaagaagacttagcatgctgttaagttgaaagataagcttgctttgtggcatgctatagaagtgttggatttgtggcagtggaatttttaatttgctgtgtcagatatagatatggctttatgtatccatacacacccagctataacatgtatattcaaataagtgacaaaatatgtctaatgaatttttgaattaccttttaaaacttgcctgttagttctctcaagtgatgaactttttacaatagcagtttattttctctcatcacgttggaaagaaatgttaaaagttttcttctaggtttattataatccagtcttcatcagccatcactcttcctgtattttgttcaagaggcactaattgttcgcatttggcaggtttaacacttcctgacagagaggctattaaggggaagtattctccaataactgtcactggctggaacaaagaaccttccaactcaatgtgtggaaaccactaacattcttaaatgacccttttcatggattttcatccctttaagctaaagtttggagaatgtagggtcagcgaaaacagcaacgtgtaataaagcagtaaaccttgattttggaaggcatagggtgggagatatagatttatctctgacttgaaaacaattgttatttggaaaatctcattagcagatgtgactgcttggagtaaaaaaaaaaaaaaacaacttaaaactgatgtcgctttcaggacccctttgaacttaacaagcacctatttgtggagcagactggctaatgaaaggaaattaaatttttctgacaacttcccctgccaacctccttattcaggggatgttattaggtactgaagaactttaaagaagatttttttttattagacataagtgaaccagttataaacatccccccccgcccccttctcggaggattctgacatggttgctctacattttaaacgtattagcttaaaagcttaaaaaacactgggcttcacttcagcattttagtcattttctaaaaattcagtcacacttaccagctgtggtttcaaaacaatattgtcagtctttgtggtagtttagtttgtgtcactgaattacacaaacacacacacacacacacacaccccacacatacccacacacacgaaggaggcttagatttcaacattatctttattgttatttggggaaatgattcagcagtgtcctgtgttggatgtgttaggtgagggttaatgatcagtgaaattacttagattcaagggaagtttttgtcttttcatcttcttagaggtagaagtggcattggttaatatttagcaataactaatccttaaatggataaacttttaccccttactgtttaggaaggtattttctttcttttgctttttggagttttttcctccagtagttggttcgttgaaattaaagtttttttttaatttatgtaacaagatacaattgtagagataaaatatgtacctgaaaaaaaaaaaaaagaaagaaacaatagaaaagaaaaggtaatgcagattaccaaaaggattttttggaacaattcgtaattcctgtaggtactggaaattaactttcatatttctgcaaaatcgatcaactactcccaaacaatagagaatcaactccccctgctgacagaatctaggaaaacatgacacataatattggacagaaacaagctggctgcggacaagctttaatgacctgatttatgattcagtattgattgtaaacatctaaattctgccattaaattccggcaactgcaccaaatcattggcaattctggtagtgcttcctgccagctcatttcaactgctttgagtttcttaatataataatgatgaggtagaatttacattccacttatggtattaattttacatttctctgaatgaaaagggttagaaggtagtaaaattgaacattaaatgaatcggaggagacagtagtgcaatatatgactgccctaaagacattgtgcaatgcctcatgggattaatgttgagtctcatttcctgcttttacaggatgcagaagaagctgtcagaattgcaagggaaattggtaagtccttaaattaactttggtaggatttctgtgtctttcagcagatacggttgagtcaacaggtaataagtaattcccatagagcaaataatactttaatagttttagattttgattacttgttgctctggaagaatgtatcagttgaattgccaaattctattattaaaggagactgtaaagagtaatttgaccttaactatacataactcttttgtaagatgagatcacaggctaattcaaagaaggaattgtcttaagaattctaaagattggatataagtttaatgtcaatttatatgtacatagttgaatgtggtttgttaaaattaagaacatttggattaaaatgaagataccatatgtgacatagttctttaagtttttgccttttgctaagatgttaggtatcaacttaatcttgttagatgggaaagataaaatagatgtgggaaattagaactgaatgatctaaattggaataaaaggtagactggaggagtttttaatggctgttttacatgtacttgtatttgggcagtgtttcccaactttttaatttcttttctttttcttttctttccttttttttttttaagatggagttttgctgtcattgcccaggctggagtgcaatggcacgatctccgctcactgcaacctctgccttccaggttcaagcgattctcctgcctcagcctccctagtagctgggattacaggtgcctgccatcacgcccagctaattttttgtatttttagtagagatggagtttcactatgttggccaggctggtctcgaactcctgacctcaggtgatccacccgcctcagcctcccaaagtgctgggattacaggcgtgagccaccgcccctggctcgcaactttttaattttaaaaatattcttggcggtcatgagaactatttttggtatctgctaattgagaaaatgtgtaagggcatgctattatatggattaacaatattgttaaataactttgcaggtttaataatcaaatcagtaattgtatacatttgacagaaatttgtacagatgagagaaattaggcaatgcttgtagggatcccagcgtcttctcagcattcctgtacgcctcagtccaagcatctcatcgtgccacacgaacatttctgtaggcctgttttctcactaagattatttagatctattttctgcctctagagagcatttgatttggcaaagctcatatagttgtgatatgtagaaatatcttattggtctggaagtgatcacttgtactagtaagcgtgttctttgcaaatgggacagtctaacttagcaggtctttagtgacctgaaaagcagtttggcttattgcacccttgtttgtagttggtactgtctaaattatttgggctttgcccatcattaagtgtgttttgttgtttgctttgcaaaaatctatcttattgatataggtcctggatttaagaccagaccatagaaaatcttattttatctgactacctcatctcttcattttttttttcagaatcattaacatttcaaaaagcctatcagtacttcataggaacatttgctcgactgctaaataaactggactatatagaactgattctgtggtttctttatggagaaaaatcaaaagtttctgttcatggtttgaaatcactggtattcctcattgcctaagaggcatataatatacctactggcttttgaggatagttttctaaaatagtttaattccatcctgtcagacatctttacatttaaaaagctctttttctagttctaggttagatattattatcaacctcattggatataataatactgttattattattattacagtatctacataaaggacaatatttagagaaatttagggaaataaagggattagaagaaaatttacagttacactgcagtgccacattttgaatggtgaattttggacttgcgagcattccctttgtgtaaatagcaggccgtggattgctttgcttcctttatgccttttcttccactttctttctttctttctttctttttttttttttttgagacagacttttcactcttgttgcccaggttggagtgcagtggtgcgatctctgctcactgcaacttctgcctcccgggttcaggtgattctcctgccttcacctcctgagtagctgggattgcaggcacacaccacaatgccagctaatttttttgtatttttagtagagacggggtttcaccatactggccaggctggtctcgaactcctgaccttaggtgatctgcccacctcagcctcccaaagtgccgggattacaggcataagccagtgcacctggccattttccactttcgttataacctgtcacctttaagataaccagctcatcatgatgggcctctgtctaactagttctcatcactttgctttcctccctcaatattttaatgctgtgctttacctccttttcattttttattttttcctactgaagttacctaatctaatctaagtcttttttctttgtacttgggcacatcctttatgactcctttctctttcctgtccttcttctaattcttccccaattactctctcttgcttgtgaaataaatgatagcaatcatggctattaagtataagagtactggtgttttgcttatactgaaagaaagggaaaccataaaatttgaggtaaaataaaccataaagaactagggtcatcagctcttacaaagcttttagaatttctctgaaaatctcttctgaatcacctcagaagcctcgcataaaatcttttccttgaagtgctactttctaaagtaaattaaattatgttttattaaagtctgttggctttctgtgttgtttgatatttcgtaagttttttactactgattttattgagatatatcacattttaactatgattatgattccatgtgaaaatgtgttcctagttctaaacaactgatttataatcaaacctttgaacctatccatttgtaagttgttgattgtccatgtgttatacctattcatagagttctctcttaattctttctgtgttatgtgatgaaaatgaagtttatcctgttttatgtgatttcctcctctctcatgtctttgcttttcttctggaaacattaatctatgctgccaaagtaggaaactcactgtattgagcattgatgaattaagtgccttttacataatggtaactccagtttatggagcatttcttcctaaggccaggcactttggaaatgttgtttctaatgctaattcttgggtttaatcatttttgtttacatttaaggaaactaatgattagaaatggtaagtaatttgctcaaggtcacagaactatcgagtggtggaccctggtttaaatttaggtttatttgactccaaagaccacagactttttattatactgtgtctaaaccaatgggattagaggatggcagctaaaatttgagcgactactttgtgtaaaatactgtaaggtactcaaatgtgttatacatggaattaaagaagcagacagtctcctatccttgatgaggtgagagacagttaagacttaatatgttacttgtatgtatttgttttttggactacctagtttctctcattcttgttcctgattttttactttgacctatctaagttgagagatacagagctattgatcctcagtttgtctttaacctcaatgatagacaacagtaatcagtgagcttgatttccattgaagtttgatctttttactgggccaaaggtccttaatacaatcaagtcaaaattgattcttgaaaggaaaataaattgtgaatctaaaacctgtcctttaacaacttccagattattcagattcttttcctttgcttgtctttctcacaatcacaaatcatgcccaatttaaataaaaacttttttttttgatcctcaggtctaccatactacaaacctacttctcccagaatttccaaatctcaataaatgtcacccctttcagtcaggccaaaactgagtctctcctggatgcctcttttcctcatcatcctgttgtaaatacatcaataggcattgtcagttcatcttatatacactgtcttcattactaccactctcctccaaactacttttgtcttttgcagggactgtggcaatagtttctttacttcatttcttaaacatttcacatagctgacagtgagatatttaaaatctttaaagaacaaggatatatttcatctcatcccagcccatttctgctttaaattctgtaatgactccattgaacttagataaaaatcacaattctttactctgactactatccctatgtaatttgacacctgcttttctctccagtcttattgtatactactcccttctctgcctcccatacttcagtcacattagcttacttgaacacagcaaatttcagggccttaggataagtttttttttttttttaatcttttgcggggtgaagggggatggcaggacctagcagactcttgctgatatcttcacaaaaatagctccttgcagtctttcatatcttagcctaagtatcatgtcttcaagagaagattctctaatactgccacccagtcattctctgtcttataactattttctaaatttctgcatagtattcatgatttgcagattttttttattcataaacttttctccaagtattttattttgaaaaatttcaatcatacggcattttgaaataattgttacggtttatactcgtatacccaacactaagatcccactattaacctttttctagatttgctttaccacttatctgttcatatactaatccattttatttttgttgcatttcagagtaaattgcacaaccagtatatgtcccattaaatacttcaacatgtgttattaattgaattcagtatttgtatacagttttgttattttgatgccaaatttgcacacaatataatgtgaacaaatcttaagtgtgtatttgtggattttgacatatgcatatatatatataacttagaatcccaccaaggtgctgaacatactatttccctggagatttccctcatgatccttccaagtcagttctcgcctaccccctggcctgcaggtaacttgttcagatttttatactaaagattagatttttaaaaattaagataaatttttaatactatacaattcagcctttcaaagtgcacaattcggtgattttttgtgtatttacaaggttgtgtaactgtaatcactatctaatttcagaagatcttcattactccccaaagaaactctgtactcattagtatgtacttcttattttctttccatctagtccctgacaaccattaatttactttgtgtcttgtggatttacttattctggggatatttcatataaataaatggaatcacaacatatgaacttttgtgtctggtttctttcacacagaatagtgtttttaaggttcatccatgttctaccgtttatccctttttacggttggataattttctattgtatgtacatgccacattttgtctgttttttatttttttgagatagggtctcgctcttttacccaggatagagtgcagtggtgtgatcccagctcactgcagctttaatctcctgggctctactaatcctcctgccttaccctcctgagtagctaggactacaggtgtgtgccactatgcctaatttttgtatttttttgtagtgggttttcaccatgttgcctcagttgatcttgaattcctgggctcaagtgatccacccacattggcctcccagagtgctgggattatagacatgagccactgcacctggccttatctatttattcatctattgatggacatttgggttgtttttacctcttggctattgtaaatggtactgctatgaacatttatgtccatgtatttgtttgtatacctgttttcaattattttgggtatattcttcgaagtgaaattgctgggttatatggtaattctatgtgtaacttttggagatactagcaaattattttccatggtggctgtcccattttacatttctaccaagaatatataagggtttcaatctcttcatatccttgccaacccttgttattttctttcttttataaggaaaactattgccatcctagtgtgtgtgtagaataatatcttattgtagcagagggaagaatagattaaaaaaagtgactcaactatatgctgtctataagaaactcactttagatgcagagacacaaataggttgaaagtgaaaggaaggaaaaagatatcccatgtaaatagtaaccaaaagagagctggggtggcatactaatgtcagacaagataaactttaagtccaaaactattctaagagacaaagaagggcattttatattgattaacaattacaaatgtatatgcaccaggaaacatggccctaaaatatttgagataaacattgacggaattgaagggagaaacagactaattctacaatagtagttggagactttaatagcacactataagtaatggatgcaacatctagagagatcagtaagggagggaatagaggacttgaacagcactatatactaattagaccttatggatatataatgaccattctacccaataacaatataaggcacatttttctcaagtaactattaaaagaggaaaggagtgatgattgagttaaaataattgttaaagaaaaagaaaatataataacaaacaggagcaatatctcataaagtgttgcccatgactcgcaatgttcccaagacttagtttgatatagaaatatttttccccgcatgtactgatttatattgatggattgctcttttcttaaaatagtataggattctctgcaatatataaattttatttttctttgcaaatgattgctttatattaatttgattactattttatagtaaaatttttgttgtggtggtggttgttttttgagacagagtctcattctgttgcccaggctggagggcagtggtgtgatctcagctcactgcaacctctgcctcctgggttcaagcgattcatctgccttagcccccacttagctgggactacaggcatgcaccaccacgcctggctaatttttgtatttttaatagatacaaggtttcaccatgttggccagactagtctgaaactcctgacctcaagtgctccccctgccttggcctcccaaagtgctgggattacaagtgtaagccaccacatctggctggttactattttgtagtaaaattgaccatgagttagttttctttgtatttctaatacttaatgcttgttacagagtatatattcagcaagtggttatttggtgaataaatcaaaatgaaatatgtatatatatgtatagaaatgaattaagcaatcacatatttaaagttcttttgtaatatttatagaccagaatttgactataattttctcccttttcccccttaatcttcaattttataatagagatacctggggaaaaaaaggaatattaagcaaaacatgataaactttcagcaaatagataattgaaacaaaatgatctaggattattcaaataaattcagtatatacttgttagtgactactagtcatcaattcttgtaggctgtccttgtgttcattaggctggactaatagaaatttataggaatctaagattcaaatgtatgaaagtcttttactgaaccttattgcctttacaccagcctgttcccatgacatcttatgttctttgaaagtctggctctcccatttgacttattttactattagtcttctgatgtagtgtgtctgccctgtctctgcgtagtgtgtgggggctatatggtagtcctttcttttctgccctggctgtttgcctttgcctattcttctcatcttccttttggcataatacaacatttttttaaaaagttacttttgttgcttatatacaaccaataattcatacttaagagggataaaaatatgtggctaagtcaggaatctttttattttgtctatttcatgcagcttagaaaaattttcacatgttatatatgactctggggttaaggttatatggaagaaacctttgcaaaaacattacaatttataccttcttcacaatcttacatcttgttaatttatttgccaatttcgtcttcaggagaagacatttaatatttaaggagattgaataacgcctaaggaaaagttatgttaaagaaaatggcattaaaataatctatgtgaaatccattaaataatgagatgtatattttgctgttttcctattattgaagtgatgtggtcatttgagattagaatgatattccctgggagacaggaacttgtgttctgtggctttttttcttctttcttttccaatgggtgcttatattttcttttattattccaacatgcacatttgggtttaagcataatttcacaagttctttttctgtcttttactgttaaatttgctgtttctgtctccctttatttctctcagtccttcatcttctttctcttgttttattgttagtcattcgtgaataccatttttttcctttttctattactctgttggaaaaggctgtgcataacattcaggcaggaatgtggaaacacattgtaatgtgaaaaaaacattgctttttttgtttggaaacttcctgtgtgtgaagcgttttgctctaatctgggcactgaaatgcactgatttccgatccctggagcagagttagggatctagtatttttatttgcctaagtagagagaaataggcaggcaaaatcagtttttcctttctctgccaaagaaatagtgtcataaaatagtgtcatgtattggtttgtttagtgtataatacatctggattatatttttgtaggtactgaatattgattcttatttaaatatgtttatatagttatttgtatatatgtgtatgacagactgaggaaaggctgtgtgtgtgtgtgtgtgtgtgtgtgtgtgtgtgtgcgcagtagtagagatgtggataaatcatagactccaacatatatatgtttactagttactggataattacagaccccaaatagtattgatgcaaatgtgcatcacctcagtctgaggtctgccaactcgaatgatactccaaaactaaactgataatgatgaaactaaatataactattttgtgatttaaagagagcaataaaatcagtggaaaattatgatcaaataaaaaatgagtaatgcattgatagtagagtgtatttccccaatttgtttgaatttaaactgtttccttgtttgtatctacagcaggaatttttcagtgttagtcacatggtgcatggcagccaaatttcccagtagattctgaactagattccttggaaaactctagtaatatgctaaatttaattggagtttgtggagttgtcattagttcaccagacctcgactataccacatttttacagcccctctcctgtcactttaaacaacacagatttagtttttcttcattctgtgtgttcaattctcattcgtcaggttgtagggtgagaaggaggcattttgttctatgctatccttattcagtggctaaggctgatggagtttccaccatctgcaatgtcatagattacagaggcaggacacagaaaagcctcagttttggtaatcatcaataagacattcttcatgacaaggtgtttactattatatctcattgtgtggctttgaaatttgcagattgtcaccaccatctcctaaatatttcttgaatttatctacttctctgcatttctgttgctattctctttgtttaaggtagtgtcatcccttgcctacatcactgtaacagcttttgaaatgtactcctcttatcatagcttgtaatcccttggaggtagactctggaagcttattgggggaaataattttgggaccaatacctgagggggaatgaaggaaactgagccaagggaaaagttgaattgattctctctcaacaaagccatcagctaataatttagagagctgtgaatatttgttggtcttttttagttgttccaagttcgggcaagaggattcagcctttatacacctgtatcaactatctagggggtgtgggctgcccctaggaaggggcatgaccttaggcagaaagccgaggacaagtcagcttttggttgacaatacttacaacagttggggcaatgtcctgaactagggatctgggcagaaaactgtacttaataactttgagatatatttttcatgattgttcatttctaagtaatttcagatttctgctatgattttgactcatatgttatttggtgatgtattttaattctttaattttttgagatagagtcttgctctgtcattgaggctggagtgcagtggtgtgatcacggctcactgtagcctcaacctcctaggctcaagcgatcctcccacctcagccactggagtagctgggactacaggcacatgccaccacttttggctaatttttgttgttgttgttgtttttgtattttttgtagagacagggttttgccatgttgcccaggctggtctcaaattcctgggctctactgatcctcctgctttggcctcccaaagtgctagaattacaagtgtgagccaccatgccaagcctagtgatatatttctaaataactgaaaaaaaaatagttttttattattattgatttctaacttaattgctttgtggtcagagagtatcatgtttttcatttaaaaatctttcagatttgatgaaaattgctttatggctaaggaataagtcactctgatacatattctgtatgttcctgaaaagagtgtatattctcaaattattatatgcaatgtcttatagaaaactcaagaggtcaaacctacctattgggatattcaaaacttctagtgagtttttttttttttttttaattaagacaatggagtctcactctgtcacccaggctagagtgcaatggtgcgatcttggctcaatgcaacctccgcctcccgggttcaagtgattctcctgtctcagcctcctgagtagctgggattacaggcacccaccaccatgcccgaccaagttttatagtttagtagagatggggtttcaccatgttggccaggctggtctcgaactcctgacctcgggtcatccgcccaccttggcctcccaaagtgctgagattacaggcataagccactgcgcccagcctgtgtgggttttttttttttttttttttgagacagagtctcactctgtcgcccagacgggagtacagtggcatgatctcggctcactgcaagctcccctcccaggttcacaccgttctcttgcctcagcctcccaagtagttgggactacaggtgcctgcctccacgcccggctaattttttgtattttcagtagagacgaggtttcaccatattagccaggatggtcttgatctcctgagctcatgatctgcccgcctctgcctcccaaagtgctgggattacaggtgtgagccaccgtgcccggccttttttttttttttttgagacaaagtctcgctctgtcacctaggctggagtgcattggcacaatctgggctcactgcaacctctgcctcccgggttcaagcaattctcctgcctcagcctcccgagtagctgtgactacaggtgcctgccaccacacctggctaatttttttgtatttttagtagagatgaggtttcaccatgttggccaggctggtctcggactcctaaccttaagtaatccgcccacctcggcctcccaaagtgctgggattataggcatgagtcaccacatccagcctttttgtgatgtttttggatatctgatggacctatatttgaaaaagtgattttccaatttttccttgctcgttaggttttgtccctgtttagataataggtgtattacagtgtatcgtgtttccttggctatcaaaacataatgaccaatttttgttttcaagtctaattatgatattaatattcctaaacaagcttatttttgttttatccttgtatcattctttatctttttcatctgccagtgaactgttgttttaggtgtgtctcttgtaagtgcacatctaaatttggactggatttttattttattgtttttctattcagcctgctggagcttgtcttttagctggagagtttagtccatttatatttattgtatttaaaattatattttgatttatttatataatctactttttgggggttttgtttgttccattctttggattctgttttctttcttggcttctttttgatgacgactttaaaaaaaatgtctcttgttcttattttatgtccccttcccattcctccctccactatgttggaaattttatactctatttctattgtttcagtgcttgctatagaaatttcaacttggagacattccttcaggtgtccttcatctttggcaacatttagtgttgtcagtgttttggattttagccattctaataggcacatagtagtatctcatagtttcagtttgcagttccctcatgacatataatattgagcatcttttcatgctattatttgctatctgtgtttcttttttattgagatgtctcttcaaatcttttgttaatttttcaattgggtggtttgtttcctggttgagttttaagagctctgtgtattttggatacaagttctttcttaggtatgggttttgtaaatattttctcccagtctagaacttatgtctttattctttttttttgagatggagtctcactcttgttgcccaggctggagtgcagtggcgcgagcttggctcactgcaacctccgcctcccgggttcaagtgatcctcctgcctcagcctcctgagtagctgggattatgggcacccgccaccacgcctggctaattttttttttttgtacttgtagtagagatggggttttgccatgttggccaggctggtctcgaacccctgacctcaggtgatctgcccacctcggcctcccaaagtgctgggattacaggcatcagccaccatgcccggctgtgtctttattcttttaagaatgttatttgggctgcagaaatttttattttaatgaagttaaatgtgccaatttttaatggtttgtgcttttggtgttatatgtaaaaactcattgctaaaccaaagtcacctagatgttcttctattttttctctagaaattttatagttctgcaatgtatatttaggtctgagatccattttgagttaatttttgtgaaaggtataaggattgtggcaagattaattttcttgcataatgaatatccagttattccagtaccctttgtttggaaagactatctgcatttaattgccattgcttctttgtcatagttcagttgactgtatttgtgtgggtctacttctgggctcttgagtaatttgtctgtcttagacaataccatactgtcttgatgtctgtagctttatagtaagtcttgaagttgggtattgttagtcttttgaatttgttctttttcttcaatattgtgatgcctattctgggtcttttcctttccatataaactttagaatcagtttgtggatatctacaaaataaattgctaggactttgattttaattgtgttcaacctatagatcacgttgaggaggattgatatcttaacaatattgaatcttcctatccatgtacattgattatctctacatttagattttcatccatttctttcgtcagagttttgtagttttcctcatagatacactgtatgtattttaagattcatgcctattttatttctttagtgctaatgtaaatgtcactattttaatttcaaattccagttgttcactgctggtatataggaatgtgataatcttttgtatattaatttgtattctgtaaccttactataattgcttatcagttccaagaattttgttgttattgctgatttttttggaattccttcatagacagtcatcttatccactagtgaagacagttctatttattcctttccagtctgtttactctttatttccttttcttaacatacttcataagctggaatctgcagtcagatgttgaataagagttgtaagaggggacattcttgtatttttcctgatttttgggagaaggcatccagtttcttgtcattaagtgtaatgttaactgtaggctttttgtgtatattctttatcaagtacaagaaatttctctttattcctagtttgctaaactcagtgattgttgatttttgttaaatgctttttctgcatctatttatatgatcataggatttttcttctttagcctgttaatgtgatggattacattaattgatttttggatgttgaatcagctttgcataccaggattaaatcccatttggtcatggtatataattctttttatatattattggattttttagtcattttaatatctaaaaacttaattttaaaatgtttgcttttttcttatttatctcatcatgtttatttttttctccaaatcattttacctgtttgtaatagctgtaacttataatagtatttgtaacaactgttttaagagtcttcatttctgggtttctttctgtcagctattttccttctgatatgaatcacattttgcatctttacctatctcttaattgttgattggattctagacattgtaaatgttacattgtgtgtttggattttgttacctttatttaaaaggtatagatgtttagtctggcaggtacattaattttgtttaggttaaggccttttaggctttaaaaaagttttcttagggcaagtctagcatagtcctttctcgtgttctgattaaacaagcttgtattatgctgtctctctacccgtcacacttcctgtcctttggttcataatttctatttcattatacgtctatggttttttcgtagtataatgtaaacccatgaaagatgtaggcaggagagagatataatagtatatataccttaagaaaatttcactgaccactatgtggcttggatgggggcaactgtagtagtggggagttctgctagtaggccagtacaagagtcctggactgctggtagtttgtgtaagtattatgattaagtattatgataactgagataaagaaaagtgaatagatttgatctttttaaataaagaatttataagagtttcatactatccagcagttgtgctcttacacatagatccaggaagctcatatacaaagttccagacaacaagtacaaaaatattcaaaggaccattgttatataaatagaacaggttacagtctgaatgttcattcacagtggaatggataatgctgcagtatgtttgtaggtgacatagattacagcagtaaaaataatgacttacagctgctcagattaactaatagatttacttagtaactcttactttgcatgttattctttaggcagtttcagccactgcagaaacaacaaagaagacaggcaaagatctttgtctttatgtttttttaatcattgtgcagtgaacaatgtagatattgactaaagcaagaatcattaaagttcatttttaataatgggtgaaaattgtttggatataggatcatcacagtttcaaagtatcaatctacagattatttgctaagaaaaaatggcatactttctgtgaggaaatttaatggatgccatcttaagtaatcaagctttatcagtttgggataaattgactttttattttacttttgatgcgatggaagaactcgaggatacaatatcaactatgttgtatttaagatttgttaaacatcttgaatttaatgagtgaataatcaggtatattcaaattgtggaatattctatcaaacaaccaccctgggttcttcagaaatatcatggtcatgaagaactccccccgccatcagcacaaaacaacaaacacaaacccacactttcccttctggggaggctgagggggttcaaaaggcaagtgaactactttacattagaggagcacaaagaaacgaaacaaagcaatgcgtactatctatgtaattctcatgagcaactttcatctggggatttccttcctttctgtcctagttctttctcggagtggggtgtcttttctcttctgaggtcctattacccatatcagggcctattctatccatctagaggactgttcaacttcctgaaatatcttttgttttctttttaccttggacctttccttgaggaaacaaaggccttgtagttaattataggtgttttgcaattggttatttaaagaagatccccattccccatcacatctccttgattcatgagagatttctgattagtaccgctggattaggaataagacattttctaagaaatacttttcttttcccttctttttatttttcctttcccattagtatattctatgaaattttaattcaagaaattgtaggtgagaaaaccacataagattctttattatacagcgtaccactgttgcatcaatagggtgtcattttatcagcttttaagttaccaggttgtgctaccatgtgtggcttgggttttgcttgaaaagtaaggttatttattgtgtcttgagtaggtaaatgtgacattatcagttggtcaaaaaagataattctttttaacttggaatccataactaaatggaaaatctcctaagctcctagaatcttccttcattcatccccttatcttccacatccaaactgtcgctaactctagtctttgtctttctctctatctctgttgctagctggactgctgcaaaggcttcctcatcagctccttgtttctacctttgccctttcaccattcattcattgcacagcagccaaagtgatcttttaaaatgctgtattaggtacttccctttcctgtatcacaccttccaacttgttccttctgtctggactcatcccccctcactgattttcagagtgctcgctctatcttgtcattaggttctcagtttaaatactagttttctcagagaagcattttcaaggagcagtaaccctgtcactctcagttacatttattccctccgtgttatagcagtcatcactatcttacattgtgtataagacatacatgcacttatttatttatattaatatgtgtatatacataaagaaatactgcagccttgacctcctgggcccaagctgtccccccagctcagcctcccaagtagccgggattagaggtgtgagccactccacccgactcagacatatatttagatgcatgtatgtttgtatatcattgtctgctagatagcagggagttttctgaatcgttggcctttgtagcctgcagagagccagataaggcttatagtgtatattcagtaaacattttttaaactgatgaatacaaatttgatagtagagttagaaagaaggctgcttgctttgtggtagaaagtaagacgcactggtagctgggaggtgagggacccagagaagatgtcctgtcctgcacttaaacctgcccttgaaaactgagtccagaaaagtagcaatggaaactttgtagtactttgctaacctaagtttctgtattttcttcgtatattttgtcatatagtattagtagatttcttttcggaagcattagtgcctcttttattgtgcagaagagaataaggagtggagactgtctctgtgttggaggttcagtgtcagtaggggagtcacttctgtgtctggggtgaggtaaggtagtagcagtaagcatcccatgagaggacctggaaggtgaggaaaaacttgggaagggcactagagcctgatttttttttttttttttttaaagcagtctcttctactaggactttcacctccttttacgagtagaatttgtattttgttatgctctgtgtattagtccattctcacactgctaataaatacatacctgagactgggtagtgtataaagaaaaagaggtttaatgggctcacagttacacatggctggggaggcctcacgatcatggtggacggtgaattaagagcaaagtcatgtcttaacatggcaccaggcaagaagagaatgagtgccagcaggggaaataccagacacttacgaaaccatcagatctcatgagaactcactcactatcacgaggacagtgtggggaaaaccgccctcatgattcagtcacctcccgccaggtccctcccacagcacatggggattattacatttcaagatgagatttgggtggggacacagagccaacgcttatcattctgtttcaaacatatgtcagctgaagaatacaaaattaaacaaatacagtatagacaagagtcaagcacagaagtaagtgctccagtggatgagaaaatgtgagagaacattagtggaaatttcatgtccagatgaggtgaggggtaacaagtaccatcaacttgatcatttctgatttttccaggaatgccaacttttgactaaatatttttttccttccacttcccatttacttatcttaattagagtggcagggacacaagaaagtagggatgagggactgaactgttggatattatttaacattatctgtgtggattattcttttccctcctcttcagatttctaagtattgtttctccatggtgtggtgacagcatatgtactgcctgaaatcgatttggcataagaagttgagtagaaaaccttactgttacattatttcagaatatagctcaatggttaaattaagagttagtatcagccaggttcagtggcttatgcctgtaatcccagcactttgggaggccaaagcgggaggattgcttaaggccaggagttccagaccaatgtgggcaatataatgagacccccatctttaaaaaaaaaaaaaagaaaattagctgggtgtgttggggtgcacctgttgtcccagttactgaggaggctgaggtgggagggttgcttgagtctaagaggtcaaggctgcagtgagccaagatcacactctgcactctagcctgggtgacagagcgagaccaaaaacaaaaaagctagtctaacttgcatcagtttcttccttcctcccaacatttttctgtttggcttgtgagattttggtcagggaatcttgccttcctgggttacatgtattcacaggtctaatgctgtgatgccagcagcactgggagaccacaatgccttattatatattgtcctattctctaatgacttcccaccttttctgagcatctgataattttttgttgataaattgttttatgtatcttgtttccccagcttgttccttgtgagcaagaatgatttccatgtcatattttgaaattcacaaatcactgtatagtccagggtccttagtaaatgactaaaatgcgattagtactggaaccagaaaaactgcaaatttcctaatcgtcagagggaactgaatgtagtggagatgtgggctgtctctcagctcttgtggcttcctgttacatggataaatggtttgtgatgatgcattgataaaatatttttttgagaggatgggggtaaggatctattaagttgttgtaaacagggttttgcaggtataccagtttcaaatttttagattgcgctttttcactcccgtaaaacaggctaattcttctctactgatttcattctgattattttatgcttgttattgtgaatgagacaaataccattcttgccattctcatgcaggattaaaactcgtgcataatctcttgcagaatcaagaatcaaagcatgcacaatcttctatgctttgtccccatctatgttttctattgtgttttcccctaccatcctgcagataactctgtacttcaactgaattgtttcagtcattccttaaacttgtcctataatctccacctctgttttccccactattcctgcctgaaatgttcaagtcctgctcattcttcatagcatcatttaaatagccctttcttttttttcttctttggaaacggagtcttgcgctggagtgcagtggcgtaatcttggctcactgcaatctccgcctcccaggttcaagcgattctcttgcctcagcctctgagtagctgggactacagacgcacaccaccacacccagctaagttttgtatttttagtagagacggagtttcaccatgttggccaggatggtcttaatctcctgacctcgtaattcgcccacctcagcctcccaaagtgctgggattacagacatgagccactgtgcccagcctaaatggcccttctgataatacacttttcttaattatttttctctctacctccctgtgatcctttctgttttgaattgccagtgatagaactatttgggtcctttgcttttctcttcttggatttgaaggctcccagtgtaagagcatgttctttatctgtcttctcagtgcactgagcattgtttcaaaaataccagcccatataaacatcatgaacagaaaaaaattttaattgaattaattataaaacgcttaggaagcaggtgccattttaactaagttgaagttaaagagtgatgttttgtggtttggggttcaaaaggtctatgacatttggccttctcttcccttttcctctaaggatcctatagcttgagttgagtgccagtagagcattacaggccaggaaggatcctgtaagggctcactgagctcttttttcttcagaaaagatcataaacaaatggtcccaaacataggagtatctctaccttgtttttagaaaacatctaaagaaggagacttgtacacttttcttgataaatcgttgtaaatgactcttgctgtcagaagttttactgtataataactaaatacttaatcatgtaactgatgacaattttatgagtttaaaactttagctggaagtgtgctttgttttgaccttactttgtattttcataacaccctgttaatgtacggaacagtggaatagcttctccattgataccagtgagccctggagcttctgctccagcccatagcatcgtagccaggtttggattttccccaataccatcatgtcacttcttgctaataaaagctgtaggggttgtctgtgactcttcagatgaaaataccttaagtacctgaaaatcaccatttttgaaaaaagggaatttgttatgcatgcaaacctcagttttggagatgtttcctggtgctattataagttgtttcttatatctttgattacttaatactgtacttctgtttttggaatccactgttaatttatgtgtgttttcttagcttttattactggggaaagtgttatgtttattggtacaagtacccttttttcttttaaaatggtcacactctcattttttaaatacatcattacactggtgttactttcctggtgttattttcctgactctaaagaaaggaacttttaaataaattaattattgttttctgcgttattgaacatgtggtcaattgtcatgttcatacatcccaatgatcaaagtctgaacttctgtctaattcttccctgctgttaggctaccctgtcatgatcaaggcctcagcaggtggtggtgggaaaggcatgcgcattgcttgggatgatgaagagaccaggtgagaggctgtccaaaatatacttttgatgaaaattgcagttaccagagttttattaaactgacaggtaaacagataccaaaagcataatggagtaattacagtaaccatctaatttttacacttttgaatgggaaaaagattgaaattatgtggaaaccttccttatttatattttgatgatgattatcttattatagaaagggttttactgttttaaacattaacaaaggattttctttttgtttttaccgtatatttttaaaaattacagtcaggattctattttctgggcataaattactaacatttggctatataattctaaatgtcatctaaagatttaaatcaactatatttaaaagcagttataatttcattgagacttaatgtattacctcaatatgtagttgctttcctttgctagtgcataaaagtagtgaattactttgataattttagagtgtgaaatatattctttttccttgagtttgaaattactgtgtcctttatatggaatgcgctcttattataatttagaatactttttatggcccaatctcagaagttacacaggtttccctccagtgaacacagcttctgctcaaattcaaggggaggggactgagtcttcacttcttcatgagagcgtgggcaagattcttagaagagcacgtggaatgggagatactgttgtggccatctttggaaaagacaatctgccacagcccgttttgtgggaaagaatggtatcataaagaagtcgaatacaacttaatggttttgcaagagatgtgtattttgtggacttcaatttttttctcattgtttttctgttttgcacagtacttacatagcaatttcactgaacgcttagcgcttatttttcattattcatcttaggatctcaggtttcttatcagtcatttctccagggctactgttagtaacttactcttttatggtgcggattactctttatagtttcttggaagtgaggtttgctgtgctgctgttgatttataaattttaatttacagcttaatattttgagaaatcactatatccattcatatattaggcatcattttgtaaataatttagccctttcttgccaagtaaatagcacattgattcaaaatatgtttataaaattaataaaaatacatgaataattttctacttaaaatattactctcttcagcttgataaataaaccatctcagaaaacttgttgagatcaacacaggcgtgcctattagatttaataatacaagctcctcattttaagaagttgctctatgtcccttatttatttgggaaagtcaaaactacctaaaaagggaaagaacagtactgcaaacatgcctatgcttgtcttttggagccactaaccgtgaacaccataccacaacttatccaccccttcttttcctctctccctctcgaggaagtaattggtttttacataatccacaaagatttcatttttcaggtacaaaggaaaatttggtagcttaattactttattcctttatcctaaggggtgtctttttcttgtaacatctttcctatgttttttggggggaagtagcatctatgacttgtcttggaatctgtaggacatctgaaagattttttttaaaaatgtaatggtttttttttttttttttttttttgagacagagtctctctctgtcgcccaggctggagtgaagtagcacgatcttggctcactgcaatatccgcctcctgggttcaagtgattctcctgcctcagcctcccgagtagctgggactacagctgcacgccaccacacccagctaatttttgtatttttagtagagacggggtttcaccatgttggccaggatggtctcgatctcttgacatcatgatctgcctgcctcggcctcccaaagtgctgggattacaggcgtgcaccactgcgcccaacctttattatatagtaaatttgggtgagaattatgaagattgttgaaggttcacttagatattttcatagtaatctctggctttcttttccctattcaagtttaaatgaagcgtatggcatgattgggaaactgattgtgtctatatttttgaatatccccactaagacttttggcattgtgagtgcaatttctgttttatttttgtattcctagcatctaaaatatatccaggcacaaagttcagtaaatacttattgaatgaatgtataattgaatgtcaccagtgatattcataatagagtttcccatgagttctaaaataggttgttggcgatgctttcaaacttgctgcttattttattttggtgactttgactttttacttgtggtgttctgggtttaaatgcaaaatgaaagatctcaatcattatagtggaggcaaactgtaaagtgctatattttttctttctgttattatatccaatctaataaaaagttgattatatggtatcgaaaactaattcattttgcttccagtttctttgaagtttgcagcctcctaagattcccctaaatcaacaatgtaatggaggactttattcccctaaatcaacaatgtgatggaggactgagaaaacctaataccttttctctgagacctctgagaaatgagttttttgcaatgttttgaaatttgtcttctagtcagttttacctgcagtgttgtacaaaaacaagcaaattagttgtgtgtgtgtgtgtgtgtttttttttttttttttgagatggagtctcgctctgttgtccaggctggagtgcagtggtgcgatctcggctcactgcaacctctgccttttgggttcaagcgattctcctgcctcagcctcccaagtagctgggactacaggcgcacactgccacgcctggctaattttttgtattttagtagagacagggtttcaccgtgttgcccaggctggtctctaactcctgagctcaggcaatccacccgcctcagcctcccaaagtgcttggattacaggtgtgagccactgcacttggccacaaattagttgtttccaatattactaggtggactgtaggattaaatgatattattttaaagttgtaataattaaaacgcatcttaagtgtaccaacctggattactatatgacaaggattatcattaaatttttctattagtagtctgtcatcgccaaaactagaagcagcttttgagatgaaaaaccatcctttaaaaaaaaaaaaaaggaagaacggtcagactaacaaaacaaatagagcaatagggctgacatcattaaagaaaacacaaaacaagcaaatcagatagttgttttttatattactagatggaccatttgcaacttaaaggactggaagaatttggtttcagtattgtacattaaatacagacatttagtcttcagattaagaaactttattaaatataaaaggaattaaagcacaaaaataagcaaattggatagttatttctaatattagtagatggaccatttgcctcttaaaggatcggaagaattggctttaatgttgtacattaaatacaggtatttaatcttcagattaagaaactttattaaatgtaaaggaattaaattttatatgctgattatatcaatggatagaaggcaatatatgctcaattacttttaggcaagcaagtttgggttttttttttaattgttttttcttttcttttttttttgagatggagtctcactgtcacccaggctgtagtgcagtgacataatttctgcccaccgtagcctctgcttcccaggttcaagcggttctcctgcttcagtctcctgagtagctgggactacaggcatgggccaccacaaccagctaatttttgtatttttagtactgatgggatttcatcatgttggccaggctggtctcgaacttctgacctcagggaagccactgtgcccacccaagtttgcgttttgaaaagattggtcaaatgagccctaaatatttgaataataggcatattttaatagtaatgatttaaattagtttgtaaacaaaatatataaagcaataattaggtccatatttttattttaaaaaactatacttttataattactatttttgatcaattttatagaagataaaattgtaatgatctgtgtgggtgtatgtgggaggcaactgcatttcaagatgtggatttaaaatattaagcagtgttcttaagaatcttcctgttggatgttcaatctcaatgagtgtatttgctgtagttccactccagtcatgcaggtgactagaccctttacatttttctttgcatcttctgacttctgaatcaaacagatgtttttttatatttttgctagtggaattaaggtatattatggttgaagaaatggaattaattttacttgctctgtatggtttattaaaatatcatatttaggctgggcactgtggctcacacctgtaatcccagcactttgggaggctgaggcaggtggatcaccttaggtcaggagttcaagaccatcctggccaacgtgttgaaaccctgtctctaccaaaaatataaaaattagccgggcgtggtggcacacacctgtattcccagctactcgggaggctgaggtggaagattcacttgaaacccggcaggcagaggttgcagtgagctgagatcctgccactgcactccagcctgggcgacagagtgagactctgtctcaaaaaaaaaaaaagtgatacttagcagttggtaaagtatcggcattcctgtttcaatggaaaatctaggatctgagaagttaaataactcatccatggtcacagagttagtgagtggaaaagtcacaggtcaaccaaaattaacttagttatttgtatattgagtaaaggtttttgcttttttcagaataagccaaaataaatatttaatcgattgtgttttcttttataatgatagctctatttgttttgttagtctgactcttcttctccttcttccccttccccttcccctccctctccccccctcctccttcttccttctttttttcacagggatggttttagattgtcatctcaagaagctgcttctagttttggcgatgatagactactaatagaaaaatttattgataatcctcgtcatatagaaatccaggttggtacatttaagatgctttttcattattattttaaaataatatcatttaatcctattggaattatcttttcttccatttagaatgattgtgagttgtgcctttagaatctgttgtactttccgttaaagtgctaggatgttggttgggattgggaatgatacaaaaatctacctccaaaaaatgcattcctaagatagccgaccaggctaatctccttccaagactggaccattatagggcattttttaaaaaagaaaagtgcctgacctggactcctgtgctacttcagtttaccaaatgtccgtgtagcttgctgtgacaggtgttctgctaggagcttgttgtatagagatctgtaaatcatttcttctattcagtttaagatattcatccttaaagtggttacgtaggggcatagattttggcaaaacaaaatgggttttctaaaataaaacggggaagaagacaagtctgttgaagttttcatttgcctgttgaaaatgccttcatgctaattttatacattatgactatgaattgatatgtaatagctaaaattgataaaaacaaatgtcaaattagaaataatgaattttaagtatttttttaaatcttaatttggtgtggagagggaaccagataaataaaaggttatttgctgaccttatattttctgacaggggcatgatacaaaaagtcctagattctgtcagtttattccttaagtttaatggtcactttcatagatattatttatgggtggaaaatcatcatttcaatcctcaaattttctaaagtgagaaaaaatatccaaacttatataatcagttggatgttttacaacattgaacacagtttctttctgaggctagcaggctttgttttttgcctttttaaaaagattttctaaattgatatatcacatataatatctgtatatcatatatacggtatctgtatatcatatatacagtatctgtatatcatatatatggtatctgtatatcgtatatatatatatggtatctgtatatcgtatatatatggtatctgtatgtcatagatacagtatctgtatgtcatagatacggtatctgtatgtcatatatacggtatctgtatgtcatatatacggtatctgtatgtcatatatacggtatctgtatatcgtatatatacggtatctgtatatcgtatatatacggtatctgtatatcgtatatatacggtatctgtatatcgtatatatacggtatctgtatatcgtatatatacggtatctgtatatcgtatatatatggtatctgtatatcgtatatatatggtatctgtatatcgtatatatgtgatatctgtatatcatatatgtgatatctgtatctcatatatatgtgatatctgtatatcatatatatgtgatatctgtatctcatatatatgtatatatatatacagtgaaatccataaatcttaagtgtgcaattgaagacaatttctatacacacacatctaattgtgtaacaaccatccaggtctagatagagaatgtcccatcacaccacttcctagtcagtccctacctgtggccgccaaaagtaactgctgttcctatctgatgtcagagattagttcttaaattgcataaatgaaatccagtgatatagtctgtcacgtcttctttttcacacatcatcatatctttgagattcttccctgaggctctgttgtcctttgcttctaagaattgctctgtgatctcccattatttgactcacctgcagtttatccatattgttgttgatggatctttgggtttttagtttctttatattagaaataaattgctgtgtctttttatgaacatatatacatctctaggatagactgaggagaggtattgttggattacatagtaaggttatttttagttttagtgggtactctggttgtgctaatgtatactcccaccagaaatacatgagagtttccattgatgccacccctgccaacgtgtgatattttcaatttttgaaaacatttaaccatattagtggacttacgatggtatgtctgtttaatttgcatttcctggatgagtaatgatgttaagcatctgtttataagtttattgaccatttgaatggcttattttgtgaagtgacttctcaaactttcatccttgccttcctttttcaaattagatttttaaaaattactggagtgtccgagttctgtatcaattttgtttatgagtcctttgtcagatgtatgtatagtgtatccttctcccttcatgcggcttgcctgttcactttgataataatgtctttcaaagaacagaagttctgaattatagtgaagtcaagtttaagtctactttgtgtaccctagttaggagtttttttgttttaggtatgatatttaagtctgttactctcctttacttattattattttgtttgtttgatgtgaggcagggtcagagtaatttttaaaattctgatatccactttttccagcatcatttattgcagtgaccttttgttgcatattaagtgagacttcgtcattgtcttaactattttgcttttataataaatctagaaacctgattctgtaagtgatctaaatgtattgtttttctgcagatagttttcattctctttaggttctttgaatttccgtgaaaagtttagacttcacctgtcaacctgttccccctacggacacctacgcctacacccacccactcccacctctacctccactcccacacaccccatctgatgggagatttgtatttgggtcgtattgaatctagagattattctggggagaattgacatcttaacaatgttgaattttctttcttccctctctccctccctccttcgctccctccctccttctttctgacagaattttactctctctcccaggctagaattctggatattttgtgaaggtagaccagattttctaatagatggatgttatgtacaagaaaaaaaaataaggtgattttagggttttggcctaagaaatgagaagaatggagtgggcttttactgagataggaaagactgtgagatgtgcttgtttttgagggaggaaatcaggttataaagttggataaatcaaggttgaaatgcccattagatatctaagtgtagatgttgagtagacagttggctatttaaatctgtaatttaagggagatatttagattgtccttcttgtaagatcgtaggggcagaattaattttgtccttcactgtattccccatctagcacttgttcacactactggaagaccacttaggtaggctgttttatctttaactagttgaatttcgtaacaggccatgaggtccttaagggtagagagtaggtcttactcatttgctgtccccagcaaccagaccattgtctttgacattactaatactcaataaatgtttgttattttgtgttaaataattacatacctagatcagctttttagtttattttatttagccatggcatacagcctgggtgatatttttaaacataagtgaaaatgcctcccagttaataggccacacagatgttctcatatctcatctatacttagaagggtttttaatttacttttctttagttttcacttatttatattaagtaatttatgcacatgataaagggtaattaataaaaagtaagcatcccttttactctattctaagtcctctagtttctgtccctaaatgcaggcaccgttactgtttcttggctattcctccatacatagtctaagaagtatatgtgtgtatgtcacctattatttttcacatgagccattatatactatgtcctttccacaatgaaactgcactggtagtgtgaatggcacctctctttgtggcataaaccagtatttctcaaccagggcactactggcatttcctgggttgggtctagggataccaacaggcttgcattatgtgacattgtctattataataaagctttttcaggaagcagtatagcttagagatttttctacattcagtacgtgtaaacctataaaatttttaaaaaactcatgatgcatttaaggattaacttcccttaaaagcagtatttatttataatgttttctgattacatggcttcctcatttatttaatggaataaataatcagcaaatcatttttgttgaatgcctagtaagtgcacagaatttttaaaaaatgaactgggagactatacagaatttagagaagaacaaactcttgattctgtatatgaatctgatattttatagttggaaatatttctgagaattcttggttattttggctttatttcttggagactgtctacttttactttcttgtcaactagaatttaaaaagaggttgagagttattttaatgatttcaaatatttttagatttacttcatgcagccacctttgagtcttagaaaattccagcttattggcattttattgctgttatgttttccttcattgcttggaatcattcttgagtttcagaaagggtttgttcctaaaaattaactttacagtcatatattaactatttattttacattttaccaattatagccatgatctttatttgatttttttcagaagccatatcaaatattaagattgatattatctgctatttataatgcacaaagaaacagaatgacttgttcagagaagttgcatagctgtttggaactaaaattagtgcctggtctttgggcttctaaaacagatcttacctctgtaaacctaatatatgtattcagaaatataaatcaacaccttaaatctgaaaatagattggtccgtttctgaaaatcagatgttctaggcaaaaactttaatgaagagctgcttttgagtttccagatttagctgaaaaagatacatgttaaatttgaatttcagattaacaatgattttttaaaatcactgttccatgtagtacttgggacatagctagaaaaaaattattcattgtttatctgaaatttaaatgtagctggatatcttgtattttatctggcaatctcagcttattttccattacaggttgaatgtatctcttaactgaaatgcttgggaccagaagtgtttcagatttcagatttttttgggttttggaatatttgcatttatacctgctggttgggtatccctaatctgaaaattcgaaatgctccagtgactgtttcctttgagcgtgatgtcaaaaaatttcagcttttggagcattttggatttcagattttctggttagagatgttcaatgggaaaaactattatgtttgtatattaactccagacctttagcagtttcctagaacaaaaataaaccacagtacagacatccatagatagataacagattacatattgggtggaaatgcatacaatgtcatttcccaatcaacagacatttaataatgttaacatcaagcagatgtttgtaataaagctgcggtggcactcctcagcaacattgacatccagtgtttatccccttcactaacactcagtgtccttcacaaaatttgtacaactgattctgatgttttactcgttgtatttgaaaggtgatatgaacactttttcctcaaatctttttgataaaaatgttttattgagctttggagtaataaatatagttttcctttgttaacatgaatcaaaataatgttttgagaggtatgtatatactatgaagtttgaatattaaaaaccaagagatgttgcatgcggaaaatattaaccatcatctactttgtgggtgtggttatatggtttttcaaatggtattgctctttcaggttctaggtgataaacatgggaatgctttatggcttaatgaaagagagtgctcaattcagagaagaaatcagaaggtggtggaggaagcaccaaggtaagtctcctaagaaacatttataaagcggctgcttttatgcatttcattcattcattcattcattcatcattcactgacgcatgcattcagagacagggtctcactctgttgcccaggcagtggtgcaatcacggctcactgcagcctccacctcccaggctcaagtgatcctcccaactcagcctcccacgtagccgggactacaggtgtgtgccaccatgcccagctaatttttgtgttttgtagagatggggttttgtcatgttgctcaggctggccttgaactcctggcatcaaaagattagcccacctcagcctcccgaagtgctgggattataggtgtgggccactgctcccagccacatttctttttttatttgtttgctttatcagctacaattgcactaatgttcatgtagactctgttactgcatatttttataattaagaatttgttacttgatttcctcagtgctttaatgtgtaaaagggagagaatacttgaaaaagaagtgggtttttattagaggagaaagttgggtagacagccaactgtgacttctgcaggcttctaggaagtatggaacctgatggtacttcacgggatttctgagatatatgccttctagactttcatgttggtgaagggttcataaagttggtcctgaatttatcctaccatgaaaggcttctggagtgtggttcttggaaattccttgaattatcagagccactttgggtacttctccagggcatctttcatgagtttggtgtatggggcctcatttctcatttgatgctaggttgctatttgtatatactctggtattctctttgttcttaaaaatcctcaggtgagtgttcctagtaatttttaattaccagacggtaagaagtatagcttattgtagctttaatcagcagagctagcatatcttgatataatgcctatatagtttctgaaaatagtaagtgagaatgtgagtatatttttaatcccggagtaatggtaaaaattcaactctattttagttacattggtttttaaaaatatggcatggtgttattagttttaaaacatggaccccaaatcctttgccatttttctctttgagcagtgaggggaaggatcattgttcccttttcttgattctgtgctctgtgaaggcttgacccgtagactacttagaagtgatgctgtgccagtttccagcccaggccttgggaaactgccagcttccgcttcctgttctcatgggatgcttgtgcttacacaccagccagtatgctgtgaagaactgtgtagcttacataagatgtggccatctagttctcaaggcccaggaacaggatgtaagaagggaggaagaagaaaagccaaagggaatcctcttcctgtgtctttaggaagatcctggaaggtgctgaagctaattacttggtgttgatctgaagttagacacttagctagggagacttgttagtatctttttcttaagaaaccatgtgctgagctagaactagtactgtagtactgtagtatggaggaaggggaaaaaggatacctgtggaacagtaagagtcttcaacacacatgtcttgcaattttctgtttccttgactgattatcaattccaattcaattaacactctgtttttagtaaaaacctactcaagtgttacctgggatagaaatctttcccagactgggaaccttgaatcataaaatgtgtttgttttttctctttgtctagaaatacaaacttttcataatgaataccttatctacttatttagagaaaaaaaggaaaatatacagcagtaggaatcaaaatgaaaaagctagaactcatcattaatactgacctgatatgtatttgtacactgtgaaatgttaaaataaatggaatgtgtagttttcagttcctggagtaagaatcggctgggcatggtggctcacacctgtaatcttagcactttgggaggctgaggtgggaggattgcttgagcctaagagtttgagaccagcctggacaacgtagtgggacctcatcttcacaaaaaagtaaaaaatcagctgactgtggtggcatatgcctatagttccagctacttgggaggctgaagtgggaggattgcttaaccccagaggtcgaggttgcagtgagccgacatcatgccaccagattccagcctgggtgacagagcaagaccctgttctcccccaccccccgaaaaataaaaataaaaaaaagaatctactaatgtgctttgagggcaatgctagctagggtcactcatatctctggatatctagcagggcttttgaaaagggcaagggcaagatcaaataggagaaagatagtttcacagagctgcactgagattctccagatgttatgctattaattgttagttggggttttttttagttgcattaattttgtcagccagttattgttgaaatgtcatctatgtctatacattaggttaatgcaaactatattatagataattcataacacttgaacccattgatttattgtaacttcaccaaaagggagacagtaggaagtacacttcccacctgtgaactcttccccctcccccaccccaatccaacttgaatatattcaaggctctgagtctaactagcaatctatatgaaatagaaatgtaatatgaatgttaaaagacaccgtggggttgcatgcagttgaaccaagaatgtgagaaataagacagtaaaatgaccagatccttggccagaaaatggggaaggggcattacagattaaaagagtcttaagatacaaaagccaatcaaatgcagttttggaccttatttggatcctgattcaaagaaatcagctgtataaagatatttatgagatagagaaatttgaataccaagtggatattaaatgcttttaaggagttcttgttttttgtgtagttgtgttacaaaagggtactttatctcatagaaacagacatgtatgtttttaaaagtgaaatgatacctaatttgggatttactttaaaaacaataaagggtgggcctggtagagaagtgggcaagtagcatagataaagccagagtggctatgtattaataattgctatatattggaggcagcttcatgcaagttttttatactattccataataaagcttttatagcatgtcatctcaatcctgctcatttgagaataattttaatccacaagtagaaaagtagttaatgttttgtttctcagagcctttctttcatagaagcaaaatctgtgaaaatgcaaagtggtttgatgatatttttttcagggtttgttgaagtcattttagcttaacttgcctgcttgaaggtgggtttggtatcttgaagccaaacgtgcaggatttagtggatgtattgctgattcttgttatttgtggcagttatgttctctaaagtcaccttgattactgaattagtgaacactgaataatttcccctaggggaaatacagggttaggttcctgcgagcctttgcttataacattttcctcagtggattaatacataattttgttttttgtgtatttctcatttaatatctgtggttgattcattaacagtgaactcacaatcctggccaacaagactataacacgtgcctgagtaaagcttatcccacacacattttctccagacagtacttcatggccttcttgcacatgggaaccccagacagcacctaaggacaatgcttgatgggccatttcacaccatgaaatgacacacacacacacacaaatgcaaaaaaagtgacactaaacagaccttgaaaaggatgcttgttatagtatgagcattgaaacgagaagggagagcatcaccttgttcagccttagcatactggagtctcaaatttttcacctctctgcacttgttcacaaaggaccatgaaagcgccttaagtattgattttggggttacaaataaatttcagcaagtaggcagatttgtaaatatggactacatgagcaatgaggattgattgtgtatgttagatactaataagttatttttctcccagtttttggctcgaagcaattctgaatatatatgttaaatattagaagttgaagagtagttatatattttgtgaatggattgaagttgcagagtaatgtgaaaagttcaaatgttttatacaaatctaaagttgacttatttgagcatgttatgcttaataatatagtcaacatatattataaaacatatataaagcacaatattttgaattcttaaattggtatagatgatctatatctgagtaaactttaagaaaatgtttatgtaatgcacacaaaagataacttgatttttgtccgaaatgtagacaaacatttttttgtatatgtagcatttttttggatgcggagactcgaagagcgatgggagaacaagctgtagctcttgccagagcagtaaaatattcctctgctgggaccgtggagttccttgtggactctaagaagaatttttatttcttggaaatgaatacaagactccaggtaacaacaactgttatttattcctctccatgcctctgtactttacccttccttctccacccttttttgttttataaatgttaaaaaattaactccataaagtgttaaataaagatttagtttttatgcttgtgctaagacatctgttaggaatgacggatagtatccctctaaagttcaatgtctagacctctgctttgtcactgttaatactttatgttggaaataccactttgtttttttcttgaacctttctagatgaactgtatttgtcagtgtgtatgtgctgttaagaaaaattactctagatattacaaataggaagtgatacagtgattgcaaaatctttggaaggatggaggaaggaagggtacccagagtgaacttcggtggtgactcccactgctgtaccactcagccaggctcccagaggaaccggcacctctgccacagtgaggacgttgagaatcaagtggctgcccttggaactgttggctttgggggacataacttccttagttctaaccaaatctcaggaagcgactggcgttgtaaccggtggctttatttccttccttcttcccttttttctttcatttaaattgtgaactatacagaaacatacatagaacacaggtgaataattgaatgtattattataaagcaaaaatcaatgtaaacatcaactgggcctagaagtatttacaaaacagccagctctttttacactagcctcattttcttctccttctcaatgattctgattccccctccatcttccctagagctgtctcctatctgactgacttctcagaaccttcagttttcatatcattcttcctttgaattacgcatacctaagcagcattattacttttgtttgttttttaaaactatattaatgggatcgtatagtattcgttcttttgtgcctggcttcttttttcagcatggcatttgtgagatttgtgctatttcatggaactcctgtatgatacattttctaagaaaatgccactatttctttatctgttagatttctgtagatagtttatttccagttttatggaatttgtgttagtttgctaggactaccataacaaatgatcattaactatagcttaacacaacagaaatttgttctcgtacacttcaggaggccagagtctatcatgcaggttccagccgagtgggttccttcctggggggttggagggagaatccactccatgcctctctcctggttctggtgttgccgacagtccttggtgttccttggctttggcagcataactctaatccctgcctcagttgtcatattgccttctctctgtgcatctctgtgcccagggttcccgttttctgtagggacactagtcacattggattcaggacccttcccatttagtacggcctcatcatacgtgatttcctctgccaagatcctgttttcaagtaaggtcacagtcacaggttgtgagtggatgtgaattttgacacgacactcttcagtccaattcaccattcaaaaaacacatatggcctacagagataaatagattagtacttgcctaggactggggtgggtgagtggggggattatgggctgatggctaaggggtggaataggacaggagagactgaggaaggcatacttatgcctgaaaacagtgtcaactcttcttccgttaggcccttgggggagggggtggggggggagggggtgttgagtcactgcaggcatgagctgggtcgagcttaagccttcctgcagtggttttctcacgtgcaccaaggggccgcttgtgggatttctgcatgcctgcttcatcctgagcttgagggcttgcctctgaccctgtgcttcatgggagccgtgtcttcatgcctgtgcctctttcccagagggagactcctgtgggccctggttagccctaccatgggtgcaggagggctgttttctgttcgctgtgccgtggcggtagaccgtccttgtgtccttgaactttgaggtgagttcagtagtggccctgctgctccccagccgtggggaagctgatgttctgggctccaggtggatttctgcctctttcctgatggttatcttttgcgtgctatggctttcttcatgcttttactctcgacctacctgtttgaagacagttcacgtgtgcctctgtaagcagtgtataatttttcagcccagtttgatatgtttgtcttgtatcttgaccatttgctccttagaaagttgacagaaatgctggtatttttgagtttaaatttctaatttttaaaaatgttttcttcttgtccaatctctggcctttttcctttttttttctttcttttgcagtatttatcatttaattttttcctgtacaagtttgggggttataaatactgctgatcttttggtagaacctctacattacaacacacatccttaatttatcaaaaactgataacagtgtcttttcacctgagctgccagactgacaagggagcttagaacatttaaagtccgtttactgtctcctgacttgggtacaattatcccccgaggccatttctcttattattttagtcatcattcattccattcctcccacatatttacctttctttgtctttgtttctggtagtttcttttagaggtttacttgggacaatctctttttgttgacagccaatgactttatgttgccttgttcatgaaatgcgtttttactcttcttagacgtcttggctgtgggccgtggctcacccctgtaatcccagtgctttgggaggctgaggtgggaggatcccttgagcccaggagttcaagatcagtctgggtaacatagtgagaacttgtctgtaccaaaaaaaaaaaaaaaaaaaaaaaaaaaaaaattagaaatcttagtttggccagtatttttttcaatttattgaaaatattatttcactgtttctggtgagacttccccactcattctgcattctgcttatttggacataattgatttttccttttggtagcatttattaatttctgtttttgttagatttcctttaactttttgctgattcgtgtacatgtatacatggaattcattgaatattttgtctgtagattaatgtcttttaattttttttggaaattctccaccattattacttctggaacaatctcacatacacagatgaataaacctataactttcattttagacctccttaatatatctcttatgtttcttatgctctctttgatatttttcatcttttttggataatttcttctgtctttcttaccttcccttatgctgtatttaattaattaatcacccattgagttcctgatttcaattgtttatatttcagttctgaaatttctatttggttcttttaaaagtatgattcattggtttttatcttttcttgtctcctatttgaattttcaattttgacttttattttttgaacataattaacttatttgttttgtagtacatgtctgataatgttgacatgtgaagtcttatgactacttgtattaactgctttttatgctgtttcttggttctgctgttgagttcctgttgggccttgttattatactgtcatatacagttattttaaaaattgttattaatcaaaacctaagatgatggattctttcttatagagatttttcaaatttttttctgccacatgcctatggacagtagtatttgtgactacggcaatctaagctcaaagtgtaaggctccttgaactcctgaggggatacacagcccggttgcagttctagagaatggttggttttattccagttcagtcttatcttgaggttgcattcctttatggtgcccactaaaagtgggggtagtttatcaaggttctttgataaactgatactttggtggcctcttatcttcgtggttatgcttttgatttgttgatgccaccaaaagtatagcttatattcatagtccttttttcctggaatggcaaatgacgttagggcaaaaatggtgttgagtgttgggtttgcaaatctgtgttttcatcttggttttggctgatcccttcctatattcttaccctgtgatgtttttaagaagacctcccccatctcccattccccaccagttgttttctagtccccaataagcccaagttccaagctgagtggctttagaggtacattatgcctatagattaaataagtttgtgtcctgactctcaacaccccccaaaagcagtgagcgggcagtggaatgacagtctgtgcctcactgctatctcacttttcctttccaaatctcatgcatttgcacatccagaacctcatgcagtcacatggaaacctcagctgtaagggagtctgggaataggctttttaaccatctgtattctgcagtgtaagagtataccctagaaggagtttggagggaaagttcagtgccagcccaccattttcacatgaatataatcaccaaaattttaatctgtaagttatatgtaaaaagttaaaaacattgctgtattttcattgtaaagtataactgtcaaataatgtggctgattttccttaagtatggcaaaagtgatctatctagatgcattttgagactagtattgtaaatacttgtagcattttataggtagtagctcagtagttgttgcttaaaactcatacttcctttgaaatcacctttgtagcctatattttattttgtgactatctttagaagtgacagaattttgccttttgaaggttaatttgattttgattaaaatgtatctttataactaagtatgtctaattagattattagctgggaaatcatgtttttggttaaagtgaagactttattttgtcataatgagaaaaatagcttgtaatttgattctgaagacaatttgagacgactgcaaaatatttgtattctattctagaccaaagagatctgagattttttaattgaggtacttatcagtatttatggaattgacaaatgggcagtttgttattctgttcttgtgttatctttttttccatttgtttctggctcatttatctcaggttataagtttgttcaagtttgtaccatggttgtttctggtataaaacccgatagttgattttttttttttttttaaacagagtctcactctgtcaccaggctggggtgcagtggcgtgatctcggcctgcaaacctccgcctcccgggttcaggcaattctcctgccttagcctccagagtagttgggactataggtgcgtgccactacgcccagctaatttttgtatttttagtagagacagggtttcaccacgttgaccaggatggtctcagtttcttgaccttgtgatccacctgcctgggcctaccaaagtgctggtattacaggcgtgagcctccgtgcccatcctgtagttgatatttttatcgaataattctatgcagttggtcaagactatctaagtacctatgttttgtgtattggatagcttgctaggaaattatgttctataccctcaaaaaattataaaaatatttcaagaaaaaaaatcaaattcacaaagattttgtcatattaccagatctaatatgacaaaaattgtgaatcattaactcataatgatatgaatcagtgctatagaatgtcatgtccatgttcggcctgaaattgccccacttctcaccggtggtctgggccccacactgtgagaaaatatttcactaatacctgcgcttagcaaacgtcccaaggtctctgactgattagagctcttgttcacgaacagagctctgatagtacctaatgctgttaagcgtgctattttaatagcattctatgatatttaacatcatactttgagacatttgtctcccatgtagtgtttaatcatatttttctctcttgtggtttacttccagtgactgtgatcctgtcagttaccagaataagttaattttaattttttagaatgtatctgtgtgatagggggtatttgatgtggaggatataattaaatgggagcatgaacaaagaattttggacttcatatgtgttcagaaaactattcttacatattccaaagatttctttctgatattgtttaaacaatccaatttgtttttttttgagacggagtcttgctctgtcaccaggctggagtgtagtggcacgatcttggctcactgcagcctccacctcccagattcaaacaattctcctgcctcagcctccggagtagctgggactacaggcgcataccaccacgcctagctaatttttgtttttttagtagagatggggttttaccatgttggccaggatggtctcgatctcttgacctcatgatccacctgcatcgacctcccaaagtgctgggattacaggcatgagccaccgcgcctggcccaagtgttcttttaatagtagacattctctttcaaatttctttactaaccttaaattataatacttaaggcacattcaccaaattctttatctcccaagatatatgttatctctaattagtgtttcagtttgaactagagggctataattttctttgttctttttttattttctttgaaatttcctgattgaactttcactttttccagcttcagaactgtgttttgtttttgtttttgttttttttttttttggtaacagaaatgcatcttcactttctacattttcttaagagtgaaatttgaaataacaatacagtttctccataaagagatgcaacactaagaaagtcaccgcgtttggtgcattaatagttggttccgttgactggttttgttctcaatctggtcacagtttatgtaactgaattacctttgctatcttcacatatttttgctttattttttttaagtcactggttttctgttgcttaaagataaaatttaaatgcttttgcatcacaacacaagcttttttttttgtagccctgatttttcccccagagtcctgtttcttgccagtgccgatctctgtgtatgaattgcaagagactcctttctttttcctgaaggtgcctttcagtttgacttctttgtgccttgtatcatgccactcccattgcttggaatgttctctgttcacctctcacagtgaacactgagctatgtatctacctgcacacccacaccacacacacctgtctcccctctctgaccatacttctccctcatctcacctctctccacatttgaaagatggacagctagatggagaactactctacggacactaggattttgttaaaatgctattttattgaagtgtattctagtagtcccccttatccatagttttcctttccaaagtttcagctacacacagggtctacttcatttcaaatatattaaatggaaaactttagaaataaacaattcataagtgttagattgtgcactatcctgagtagtgtgatgaaatctcacaccatcctgctccatcctgcctggtacgtggatcctctctttgtctggcatctccatgctgtagacactccctctccatgagtcacttagaagctacctcactgcaatgagacatgatggtgccactgcactccagcctggacagagcgagaccctgtctctgaaaaacaaacaaacaaacaacaacaacaagaaaaaacagaaggaaaaaaaaatccgcctcggtgatcacatcgactgtatgatacctcagtgcttatgttcaagtcacctctactttatttcataatggccccagcatacaagagtagtgttgctggcaattcacatatgccagagagaagccataaagtgcttcctttaagtgaaaaggtgaaagttctagacttaataaggaaagaaaagagtcatgtgctgaggttgctaagctctgcggtaaggatgaatcttccgtcggtggcattgtgaagaaggaaaagaaatttgtgctacttttgctgtcaaaagtcaaacttcaaaagttatggccacagtgcatgataagtgcttaagatggaaaagacattaaatgtgtgtgtataagacatgaatagaaaagtgttctaattgacagcaatcatgttctatactatccacagtttcaggcatttgctggggacctaggaacatgtcccccaaggataaggggggactactatatatgcaatttgctgggataattttagtttcttattttgttgaatggtaatactcagaatttataatactttgtttaaaaaaatctagtggttcataagagtctacaatggaaaagttactctccataccacacttttatcacagccatttatttttcctctgttgaagcaacctttgttttttttaacatactaatttgggagtattccatgcctaatttaaagcattatctttttcattttaatgacttctaataacctgtcatagggatgtaacagtcatataatttcaccagatctctatcgataatttttccagtattttgctatcccaaataatgcaattatgagtgaccctttatatccactttgcacgtgcagaagtagaattgctgggaatatatgtgcttttataaattagttaagtattatcagtttacctcttaaatgagagcttgtttcttctctccctggccaaaagtgttttttgccttttgatctttgtgtgatagtgaaaaatggtatattgttttcattgtttatcatgaatttttctttatagattcatttatatttctgtgaattgactattagatcctttgccctttgggttttcttattgatgtgtaggtatttgcttattgttgggggaaattagccctttgtgatattgtcagaaaggaggggctttgtgaatattttcatagggctacagggcaggtgctttctgagcaaagaccctggcagttgtgagaggtgacagcgtgctggcagtcctcagagccctcgctcgctctcggcgcctcctctgcctgggctccaactttggcggcacttgaggagccttcagcccaccgctgcactgtgggagcccctttctgggctggccaaggccagagccggctctctcagcttgcagggaggtgtggagggagaggcgcaagctggaactggggctgcgctcggcacttgcgggccagctggagttccaggtgggcgtgggcttggcgggccccacactcagagcagccgggcaatgaggggcttagcacccgggccagcggctgtggaggttgtactgggtcccccagcagtgccagcccaccgtgctgcactatggcttggccccaatattttctctctgatggggaaaaatggccacctgagggaagtacaaattacaatactatcctgcagcttgaccttttctgtaagagggaaggcaaatggagtggaataccttatgtccaagctttcttttcattgagggagaatacacagctatgcaaagcttgcaatttacatcccacaggaggacctctcagctcacccccatatcctagcctccctatagctccccttcctatgaatgataatcctcctctaatctccccccgcccagaaggaaataagcaaagaaatctccaaaggaccacaaaaccctcctggctattggttatgtccccttcaagctgtagggggaggggaatttggcccaacccgggtacatgtccccttctccctctctgatttaaagcagatcaaggcagacctggggaagttttcagatgatcctgataggtacatagatgtcctacaaggtctagggcaaaccttcgacctcgcttggagagacgtcatgctactgtgagatcaaaccttggcctttaatgtaaagaatgcggctttagctgcagcccaagagtttggagatacctggtatcttagtcaagtaaatgatagaatgacagccgaagaaagggacaaattccctaccggtcagcaacccatccccagtatggatccccactgggaccttgactcagatcatggggactggagtcataaacatctgttgacctgtattctagaaggactaaggagaattagaaaaaaacccatgaattattcaatgatgtccgccataactcagggaaaggaagaaaatccttctgccttcctcgagcggctacgggaggccttaagaaaatatactcccctgtcacccgaatcacttgagggtcaattgattctaaaagataagtttattacccagtcagccacagatatcaggagaaagctcgaaaagcaatccagggccctgaacaaaatctagaggcattattaaacctggcaacctcggtgttctataatagggaccaagaggaacaggcccaaaaggaaaagcgagatcagagaaaggccgcagccttagtcatggccctcagacaaacaaaccttggtggttcagagaggacagaaaatggagcaggccaatcacctggtagggcttgttatcagtgtggtttactaggacacttttaaaaagattgtccaatgagaaacaggctgccgcctcgtccatgtccactatgccgaggcaatcactggaaggtgcactgccccagaggacgaagattccctgggtcagaagcccccaaccagatgatccaacaacaggactgagggtgcccggggcaagcgccagctcatgtcatcaccctcactgagcccccggtatgtttaactattgagggccaggaaattgacttcctcctggacactggcacggccttctcagtgttaatctcctgtcctggatgactgtcctcaaggtcccttaccatccgaggaatcctgggacagcctgtaaccaggtatttctcccacctcctcagttgtaattggaagactttgctcttttcacatgcctttcttgttgtgcctgaaagtcccacacctttattagggagggatatattagccaaggctggagctattatctacatgaatatgagaaacaagttacccatttgttgtcccctacttgaggagggaatcaaccctgaagtctgggcattggaaggacaatttggaagggcaaaaaatgcctgcccagtccaaatcaggttaaaagatcccaccacttttccttatcaaaggcaatatcccttaaggcctgaagctcataaaggattacagaatattgttaaacatttgaaagctcaaggcttagtgaggaaatgcagcagtccctgcaacaccccaattctaggagtacaaaaactgaacggtcagtggagactagtggaagatcttagactcatcaatgaggcagtaattccactatatccagttgtacccaacccctataccctgctctctcaagtaccagaggaagcagaatggttcacggttctggacctcaaggatgtcttcttctatatttccctgcactctgattcccagttcctctttgcctttgaggatcccacagaccacacatcccaacttaggtggacggtcttgcccaagggtttagggatagccctcatcggtttggtcaggccctagcccaagatctaggccacttctcaagtccaggcactctggtccttcaatatgtggatgatttacttttggctaccagttcagaagcctcgtgccagcaggctactctagatctcttgaactttctagctgatcaagggtacaaggtgtctaggtcgaaggccccagctttgcctacagcaggttaaatatctaggcctaatcttagccaaagggaccagggccctcatcaaggaacgaatacagcctatactggcttatccttgccctcagacattaaaacagttgtgggggttccttggaattactggctttggccgactatggatccccggatacagcgagatagccaggccactctgtacgctaatcaaggacacccagagggcaaatactctggtgggaatcagaggcagaaacagccttcaaaaccttaaagcaggccctagtacaagctccagctttaagccttcccacagtacaaagcttctctttatacgtcacagagagagccgggatagctcttggagtccttactcagactcgtgggacaaccccaccaccagtggcatacctaagtaaggaaattgatgtagtagcaaaaggctggcctcactgtttaagtgtagttgcagcagtggccgtcttagtgtcagagactatcaaaataatacaaggaaaggatctcactgtctggactactcatgatgtaaatggcatactaggtgccaaaggaagtttatggctatcagacagccacctacttagataccaggtgctcctccttgaaggacccatgtttcaaatacgcacgtgtgtggccctcaaccctgccacttttctcccagaggatggggaaccaattgaccatgactgccaacaaattatagtccagacttatgctgcccgagatgatctcgtagaagtccccttaactaatcctgaccttaacctatatactgatggaagttcatttgtggagaatgggatacgaagggcaggttacgccatagttagtgatgtaaccatacttgaaagcaagcctcttaccccagagaccagtgcccagttagtggaactagtgcatcaccctctcaccctccctctccccaccaccaaaagttgagaaggggcagatatgccagcaactcttctacaagctctaattttaatagtctgagctttcctttccagatgtgcatacccctctgcatgtgtgtgggggggaagcaggccattaactacgctgcctcatggggaagtggggtatgaggaacgggactaagatgttctgtgagtaaacaattgcactgatctatgattcagaaacctttttatttttaataaaattttctttttaattgtcagcaaggcaagttatttctatagaagggtgtgcccttacagatggagcaatggtgagcacacactcggacaagggaggggaaggggttcttatccctcacgcacgtggcccctgctgctgtgttgttcccctgttggctagggttagaccgcagaggctaaactaaatccaattggctaatttaaagagaatgacggggtgagtgctttggcgggagtcagggcagagcaggtagcaggtgatcggaatgagttagggtggagtaggtaactgaaaaaggttgctttacgaggaacttaagtttaaaagtagaaggcaacgaattgaacatattgacatattaattctttgaaacgaaatttagaactcatatctaacaacccctccccttgtatttccttacagctttcttttcaaacttttttttaatgtgtcttggcttagttgttttgcttgattttccaaaagaagaagcttctctggataaggtggaggatagttaagggaggagaaaccttttttttttttttaatgtcttggcaggattaacaaatactcgtatgaaaacataacagatatgatttgtaggtatttttccttatctattgcctttttaactttgtatgtgttttttcttcttgtatagaaagtttttatttgtatgcagtttaatttttaaatcttctctttgtgatttcaggagtgacatacttaggctttctgtgctctatgagcaatcaaactgttttctttcatgttttcatcaaatatttcatctttaatggtgaaatcttcacttcatttggaattcattttattttattttccaatggctacctgattgttccaacaattattgaataatcagtcttttctgtaataattcgaagtgctatctacattacatactgaaattgcagatgtatgcagacctattacttcactcttctttttttaatttttctgcttattcatctcctagcaccacactggtttaggtattatagctatatattatagtacagtatctagtagaactattcctttctcattacttttatttttcatatgaaaaattagcctatagattagcttattgtatttatatttaacagaagaaaaagaaattaaaatgacagaatctctggactattagataaatgtttataactttccacagatatattaattcctaaaatatgttctttttttcccttccagtgacatggaactaaaatatgttcttaataagaaaaatggttatgaaaaacatttatatttttgtcatcattttccttcatatttcaatctgaaagagtatattgtttctcttttacaaaagtaatggaaattggcatacttatatttaatcccgctgtctttacttcctaactcttcatgtttgctagttttattattagttctatgtgattgtagcatttcctttcttttctgtaggcatggctctcctggaggtttcatcttacttgtgtattttatcactttatggtcactgtcagcatcttaccatagcttcatgattagtgagttctttattttgatttgttttatataaagttagggggtttttttaatcaagaatttattttttagagatacctgtgggtagtgtatttgaattcttagatggattaaataaggttacccttatatttgaaattttaactcagatgcaaaccgtttgataccttcacaattgtaggactttaaacatctttctgtggtagaccttcagaattttatgagggagtatcaaaatttaagattatcgattgttttattcaattcctctatatatcttttctttttccctttaaaaattgaatctgtttgattaagaaagagatagacggagtttttatcataattttaaaaacgaactttatttgttagagcagttttgggtttatagaaaatctaagtacacagaattcccatatgcccctccctcatgccacaccatttctctacttaacatctcatattagtttggtgcatttgttacaactgatgagccgttatcgatgcattgtgggttttttgtttgtttgtttatttttagagagaggggtcttactccaccacccaggctggagtgcagtggtgagatcctagctcattgcagccttgaactcctgggctcaggcaatcctgccaccccagccgcccaggtagctgggactacaggcatgcatcaccacgcctggctaatttttgtattttttgtagagacgaggtttcaccatgttgcccaggctagtctctaactcttggggcctctgtctcctaaagtgctgggattatagccccgtgccagggcacccggcgatacattgtttttaactaaagtctgtagtttacactagggttgctctttgtgttacacattctatgagtttggacaagtgtatctaccattatggtatcataagaataggttcattgcctcagaaatctttgtatccaagacacctttgcatttctttccttctttccttgtttggttctttctgtctctcttctttcctttcctttttcccttcttttctttcccttcctccttccttcttttcctttttccctctgtgtgtctgtctcactttcttttcctcattgtaattttcacacatacagaagtacttcagaatagcaacagtagtagagtagagccctaggaatctgcaaccagcttcttatttacttcccagtgttgtttcacgtatgccttcttttcctcagttgttcctctcttggctggagtatcagacattatataaattcacatcatactgaagtatatgtctttaagttttccctacattcctaataatgcatatttttaaatatttatatacagtataatttgatgtatgtgggtttatgactcttgtacatgagttatgtggctattttcttgcctgaatgtttatcttgtttaaatgtttaatctgaaatcctactttgactcatgtcatactgtatctcctcctgttttgtctggtcctttattttaaagccttctttattagttgttttgtttttttagtttagaaaaaattatgtgtgtatgtgtatttgtatagatggggtctcaacatattgcccaggcttgtctagaactcttgggctcaagggatcctcctctcttggcctctgaaagtgctgggattataggagtaagctgctggcgcctagcctgaaaaaattttctaagaacctaatccaacattttcttttagtgtgaaaatttaattcttcccattttaaatacttgattttatttattttatcttatatttaaaaattttttttcttgttttccattttgtttttccttttctgtttgttgcttgaaataatggttaattatcccttttgtttcccattgataatttggaaatcctattgtcctttaaaattttatttatgtttatttttctattcagacagacgttttctctgtcatttgtaaagatgatgtaactagtttccttgactttccaacactgaagatttgctaagataatttaatacttctaagctatttttagtttatctcttcttttttagcttttttttagctcccatgtatacagcccagacacatctttcattatttgctatatcttcagctttcttttttgagatttctgccctagttcacttatttgtgtagcacattttttcatgaaatttcttcagtagaatgtgtggaatatatgctctgaaatgtcacatcctcaactatgtttctttagccctgaacgggggatactgttttgattgaatacaggattcttgattaggattgggtttcggttcttgtctttcaggagcatatgaatttcagctgtgttctagcttctagtattatgtctggtgtcattctgatttctttcccattgtagataatgtagtcttgctgtctgaaagtttgcccaattttttttatttctctctctctctttttttttcttgagacagggcctcatcctgtcacccaggctggagtgcagtggcatgaacctggttcactgcagccttgacctcctgtgctcaagcagtcctcctgcctcggcctcctgagtagctgggaccataggtgcatgctgccacgcctggctaatttttaaatttttttgtagagacgagatctcactttgttgcccagcctggtctcaaactccaggtcttaagtgatcctccagcttggcctcccaaagtgctgggattacaggcatgagccgttgtgtctggctctaattttcttttgatcattggaattcagggacttttttttccaaccaggatatgccttggtttgtgtttgtatacattaaccctgccttttagtccatgccctttttcagtgttcaggtttaagtattgcttcatttcagaggaagtttcttctgttatttaactatttccttccatcagcaattttctcctccttgtggaacttctagtttttgcaatttaggtctactggatatgtttctcttatgataactgtcattttatatttatgctgtgtctcttgacattatttctttattgatcttccaggttactaattcaggttgcaacagtggttatcctctcctataagtaactgactaaattgtgcaattgggaaatcacattattttagctcagaaattctaattgtgcgttacagttagccctccttacctactagttctgcatctgtggattcaattaactgtggcttaaaaatttaaaaataaaatgaaaatatcaattcaacaattaaaaaataccaataaaagcacaatatagtataacaacagtttacatagcatttacattgtattactataagtaatctagagatgatttaaagtatacggaaagggctgggtgttgtggctcatgcctgtaatcccagcacttttggaggctgaggcaggaggactgtttgagcccaggagatcagtgctgtgatgaaccatgatcatgccactgcactgaagctgggatgacagagcaagacccatttcttaaaaaaaagaaaagtgtacgggatgatatgcataggttacatgcaaataccatgttactttatatcggggacctgagcatctgtagagtttagtattcacaggggtcctgggaccaatcccctggggagatggaaggaggactcaggggatgtgtgtgcacatgcacatatgtgcattgctacttcttaagtttttaagtgcctttactgctttttgggcaaagttgtatttttctcctgtccttcagcagctctgtttcacttggtctgtgtaatcattattctgaatgttttttctttcttgtgctagtaatccccctgctgtggttttttgggggttatcagtactaagttctgcttcttgaaatattctaagtgacagcagcccttcagatggttgaagacatgaccatatctactccagaggcctggaagagcatatgtctcctagcattctcatctcaaggacagaattgagctaatttttattgactacttggattcctgggcaaagagaccacggacccatctggagcctttattgacttttcccctgaggtccatggctctttgcaagccagtctgtctccatgatgtgttcctttcacattcttccctagagttctctgaagctagtctccagttttcgttcagccacagagggagaagagcctgttcccagtttttggctctcatcttctccctagatcttggtgcttcccatgtcctcagctgcttagtaactctgggggagatagacagcatggagtttggagtggagaggtgggagccaggctggttccaggctgtttttgacagcttctcagagcaggaatagctaacctgggttatctggatctctcatgagctttagggaagtctgtgaaccctctgaagtcagatatatagttttttagtgagaaattcagtgagattcaaaattgtaaaatgtttcagaacaactgcagctgactaatggaggactcatttaatcattgtttttgttaattgcaaacatctactgttttcactcagagcaagtaaattctagttctcttccttcttagctgtgtgaccataagcaagttccttaacttctgtatgttttgatttcctcattagtaaaatgacattaattatagcatttgctgtataggattgtcagcattaaatgagtttatatagtttacaaattcaaaatagtacctggtttatactgagcacacattctttctgctaactgtgagtatcttatccataacatttgcatgctgtttattatatattggttgacatttttactcttactgttgtcattattattaacattattgctattactattgtcattaatataaagcctgtctgacatctgaaaagatggcaagccacatattaaataataactttctctcattcttttgtcagttaactgcaaaattattgttacatgtgaacaaacatatttgaaatattaaccacttttaaagagatctcctttctgttataagggtgtttgtgtaagaagagtctgggaggaaaaatggaaactgaaatcttccaaaaatgaagctgatagagaaaagtatttactacatggcttaggcctttgtgttaagattaatattaggaccctgaatacacctttccaaattcgtgtgtgtgtgtgtgtgtgtgtgtgtctgtttgtgtgtgtgtaattaataatttccagatgctaggtttttttttagatttaagtgttttggaaaagcatcctctgtatagtctacaaagtctataggagttagaaaattcccaaatagagaggaataaaatcttaataagtaagtaattaaaaccccaaacatggtcagtcagctgtccatatctttgagaacagacaggtaaactgtcccacttttgttagacttagtcagttgcttatgttgattggtacagtgcaggaggaatctacttttaccatggaaggaaaggtacagtacaattgttgaaattctgtgaaggctatacactctaatctcatcagggggaattctgcatcacagggaacctttatattccagaaagattttagaaatttttttgtaacttgattttgccctttgccatttgtttaaaaattaagaattattgcaacctaaattctggtttataacaattaactataattgaacaaataccatattctaatttcagactagttttggattaaaaaaaaatttctagacctgccagatgaaaatattttggtcttttatggaattggagtgtttgatagaaagaatgaggagaaattattgggaaaaggatttctaactaattgtaaaatttcattcttgtcagaaggggcattttggatgtgagcaaatgttgacctttttgattgtatttaaaatgatagaggccagggctctcaggctgtttagagtgagccagaattgggatgttttggcatgttttgttctgggaaactgaggatagaaggtaggatgtgttataccctcccttattatttactgaaccttagtagaaaatgaaggaaagaagtttttggtatacagatatgtatagataagcttttcaggcacttagatttggggttttgttttaaagcatattgtaaatgatattgctgtctgagttctggactctttttatctatgtttaactttttaaaactggtctttgtattagtttgctagggctgccataacaaagtatcatacactggggtggctgaaacaacaaaaatgtgttttctcaaagttctggaggctggaagtccaaaatccaggggccaacagggtcagtttcttttggaggcctttctcgttgcttgtgggtggccatccactccctgtgtcttcctgtggcctctcctctgtgccttgtgttgtctgggtcctgatcttctcttatgaggataccagtcatgctggattagggcccactctgatgatctcattttaacctgagcacttctttaaagaccatgtctccaaatacagtcacattctgaggtggtggggctaggacttcaacatacgaattttggggggtacacaattcagcccataatggtttccttatcatttcttcatgtgattattattcttggggtcaccaggggaaccctataatagaatctgttccgttttcgtggtcactcttttttttttccatgtatacatagcatataaaaattttaaacaacttactagaatatgactggttctaaaaatcctatctcccatccccccaaaatgaagacttgacaccggttagtctattctaaacattctgatttcagctccaaagtgaatttttaaggacaagttccagaaatgaattggcagtggtgatattaaatgcatatttagttttccaagatgagctggaaaactaaatttttagtttttagtgctgttggactatttaggaatagccagtactcactttgatgtatagttctgatgttattggcaaaaataaacaaatcaaaagcacaaaacaggcaactgacaatgtcatgtctctgaagagcacatctgtatataatcctacacaggtatacgcaccttcatccatctattctaagcacgaagaatgtatcagagaaaaggggagaaaaattggtttctaagccctgcagtccaactcttttttttgtttttttctgaggtagagtctcactctgtcacccaggctgtcactcttgaatataaccattgtttccaaggtgagtttataggagtgatgtgttggggcttatttcccaacatgcttttcatccttgagtgctgtggatcaaaatctaataaccttagatctttattttgaaatcctgtattctcaggaggtagagcttcagaattttagtaggtacatgctagattctgttccgtgaacagaaagagcagaatctttctgaacagacagagcagaaccaaaaataatggcattgaccatcctttcaggctggaatagcaacaaactacaaagacagaggcctattatgccaaacacttatgaaactgaattttatgtaatgggacagtttcctcatatttcagtgggtaatcatactaaactactttgctaagttgaatccaacaagttctgcttacaaaagatagctttcgaaaaaacaagtctttgtaatacctgtcagtttagacaggatatattgaataaaaatgtcacttaaaattttgttaatttaaaagaacattattttgataacaaaaaatttcagcattctctcaccacaccatatcttgagagcaatctcctatgccttctctattaaatgacagtgatgtattgaagaagtttgtgcatgtgtggaaggattttgtaaatttcaaagtgccacactgatgttggttatacttaggtatggtgggccttacacttttaggggcagtttctgctttgactaagcaactgggccactacttaccagctgccaaataattagagctgcagatatagcactgttgaaggaattttaatacttctcatcagcctcctcctcataatggccaagttaacacacactgcgtctttctgacttctttttacatgttgtgacttttccccttttcccttaaaactgattttcctcagttttaattttcatttcaagtcaactcaggtatataattaaaatttccttgaatcttgctcaccttcaggatgacttgcctgttattcagttactgatcctgaaagttttagaaattattaggtaaatatcacagtaaaatatttaaaagtttaggtcagaggaaacatatcgcacaaactatctgctattgtataactatttttatttaacatagtgggaggattctgacaagaatgttggtcaagtcagatgtctttatttttaataatgttttataatatgaaaaacaagtctttctagggacactatttttatttttattaacttttttattttttatttttttgaggcagggtctcactcccatttcccagactggagtgcagtggctccatcttgcctcactgcagcctcgacttcctgggttcaggtgattctcccacctcagcctcccaattagcgggactacaggcatgcgtcaccatgcctggctgatttttttgtattttttttttttttaaatagagacaaagttttgccatgttgtccagtctgctctcaaactcctgggctcaagatatccacctgggtttttctcccagagttctgggattataggggtgagccaccgtaccctgacgtatttttcttaactttaaattttgaaatgatttcagactcacagaaaagttgtaaaaatattacaggtaatttctgaatacacttcactcatatttaccacatttactttatctttctatctatatctgtatttactggaagcatttcagagtaagttgcaggcctagtggccctttactcctaaatatgtctgtacttcctaaaaacaagtaaattttcttatgtaactatagcaccataatcaaaatcaggatttggacattaacatattactgtcttccaatttagggactatattcaaatttccccagttgcctcattaatgccttttgtggtaaaagaaaaaaaaatctggttcagcatcctgcattgcatttagttgttgtatctctttattctctctcaatctggaataatccttagttttttggtcagttgtgatcttaacattttttaagagcataaaccatttattttataaaatgtcactcattttaggtttgcctcttttctcatgtactagattcagtctttgcattctgggcaggaatagaaatgacactgtccatctatgagcaccatgttggtagcacgaagtgcctctttatcccattattggtggtgttggctttgttaaggaggtatctctggcgtttctacactgtagactttctattttccttttgtccttaataaagtatcttatagggagatactttgagactctataaatagccagcatactttcactcactagctttagcatacttcctagtttgtatttagtgaggaataggctgaagatgacaatggcagtgtcagagtttattattataatttttagaatcatgaggtaggtaacaacacagtgccaaggagatttagttttccctaagcttattctgctaccgaaatgagatacattaagcactcagagatgaagcacaacctaatttacctcacagttgcatttgacaagcttggttatattttgggaaataaatttgaagcaacagatgagtaagagggagtggtaagaggtattagacacgatgctaatagtgacagcttggtggtgattaagaatacaaaactaaaaatagcaagtagatctataaaaagctagccgattgttaccatctagcgtaggtgtatggagctaaacatatttattctagtccatgagggtgattatggcatgagatgttataaggcacgattatgtcctataatatggcatttgataattttttgtacctgtttgaacaaaagattcatggtgagctagggatataaccaatacaaataaatttatcaacaactgttagactctgcagtgtggcactcccttgagaaatttgtctttgaggattcaggtattataacttggtagggcttactccttttttgtgagtgtgaatttttttttttttttttgggttcgggcttactcttgctcactaaatcccaagatttatatattcacatgctaatacgttaacaatgcaaaacagtgctgtctggtggatccctgatttgtgtgctttttagaaagagcacattgctgttgggtaggaaaaacatatgaagccaggttctcaaatatttgtgtggtaaggatggagtaacaataagggaattccattttgtattttgaatgtttttgaggcattgtttccaaaagtgtgttccatggacttggcaactcataaaggtactttgcaaaaggaggaggaagtgctgcgcaaggcccttctctaggagagtcacaggacatatgggcatcctaatgacaagagtctttcctaaacaatctgttgaactgagattaacccggtgtttcccaaatagaagtgacacagaaaccttttccccccacataatagccctcaaaacagatgcatattagcatcagacttctgtagttacatttttcttctaagtgggacaagatgaacttgttggtttaccagacaccaatttttgacttttttgtttttttatttttataaccttttgatcaagttaaccatcttttccctccctccctccctcccctccctccctccctccctcccctccctccctccctccctccctccctccctccctccctccctccttccttccttccttccttccttccttccttccttccttccttccttccttccttccttccttccttccgtccttccttccgtccttttgttcctttatataaccctgttctatcacttaagtattgagcttaacttgcagagagaaaccattgctaagcacttgggaatagggggatatttgtgattatttaagcaatgttgtgcttataagatttctggtaataacacagtctaaaggaaatgcttcatatcctgtggagtagctttggaatcctatgtatttagaaggatttctttcaaaaatgtttaaaattataagttttactttaaagaagttaatttcttttacctggaaaattgaagcaagttagactattttgtggacttatgcagtacttgtcaaaaggtaaatgttttttaaaatttctgttagtaaggattttacctttagcagcttgttattttagttatctgcttagttgcttctaatttgaattacttgtagctccctaatttagattgtaaaatgttatggctctgttatatgacttaagtttagaacacagtgggtccacttttggatcccattcaaagtggatctgatgtacttattttcctacacagttaaagatccctcttcaaaggtgaagcagagacacaataaatttggatcttgaaaccttcatagtaatatgctttttaaaagacatgtatacataattgtatagccattgcatatacttttatacatacatttctttcatatacattactgtcaggaagatcaggaagataatgtcatctctttagtgagataaattccaactccatcgtgaccacttaccatagatgtgactctgtatttgctgttcattcattcaatatgtatttatttgccttgtatatagtatgtacttatatgggcactggtcatagaaagaggaaactgaatggttcacttaacttttgaaattgtcttttcacctatcagggatgtgtgaatagtattgatgtaaagcacttggcacgtggtaggttcacctcttttttttttcctgagatggaatatcgctctgttgcccagactggagtacagtggtgcaatctcggctcactacagccttctcctgggttccagcaattctcatgcctcagcctcctgagtagctgggactacaggcatgtgccaccacacccggctaattgtttttatttttagtagagacagggtttcatcatgttgaccaggctggtctcaaactcctgacctgaagtgatttgcccgtcttggcctcccagagtgctgggattacaggcgtgaagcgccacacccatccaggttcacctcttgagtagagtgctgagatgctttctcacatgagattggtttctagtaataatagagggtttttttgctagttactttcttattgtatttatcttatagagtcttggttcttacaaaatcataatttgctttcaaaaatacatattttaaactacctaataagatctttatttagtgtcacatttacgaagggttgatgcttattttagtgatgatttgtcattaaaattatgtcaaaatgtcttaaaatgttgttgaaactgtaagcaaactcaacacgcacaaagctaattatgggtgccatctgtttatttttacaaagctttttttttaagactatggcattgtctgcttatgataagcttcaagattattataatgactaagtcctgtccttcaattagtgtagttgaagatgggaagataattcgtttgttcactgaccttttcctgtgtcagagtgtatgaaatatgacatgtcatgataaagaaactattgtgaagtgcatttagaagatacttaatttttatgagaaaaaaatgacatcaaagcagcagatgtggccaaagttttgtttaaattcttagaacttattcaaggttttagatgaacggtagacttttccagtgacttaagtggcttcattttaactcaaggttaagaatttctaagtgatcgaccaagtttatgttgacatgtatccctgtttgtgtacctatatgtcagcacatgtttttgtacatacatatctcatgtgttagtgcagaaggccaggtacatgcatgacagcatcagcccaagtagttatcagcaatctgctgagagagcagagcgatcgcactggctctgttttgcaattgtgcatgctaagcattacccaagtcagtgtggagggaaagcaacctgaaggatccatctgctcccttctgctacactgcctcgatgcaagattacactaatctggctgcttgtcaggacaggttagtgaaagcatgcaagtgggtgagacttagggtggactagtgctttggaaaatcataagctgcccctgtagatgccacgttaagtgcagcagaataggttgattatcggccacattgaagattgccgtgaaataaatatatagctttttggttaagaattagtttcaaaattaaaattcttaaatattgttggaccacagataaatcaaaattgagaaaaataatacagatagtttacaaatacttttaggccttagtttttcttatgatttgtgtattgtgtttattctttcattttattcccctagctcaagagttttttagtcaaatatgttcaaatgttacattcgattaacttcattttacccaaaaacttttgtgatttttcttgtttgtttctatttatttacccttttctacacctactgactggcagaccttggccttgcaggttgagcatcctgtcacagaatgcattactggcctggacctagtccaggaaatgatccgtgttgctaagggctaccctctcaggcacaaacaagctgatattcgcatcaacggctgggcagttgaatgtcgggtttatgctgaggtaaaatgaatggtgttgggaggaaggatggtggttatgtccagagtcatgagacctggtatagccaaacaatgaggtaaagttagggttttataatgttgccaactattggattacgtaatccataattaaatcagaaaaaaattagataattttgacctaattccagatagttttaaagaattgggcttagttaattgtcatgtatttgtagatggggaaatagctaccaatcctttaagaggcaacagagcattggttaaatactcttgagcttgaatggaccatggtttttgttttgtttgcattttctttgtttattttcaaacaacactaacaagaagtagcatttatttccatgggttttttaaaaaaatgcccaccttgggtacacattagttgttgatcagatatttacttaaaatttttcccaaccttttttttgtataattttctcctttattattacataaaaataacaatcaaaatttaaattgtaaagcttttagtaaaacatgtactcttaatttataattttaattttgggttttactcataaactctcagttcagtacttctaaatgctttttttcaaatgactaaaacaagaatgcaaggtaacatttgtactatttttacttttcgacatcaaaaatgtctgtcaagattaaaaataaatcagtgtctgtgtttaagaatactgagagctggtttgaaatatttttcaaggagttcaaaaatatgttttggcgtgactgtattgctcttgcttttttcatattttaagtagtattactttcattcttatgacactgaacctgtttattctgatgatctaagatatttacaaatgaagtgcatatctagtagcgtgcaaagttttttttttcaggtctttatttgaagaacccaaattctcaagttttaccatatgtgaactgttttgagaagtaagaaaaacaaatatctttagtataccacatttgttgttctaaacttgagtatgttttgatgtagggcctaggttattttattttttgcccaaggcattctaagaagttttataaaatgttggaattttaccaatttcaataaagtatgaacaaggtcaggctaaattctgcttacagttctgtttgatttttaagtacattctaagttgtctagcgtaaaagacaataatattctgaaatctgtgatttggtaaataccatatgttgaaaatagacctataaatggttcttcattgtgtaaatatttaaccttacttgtgctgatttatatttcaaagactgtgcttcctttcctttgaactttcaggacccctacaagtcttttggtttaccatctattgggagattgtctcagtaccaagaaccgttacatctacctggtgtaagtcattaagctgtaataccagctgaagggttaaaatcgtgatttatgtcatacttttatgttaaagcatgtcaacaccaaagggtgtaaattgaaggacaagtgaaattcatgggaatcatggtttttgtgttgaaaacaaatttttttcagtattttgtggtgttcaagaaagtcaggattcactggacaggggaagcctggggacatctgatgatataaatgatagcttacagtgttcccaattctttcgaaaattataataaaaaaggctgtgaatcctaagaatgagaaatgatgttttgtgttacaatttaatcttttcaataaatcgagtccaaccctgctatatagtcacttgtcaagaaattcaagcacaaaatcagctccttaattgaaatttaaggagattgaattaaggcaaacaaagtgtgcctcagtctattaaacctcatggactttaaagagtaataatatttatatcagttaaataaaagtgaccactgtccattttattccatagctcttctgtatttaatagctattttgaaaatagtttttgttgcagaaaaagagcaaggacataccctttttcttaatcaaggtaataagtgcatatatatatatatatatgacattatgttagctagtagatgacaaggctgtaccatctgtgaatattcaaattattcattttgattactggcatgaagatggtgaaagattacaggaagaattctaaatctgaagatattattggatatatgatttatttcactttttaaattgtttttgcccatgtgctttctaaagggacttgaccctttctgtgcttggagactccatgctgtgttcaaagccagaaggcagaaaaaaaattgtgaagatttaacaggcattatgtgacgttaaatagcacatgagaaaacaagtatcatagggacatatctaaacacttttttaatcaaacaaaagaagtattaaataagaattcataatgattactctagttgttagaagttttcaccatgttgtaatagctaacaggatgtcaaacattttgccctcgcaagtttttgcaatttgcaattttcaaacgtgagacctgttgaaagtacaagtgataatggacaaactataccccctacagtcttcatcccaccaaatctttcttcaattaatgctgcagcaggagttttatgtaataacatttgcagttgtgagccatccatagaaagaaaaaacaattaaaatgccttaaatgttctgcttactgctgttatttgcttgtgtgaatgttgcatgtcagctaaatggaccaaggagtagataaagtgattgggtgcaggagagtgcacactaagctttgtctatcattattgctgggagcaatcaaattgatgtcagcaggacagtagatgcgttgacagctgtaattatgtatctccatggtgatcacttttggcctgtcatggaggcccatgagtcccctcccttggaagcatttaatcagattgggctgtcacttgtcaggtagacatggcgggctgggagttgtgcttagggggagaggtgaattgagaatgaagggtgggagatgtctgatagtttcacagagtccactgtggtactgaagacagaaattttaattatgctagaggtttctgagcagtggtttgagaatctcgtacagaggtgcttgggtgttttgttgtggttgttattgtttgtttttcttccttgtcttattaaaactagagcagtcagtttaccttagaaaacaatttttggctcttaccttttttggtcacaagaatgcatacttaagagttaacttatggtttgtacttttcacatgcttcattaagcctgagatttattaatatggcagaggtgaagatttccttttttatttttgatcatcatgttttgtaaatttgttattttcagaccacagttttgttctgctcagaaatttggttctgatttcatttgaattttttcttaaagtttttagtgcaaatttgtatagcctttcattgaaggaatggagacttgatctgacttcagattggttgttaagaaataaaaatatagctgattattacttggaaaaagcagcataaatagtaaattataaagcagagttttcatactgtggtacagtttttaattgggaatactgatttgcttatacaaagatacgtgtttatatatatcttgattttatcgtatgtattttaaagttaagatgacataacttctgtgatcataatattagtaaataacaaagacagttatatttaattaagatctgtaggtaacaccttataggatgatattattcaaggcaactgaagttttaagtaaggaactgtagaagaacataataaatattctttattgtctatgttattttatttgtgggttgaacatctaagttcttcctagctttgtagcagtttatgtagcaaatgataggatgtagttaaagtcagaagttttagaacttgtatcagtctcgtttgtaaacacagcattagcaagcatgctgtggttttaaagatgacatagtggtcaaattagctctttcactttttagtactaaaattaagaaaatgaaaactcacagatatattttctgttatgtaacccgtttactagttgccattttggggctctttaatgtggggaaaaggtagattgtgattttattgcttttaaagctgctccattaatttttttctagtttttgtcaacactgtgaatttcatagaacatcagtttatgtcctgaaatatgttttcagaaaatagaaagccaagtatatttcgtaagtgtgctgaatgatttttgtttataattaagatttttgtatatgaatgtgaatacgaatacagatatctatatttttgtttgtgcttgcaaatacagaaataaaagcccttcaggtatgttatagtgttccttttacaaccttacaaagagaataatagtagtgtgaattttaagaaaatgaaactatcgcttgtcttctgatgtcaccgtataataaagccatcattataccctcatgtggatatcctagacaagaggttctacatgtggtcccttgataattgcctaaattaaaatattaaaggcctaacagccgctgtgttgacctttttctgccttgctgcagacagatgagctgctgtttattaggaaggcttcttcccacaggtggaaggctacgtgagcttccgctcttctcttcccacccctttacaatgttgggcatcaaagtcctgctgttccagcagctttgattcagttcctccatcctcaagacccctaggatgtgcctgacagtctgaagtattttgattagcttttaaatacttcagattccaaaacttctttctaataatttaataaatgttctgtcctcagtaactgctcatttttaaagttttgcatggctaacctccgtgccttgctgctggtatcaaactgggaaatgaaaacaagaatcagtgatgtactaactcactcgttggctggttaacagcaatcagcctcttcaaaagaatattttgaacttgtgctatccccctaccccccaccccaagaaaatcacaaaatcagaactctaattggggctttacaaagcaaagccataggaaaagctgtgtaaacatgaaagcctcaggggagcaacagtaacagaaaaatagtgttttacagttgagagggtgaggcagaaaaggaaagtgttacagacatgaaaggcccaggcccacattcctatggagctgaggaccaggcttgacgaggggcctcactggtgggctcagaagggtctggcagggagtgcagttagcaagggcatcgtccatgccatgcttcagctggaagacaccatcagagagccacagcatcctggcatagtgatgtaggaagtcttcattttttattttttatttttgctgttttttagtttcgtcattcagtggcagaacaaaaaatgtgttgcattacatattaacggatcaagattttagattgttttcctattttccagaagttgaaatgttatttgagattgaaattctctatccattttctccatggaaatgaaattggtggttacaaaaaaatatctacacaatatgaattacttttctttttttctttttttctcccaggtccgagtggacagtggcatccaaccaggaagtgatattagcatttattatgatcctatgatttcaaaagttagtttaatttctcaatggattatttgatttcttcgaaaaatcaatgatatttaaagagtctgaaactgggcctttatctgaatcataagctataattaaacaactaattatgcactgatgtaaatgtgaaagcagagcaggttttttctcttgagagaaaattcagcgttatgttagtttgtagtactcctcctccccaactaaatcatgccacaccatcacacacatgcatgaacaataataataataaacatctaaccagtggtgccagcctaactcattgccatgagaaggaattaaggttttttttggccattggcagaaattacctgagatggaagtatgaatgaatggcaagagttgggctgataggcagtgtttgttagagtactttttgatcttttctcttcagtttttacaaattaccaattatttaagtagatgtgatgtaagagtataagatttgttttgcccacctgtctttttgaagtttgactttccagaataaatgaattgaatttttggatctttaaacccttaaaaccgtataaagtgtaaaatgctgtaataattaagattgtggattttatttttattttattattatttttttgagatggagtctcgctctgtccgccagcctggagtgcagtggcacgatcttggctcactgcaacctccgcctcccaggttcaagcgattctcctgcctcagcctcctgagtagctgggtggctcgtgccaccaagcccagctaattttttttgtttttagtagagatggggtttcaccttgttagccaggatggtctccatctcctgacctcgtgatccgcccgcctcggcctcccaaagttctgggattacaggcgtgagccacaatggccggccagattgtggattttattttgaaaattctgtgttctctgaaatgatacatctgtattgaggaatgatttgtttttcaagccttgtttctcaagatggcttttccccaagtgtcctttttaatgttatagttgcagtaaacaaacacttttttatctgtctttcttcagttagggttttagtgcttttttttgggatagggtctccctttttcacccaggctggagtgcagtatcatgatcttggctcagtgcagccttgacctcccaggctcaagcgatccacctgccttagccacccaagtagctgggactacaggtgtgtactaccatgcagggctatttttttatatcttttgtagaaatggggcttcctcatgttacccaggctgatctcgaatacctgagctcaagcaatccacccgcctcggcctctcaaagtgctgggattacaaacgtgagccaccgtggttggcctaagttattagtagtattaaaataaaatttaggtcttttgtttattagagaaccaccatttaatttaaaaataaaactatgtaaaaatattatacgttgatttttaaatattccatttttagatgaatgtttttctcttcagaaaaatggcctacaaattaattttcaaatttgcttgatattgaagagctagtaaaacctactaaaataatcacaatctatagattggctaatataactgccagaaaaatctttaatgaatagttaaggtcttatttcattgccaaattatagagatacatataagtaggcactaaatcatgtagaatagtaagacttttctgtttttttgatttctgaaaaagtaccatttgcttctgtgtatattatatgtaaaactgcaaatgatttctaagatagtcgtcttctttctttatacttttatttttgaaactttactttttttgttagttatgaaagtgttaagggctggacgcagtggctcatatctgtaatcccagcactttgggaggctgaggtaggtggatcacctaaggtcaggagtgtgagaccagccaggccaacatggcaaaaccctgtctctactaaaaatacaaaaaaattagctgggcgtggtgacacacgcctgaaatcccagcttctcgagaggctgaggcgagaggatcgcttgaacctgtgaggcggaggttgcagtgagctgagattgcgccactgccctccagcctgggcaatagagcgagactccatctcaaaaataaaaaataaaaagaaaggaaagtgttagctattcagggtatcaaacttggaaaccacagaaaaatagggaaaaaatgtcttatctaatcctcaccactacccttggtgttcaaatcctatctcatatattcacgtttagctgtatctccttttaaattttttctgtacttacttttgttacgtttttgtttttgtaaaatcactctttactatgataatgaaatgtaggagaagagtctgaaatagcttgattctaatatttatatacttaaaaaatcataattgacatgtattgaaaactgaactatcataaaatttcgagatatatttagaaatctgttatgaaatattttaatttttactaaaatgaatcatttaacatagttctaaatatatatatatattgggttttttgtttgcttgtttttagctaatcacatatggctctgatagaactgaggcactgaagagaatggcagatgcactggataactatgttattcgaggtaaaaacaaagatttgcactcgttggttattgtatatggtgtccagttccagagaacagcctgggggtttaccaatgagaatatggcacagcacatttgctcactatgtgcttaaagagaaataagaaaaactcaaatccatcaaaccaccataccaagtatagccgtttccactgttttaagcaaatgcatattttctctatatgcctaacatatatattactctatataaccagtacacattggttacacaggccttcaggagggcgtcttttttcttacagaagtaatattgctgtggagaggtctttagtgcgtatttgggacacacgttcagtttatgtgagtttatctatgtttatctatatatgcgagtttagatagacataaataagttacttgggaagattattcctggaagacattaaagtatttgtaagcacattctatggggattttctccctttttatctctgcatttttattgtggtaattgaaatactagattttggttaatttaatttttactctaatgtgcttgagcagtaaatccatgaatttgagagtctgaataagaatattttgtcaaaactcatttctgttaaactgtgatataatacgacataggggcatggcatctgggcagtttgtcaaaatattagattagttttggtcccaactagaagttatttatctactccatctggcttctgaaaggagtactcttttgtatttacatgaataccatttcatgttttatacttaaatgaacattttcccactaatttgcttactctatatatgtatatataggttcaccagttactacagtttttaagtgactaaaatacaaagtaggcttgccattattctcctaactttatatgtgtcacatataaaaaataaattttgttgtataggtagatttttccaggcttagtctgaaattttgcctttgaattactgtgatgtagtagacagaaaccagacaaagctaggttcatagcccctgtcctgacgccatttaataattatgtgatttttggccaagcacggtggctcacacccgtaatcctagcactttgggaggctgaggcgggtggattgtgaggtcaggagttcaagaccagctgggcaaagatggtgaaacccagtctctactaaaaatacaaaaattagtcaggcgtggtggtgggcgtctgtaatccccgctacttgggaggctgaggcagaaaattgcttgaacccgggaggcttagtttgcagtgagccgagatcacgccactgcatgccagcctaggtgacagagtgagagtccgtctcaatgaaaaaaaaaatttttttttaaataaataattacgtgatttttgtcaaatgactttgtctctctgaatctcatactccacatttgaaaaatggagtgatagtctctgccttataaattactggtgaggattaactgaggttaagtatataaagggcttggcaccacactggcttatgttgttcaataactttagttgtcatcctttcttcctctttcctcacacttaataaaaccatatatttaagaatcaaggccaggcgtggtggctcacgcctgtaatcccagcactttgggaggctgaggagggcagatcacttgaggtcaggagctcaagaccagcctggccaacttggcagaaccccgtctctagtaaaaatacaaaaattagccaggcgtggtggtgggtgcccatagtcccagctactcaggaggctgaggcaggagaatcgcttgaacccaggaggtggaggttgcagtgagatgagatcgcgccatcacactccagcctgggtgacagtgtaagactctgtctccaaaaaaataaaaataaaagccatgtgttataaatcacattatcaatccattagtcatatgaaatttactaaatcatagataaacaatattgaaagaccgttttatgtaatttctaatactgtgtgcggaggttatatgctttcattgcaccctgttcaaatacttctccagagaatttaccgtcactgtaaaattaaagtattaattgtgtaattaactgtgaaatgttgggttatcctataagattattaggcacatgaggacactgatgatctttatcttgtttgtatgcatattgctggtgcttagcagtgtctgacacatgctagatgattaataaatgtttgttggatgaatgaatgagtgagcaagtgatactatccctgatttcaaggagttactaatatacttggtgtgaaaacatatgaaaagataagtataatattaatatagctttgtaggtgccccaataggggattgaaaaagggtagtgggagtttaaggaagaggctagcatatctttcttttctcgcctctcttggtcctttgaaagtaactagtactgctttaggactcatagtgtctctgtgtctctgtcgagagtacctcactttgttctgctttcaaatgatcctcagagtggcaggatttttaaaaagactggtaatgtcctgtgtaggtgaaataaaggggatgggcacgctcaagcgtctttgcagtatcacttgttatagtattttgggaaaataatctggtgttagatgttaaaataaaagtgcataccctctgacccagctattcatcttttgtgaatctttcctatagagttaaaaaactgaattatgagcatgttcaccatgacatttacaacaacattgtttgtagtagccaaaatgctgaccaaccacagtgtccgctaaatggatgaatgactgaataaattacaatgcattattactataaaatactatgcagctgtgacttaaagacctgtttgtatgaatcgttaaagtagaaaagcaatttgtagtcatgtgtagtacattctcatatcacttgaaccatcttctcatcctaaaatattttaaattgtgttggatgagcacagagaaaggtgtggacatctacatatcacaataatttttttaagctcaaaggatttatgagagaggggtttttcttgacacatttctcttagactttttaattttaggtattttcaaatctatagaaaagatgaatgaatagtactgtgcatgcctgtgtactcttcacctagattattatttaataaacttttttttgatatttgctttctctatttctccctttctttgccttttcctcttcctttctcacccttcctctttcctttcctccctccattctcttctctgtttttctcctgatccatttgaaagaaggttgcaaacatcatggcgcatcactcctgaatactttaccaggcttcttaaggggaagaccatgttcctgtaactggatttttcttgcctgctgcacagatagagtctatttattgagacagcgttattgcaatagagaaagagtttaataaacacagggctggctaaatgggagactgaagttttattactcaaataaatttctcccaaaatttggaggctagggtttttaaagaataatttggtgggcagggggccagggagtgaggaatgctgactggttggtttggggatgaaattataggtgcttgaggcagggtcttcttgctaccttcagttactgggtaagatcacagaactagttgagccagtttgctggtctggctgcatgactcctgagccttaatttctaatgttagttttacaaatgcagtctgttccccagacaaggagggggtttgttttgggaaggggctgttttcattgttttacagttaaagtataaattaaattcctcttatagttagcatggcctacacccaggaatgaacaggggcagcttggaggttaaaagcaagataaagttggttaggtcggatttttctcagtgtcataatttttgcagtggccatttcattcctgcaaaaaagcacaataccatcattacacccaaggaaaattgacagcaacctaacagtttcatctcatgtattgtccatatttaagcttgtccctcggagtctttttttattgttttttaatcccatctgtggcccaaagttacacagtgtctttgattatgtctctttattatcttgccgtctttcatatttcatttcattaattttcaggagagtccacggtagttgatttgtagaatgtggcacattctagatagaaagtgttaacgttggttcactaaaggcacttgtgaagtgattccaagaatgagggttgtaggtgataatttgcactatcactcacagaactcgcagaaactctttgcttactattatcagtttattataaagggtacagcttgagagtaacccagtggaggagatgcacagggcaaggtgttaggaaggggtgcagagcatccatgccctctccaggtgcaccaccctccatcacttccgtgtgttcagcaacccacaagtcctctgatccttgtccttgggtttttatgaaggcctgactaggtaggcatgattgatcctatcaatctgccattagtgattaagtcattcttcagtccctctcccctttggagggtgggggtggggctgaaagttccaaccccttaatcacatggttggatcctctggccacctgctcccatcctctaagagtcatctcattagcataaactcaggtatgattgaaaggagcttgttatgaataacagaagacattcctctctcaacagtcatttctatgatattcttgccaaaaatgtacaacctgagtataatcatgaggaaacatcagacaaaccaaattgaaagacagtctacaaaataaatggcttcttctcttcaaacatgtcaaggtcaggaaacacaaagaagagttgagcaacttatgtagatcaaaggaaactaaagacacatgacaactaaatgcaatgtgtgatcctggtttagatcctggaccagaagaaaaatgtttttcttttgtagtaagggtcataagtgggacaattggtgagatttgaataaggtctggagatgaggtgatagcaatgttagcagtgttaggcttgtctgattttgatccttgtactgtgattatagaagagatataccttgcttttaggagatgtacactgacatatttagaagtaaaatgacatcttgtctgcaacttaccttcatatgtttaagaaggaaaattatgtatctgtgtataaatagaaaaaattagtgacaaagcaaataaatgtgataagatgttatcatttgtagaacctccatatatagtaattctgcttactatttttttgaaatttttttaaattttgaattttgaaattatttcaaaataattttgaatttttttattttgaaataatttcaaaatttaaaaaatttaaaatttaatttcaaaataaaaagttaaaaaaatagggaagagcaagaacccccactctccactaatatttaaagaataaaagcagagatgcatttgggattttgaacttacatattactcatctggctaattctgaaggataggcaggtttaaaaacttgctttatgaaaggcagaaaagggaagacaatctactgtcttgtttggtaactgcttaattattcaaatatgaatatttttttcctgtgctgattgtgaacttttgttaagatagagaaactttgaagcaaaaatgtaattcggttaaaatgaatttcaaaatcctcatgaaataagagtgcttttggcctctgtttgatcctggcagcatgtctagctgatgtctgggcagtgttttggaaccagcaggcagtcaggggaaggccactcctaggggcctcttctctgtggcctggtggtgatttcccatacagatgggacctggtgaactctgccagaggtcatccttgactcccagtccacacctcccagtcataatttttatgagtatgtgattaataatatccttgaagttgtaaactaactctcaaagaatacctctactgtccccataccatttaaacaaggatctgttcaaatagtgttgtctttcctgggatgtgaaaagaaagaaactaaatgcaaaatggtaactttcaaatctgtatgatactgtttagtgcttcagtgattcttcccatctagctgatcttttgagctcttaggtataaaatacttttctgattattaccctcttttggctttaggattaattaatggacagtagtttcgggaacagttagtcgaggcatagatgtttgttgtctgccatgagccattatctcaccatattggccttaggaaagaaaaagagataacgatttagttttgcatagtcatatataatattttatttagaaaacattaaagagaaaatggttttgtgttttaattttgtttttaaaatatcatttagtgagataaaagtctgtgtttttatgctgtatttactattcaagtagaaagatttttaaaattccatgcttcatttacgtgcttgatggctctgttctttgatatccaaaatgtaaattaatatttgctttcaattcctttgagttagatttttctaaaattaacacctatttttcagctttggatatagaggacaaatacaacatatgatttatcctgtgaaactgcaagcatgttaactttctgaatattatcagtcacaaattttgggcatcagaaaataatctctttttttgttcaaattgtcattaactatttctgaaaactatattgtattttactgatgacagagtttggttccacctattttaacattggccacacagggagctaaaaaatttataccagcagtaggctataaacatgaaagccagtaaagttaaatatgaaatattaaatatatatgttaatagtattctttttttttttggagatggagtctcactctgtcacccaggctggagtgtagtggcatgatctcggctcattgcagcctctgcctcccaggttcaagcaattctcctgcctcagcctcctgagtagctgggactacaggggtgcgccaccacacctagctaatttttgtatttttagtagagacggggtttcaccatgttggtcaggctggtctcaactcctgacctcaggtgacccgcctgcctcggcctcccaaaatgaacaatactatttctgtttaaccagggcagggaagttcaaaaatcctgagactgcctgctaacttacttactgttttgcaaaaacacttgtaaattgaaatattctgaattatttatttgtacataagatcaatatttttggtaaaataaattgttgatgtaccttggtctaatacctttcatcccttccagtccctcccttagagtcttattttttccagaactttatttatttattgtaatatatgagcgatttgcatattgctggttttatttcacgtttctctgtctcaccctgttttggattccttcacatatgggagatgttcccccataagtaggaacgtctgttttctgatgtataccatcgaatctgcctgcttttctgaaccttaatcattcagacatcatctcacaggcatctcaaatttaacttgtccatgaatctgctattttcctctcaacctgtttcttctctgcaaatggcaacttctctcatgttgcagagccagaactttgggtgttgtgctcatctccccattctttgtaattgtggttgttgttttgagacagggtctcactctgtcacttaggctggagtgcagtgatgggcccagggctcattgcagtcttaacctccagggttcagctgatcctcccacctcaacctccctggtagctgggactacaggcacaagccagcacacccagctaattttttgtatttattgtagagatgggattttgccatgttgcctagactggtcttgaactcctgacctcaagtgacccacccacctcggtttcccaaaatgttgcaataacaggcatgagccactgcacctggccctcatctccccattcttgccatcagtccctgcctgcctcctgaatatccgtcaagtccagctgcttctcccatctgtattgtcagtgtcctagctgtggaccccagccttgccatttttcagcatatctccgcaattgtcccctaaggaatttttccatcttccctcttgcccttcctcagtcccttttccgtatagcagcctaagtgattctggattgcataaatctagtcatacctgccctgcttcccattctagttgctctcatgggaatgtggaatctgtgcatggcctatcacacgctgaatgcctattggccttttcactgcacccagcaccgttctctcctttgctcatactcagaccatggtgttttcctttcattcctctccataggaatacctggtggtaatcatttgctttttgcaacagtgaaatctctctctgtctctgtctctctctctcttttaattatactttaagttctaacaacgtgcaggtttgttacgtaggtattcatgtgccatgttggtgtgctgcacccattaactcgtcatttacattaggtatatctcctaatgctatccctcccccctccccccaccccatgacaggccctggtgtgtgatgttccccttcctgtgtccaagtgttctcattgttcagttcccacctatgagtgagaacatgcggtgtttggttttttgtccttgggatagtttactgagaatgatggtttccagcttcatccatgtccctacaaaggacatgaactcatcattttttacggctgcatagtattccatggtgtatatgtgccacattttcttaatccagtctatcattgatggacatttgggttggttccaagtctttgctattgtgaatagtgctgcaataaacataacgtgtgcatgtgtctttatagcagcatgatttataatcctttgggtatatatacccagtaatgagatggctgagtcaaatggtatttctagttctagatccttgaagaattgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttggtttgcatttctctgatggccagtgatgatgagcattttttcatttgtctgttggctgcataaatgtcttcttttgagaagtgtctgttcatgtccttcgcccactttttgatggggttgtttgtttttttcttgtaaatttgtttgagttctttgtagattctggatattagccctttgtcaggtgagtagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgtctatgtcctgaatggtattgcctaggttttcttctagggtttttatggttttaggcctaacatataagtctttaatccatcttgaatgaatttttgtataaggtgtaaggaagggatccagtttcagctttctgcatatggctagccagttttcccagcaccatttattaaatagggaatcctttccccatttcttgtttttgtcaggtttgtcaaagatcagatagttgtagatgtgtggtgttatttctgagggctctgttctgttccattggtccatatgtctgttttggtaccagtaccatgctgctttggttactgtagccttgtagtatagtttgaagtcaggtagcatgatgcctccaggtttgttcttttggcttaggattgtcttggcaatgtgggctcttttttggttccatatgaactttaaagatccaattctgtgaagaaagtcattggtagcttgatggggatggcattgaatctataaattaccttgggcagtatggccattttcacgatattagttcttcctatccatgagcatggaatgttcttccatttgtttgtgtcttttattttgttgagcagtgttttgtagttctgtttgaagagatccttcacatcccttgtaagttggattcctaggtattttattctctttgaagcaattgtgaatgggagttgactcatgatttggctctctgtttgtctgttattggtgtataagaatgcttgtgatttttgcacattgattttgtatcctgagactgctgaaattgcttatcagcttaaggagattttgggctgagatgatagggttttctagatatacaatcatgtcatctgcaaacagggacaatttgacttcctcttttcctaattgaataccctttatttctttctcctgcctgattgccctggccagaacttccaacactatgttgaataggagtggtgagagaggccatccctgtcttgtgccagttttcaaagggaatgcttccagtttttgcccattcagtatgatattggctgtgggtttgtcataaatagctcttattattttgagatacgtcccatcaataccaaatttattgagagtttttagcctgaagggctgttgaattttgtcaaaggccttttctgcatctattgagataatcatgtggtttttgtctttggttctgtttatatgctggattacatttattgatttgcatatgttgaaccagccttgcatcccagggatgaagcccacttgatcatggtggataagctttttgatgtgctgctggatttggtttgccagtattttattgaggatttttgcatcgatgttcatgaggaatattttagggcctctctgtattgcctaggctggagtgcagtggcacaattatagctcactgcagccttgaattcctggattcaagtgatctccctgcctctgactcctgagtagctgggactacagatgtgccaccctacgcggctaatttttaaattttttgtagagatagggtctttgttgtccaggctggtcacaaactcctggcctcaagcagtcctcctccctcagcctcccaaagggctgggattacaggtgtgagctaaattcctccctaatgttaccatagccttagctacttatctttgggtccttctcatctttctgttttccttcccagccaggaaaatctgtgtaagtctcaaatactttcctcttcccggaacaccaaagctgtcatttcctatgcaggtgaacctttctggcaagtgatacctcttttctttttcaaaagcactctagtttgtctctttgtgaaacatgatcaagggattaatttcccatgttttatttagcctgatctctttcaaggagctttttacatttttgcctacctaattgatctttctaagcatcctagcatattgccttcagttgcttttcactttcatctaaacaaaagcaacgccacattttttcaatgatttcttaggtatattgatgtcattagaaatttcatctgccttctactatgtttctcattaaaaaaacttattaaagccctctgaaacatagttattatgtatgggccaagtaaatcattacccacagaacaagcatgaaatagctgtgtagatctcatgggcatgcgctatagaagatctgtgtgtgtgtgtgtgtgtgtgtgtgtgtgtgtgtgtgtgtgtgtacataaagcaatctataatatatatatatgtatatagtgaagaatatgatcgattctgatatatataactttttccatggaatttttgtgtagctaaaggaatagcattaatttgaatttgtgaatgttttctaaacgtcttgaggcagttttgataaattgagaattggcctttataaaatttagatacatagcatctcttgagtcaggaacagaaatgctcaggattttccatatggttgtggatatggtctagtataaaaggatgcataggaaaatgcctgggagggtatacatgttaagctgttatcattggctagcttagagatggaaagtcatattgaaaaggtgtgccctgctcgctcaaacacatgcactagggtacagggtaacctgctgtaacaaagatttctaaatacagtgggataaataagagagacgtttatttacctctcatgtaactgtctggtccatgctgctaggaggcaagtcagcctcatgaggtcattcaaagatacacacacccatcctgatgtgccactccgtttgaattgccaaagctgagtttctgccatgtcaggaaacccacagtaagacgagaagaaaggaagctcaagcaagcaatgagagagtcggaagttgcgtacatcactttagcttaccttcctttgtctaggaattagtttgtcatgcctacctacaagctagatgggaaagtggagtctgtgtctgggtgtcttttgctcagctaaaattctattactatggaaaaatgaaaagcaggttttaggagaaactagcagtctgtcacaataaactgtgtcttaaaaattgtttatatataattatatatatgtaactattgtgatatataatgtgctaatcattaggtaaactattcagtctctctggattgcaattttcttttttttaattttttttttttcttttagagatagggtctctctctgtcacccagatttgggtacagtgatgcagccgtagctcactacaacttcgaactcctgggctcaagtgatcttcctgcctcagcctcccaagtacctgggactataggcacatgccaccattcccagctaattttctgtttttattttttgtagagacagggtcttgctacattgcccaggctgatcttgaactcctggtctcaagtcatctcccaccttgacttcccaaagtgctggaattaaaggtgtgagccactgcacccagcacaattttctcatttgtaaggtcccatttttctctgtagtttacttattctataactagttgcgcagtttcccaagagcaggtaccatattgtgtgctctcattttccttcccatgatatctaatggctgcatgagtaatagtgtagaatacatgttgatgcatatagataggtttgctcagattaaagggctagatagtaaatgttttagactttgtgggacacaaggtttctgttacaactgcttgactctgctgttacaacatgaaaacagtcatatgtaagcaaaccaggctggctgtgttctaataaaactttttttacaaaaataggtaggaggctagatttggccttcaggccatattttgccaaccattgtcttgtaggaaagttacactttccaaatagatacaggtgtaaactcagatttcaggagctccattctttttttttttgttgtttttttgagacagagtctcactctgtcacccaggctggagtacaatggtgcggtctcggctcactacaaccttcacctcccggcttcaagcgggaggcctcagcctcaagagtagctgggattacaggcgcctgccaccacgcctggctaattattgtatttttagtagagacggggtttcaccatgttggccaggctggtctcgaattgctgaccttgtgatcctcctgcctcggcctcccaaagtgctgggattacaggtgtgagccactgtgcctggccaggagctccattcttaacagaaaacagaactagaagttaggtaggtcagtgctgaagcttaggatgcaggaaaacttctgtctgatgttttattaattacattttgtctcatgctctttgtatattcccatataacaggatagtaatgttcttttttgagagcccagcattgcattaagcattatatcatttatacctgataacaatcatgcataataggttctattattgttaatttacaaatgaggaaactaaagctttgagaggttaactaacttacctaaggtaagggatagacctggtatttgaacttgactatctgattctttgcttactttatggttattgttgcaaaagtggggattctgtgagacttgaatagtaaaatcagaatcatacttcgtaggtttcttatgcagcatgatggtacagattagaaccatacaagagtggactaaagtaataggaaggaatgaacaaacctctgtttactttgacttcagctgtcatgctgcagtcacctgctcttcttgtggaagcctgatgtaatttctgccttccctggatgtaacatgcttcctcccacttgctttcattcctgtgtaacatctttgtaatctggatgaccaagattagatacttcattcttcacaaaaccttcctgcatcctagaactctcccaatactattagtatcctcttgtggcagttacctattttgatattacagttgacctttgaacaacactggtttgaactgtgcaggtccatttatcttggattttttttcaataaatatatcctaaaattatttgaagatttgtgacaatttgaaaaagctttcagacaaactctatagcctcgaagtaccaaagaaagaaaaaggtatgtcatgaatacataaaatatatagagatactagtctgtttcatcatttgctattataaaatttacacaaatctattataaaagttaacatttatcaaaacttacacaaacagagaccatacctggtgccattcaaagcagagagaaatgtacacaaacagtaaagacgcagcatgaaatcataaccacattaagattcactgtagtacatactgtactactgtatagtttcatagccacctactgttgctattgcagtgagttcaagtgttgcgagtatctgcttaaaacaccatgtgatgctgatcaccgctgtgtgatcagttctctctccagtaaattgcatatggcagtaaaaagtcattgcttatggttctggaatatttttcatcatgtttagtgcaaaccataaactttgaataacaggacagaatccatacaaagtgctactagtaatgctggaggtcctcccaagaagcagagaaaagtcatgacattacgagaaaaagttgaattacttgataatatatggtagattgaggtctgcagatgtagtttcctgtcatttcaagataaatgaatcccatgtaaggaccattgtaaaaaaaaataaaatgaaatttatgaagcatttgctgcagctacaccagcaggtgtgaaaatcttgcacttttttgtgaaacacctttcatttcatattgaagatgcagcttttatgtgggtacaggattactataagaaaggcattcccatagactcgaatatgactgtctatgggaaaagtgaagttgttatatgacaacttaaagcaaaaggaaggtggaaggatataaagctggagaatgtattgccaaccaaggatggtttgataattttagaaagagatttggctttaaaatgtgaagacaaaatgtgaaggggaagctgtttctgccaactaagaggcagcattaagacaccattaagaaaatcattgaagagaaaggatatctgctgaacaggtttttaatgcagacgcaagtgccttattctgagggggaaaaaaaagccacaaggaacatttcttagtagggaaaagaagcaagcatgaggagttaagacagggaggaataggctaactctgtctgttgttctgtgcaaatgcaatcaggtttatgatctgcacttatctgtgaagctgctcatctcctagccttgaaggaaaatgataagcaccggctgccagtcttctggttgtacaacaagaaggcttggacaatgagaaccctttttctggattgactccattgatgctttgtccctaaagtctggaagtactttgccagtaaggggctgtcttctaaagttcttttgatatggacagagccccagccacccagaacacatgtgtttaacatcgaaggtgtcgaagtggcctgcttctccccaaacccaacaagtctaattcagtctctagctcagagtactgtaaggtcctttcaggctcattatacacagagctgtatggaaacgatcgttgacactgtggaagagaaaaagtctggaaagattacaccactgaagatgcattgttgtcatataaaaagctgtgaaagccatcaagcccaaaatttgtgctggagaaaactttgtctggatgttgtgcatgacttcacaggatttatgaaagaggcaaccaaggaaatcatgaaagagattgtggatttgacataaaaggtggagtgggggttgaagggttttaaggtacggatcttagaggaatccaagagcggatagacaccacacccgaggaattaacagaggatgacttgatgtagataaatgcttctgaattggtgccagaggatgaagaagaagacatagaagaagcagtgccagaaaacaggatcacatcagacaatgcggcagaaggattctgattattcaagactgctattgacttattttacgacatggacccttctgtgatactggcagtaaaactaaaacagtggaagaaggattgaaatcatatagaaacatttttagagaaatgaaaaagcaaaaaaggcagacaaaaattacaaagtatattcataaagttatacagagtgtgccgcctctcctgcctccccttccacctcctccacctctcctgcctctgcaacccctgagacagcaagaccagcccctcctcttcctccttctcctcagtctactcaacctgaagaggaggaggaagactgttatgatgatccacttccacttgatgaatagtaaatgtattttctcttatgatttgcttcataacattttctttagctttattgcaagactgcagtatttaatatatataatatataaaacttgtaattgactatgttttcagcaagggtttcagtcaacagtatgttattagtatttacttttttgtagcatcaaaagttatatatggatttctgtctgtgcaggaggcacccctaatcctcatgttattcagtcatcacctgtgctttgaaattgtcattgtgtactaggctcaatttttttctactagattacatgcatctttaaaaaaatgacttattgaggtatacttgacataataaatttctgatatttaaagtattcaatttcatgagttttgacatacgtatacacctgtgaaaccattaccacagccatggtgttgaacacttctttcacctctggaagtttccttatggtctttgacatttaccctccctctacccctttcccagtgtaaccacatgatctgctttctgtcactgtaggctcgtttgcatgtcctaaaattttatattaatggaattatacattattatgcattatttttggtcttgcttttttaactcagcataattatttttaggtttatccttgttatttaatgtgttattgactctgtgtgtgtatgtggaatagaattccattgtatggacaagcccagttttgttaattcatttgcctcttaatggagatttaaattgtttccaggttttgattatagtaaataaagctgctattaacctttgtatgtaagtctttgtatagacatatgtttttatttaacttgacttaatacgtaggagtgagttgtctgaatcagtgaatatatgtttaacttttccagaaactgccaaactgttccaaagtgtgtgtatcattttatattgccaccacagtgtgacaattcttgttccatatcctgactagcacttgctattatctgtcttttcactttggccatgtaaatcggtatattgacggcatctcattgtgtttctttaacaataatgatgttgaacaatttttcctatgcttagtggacattttgactgtgtttttttacttggtgtgttttttgtcttataattgtgttgtaagtgttctttatatgttggtagatacaactcccttgttcaatatatgtattgtgggccagacacggtggcttatgcctataatcctagtactttgggaggccaaggtgggtggatcacttgagcccaggagttcgagaccagcctgggcaacagcaaaaacgtgtctctacaaaaaatataaaaattagctgggtggccgggtgcagtggctcacgcctgtaatcctagcacttcgggaggccgaggcgggcagatcacgaggtcaggagatcgagaccaacctggccaacatgatgaaaccccgtctctagtaaaaatacaaaaattagctgggtgtggtggcgtgttcctgtaatcccagctacttaggagactgaggcaggagaatcgcttgaacctaggagacagaggttgcagtgagccgaggttgcaccactgcactctgacctgggcgatagagtgagaccctgtctcaaaaaatatataataataataataataataataataataataatgatgataataataatatattttatgtgaatatcttctctcaggctgtagtttgttattttattttcttagttgcctcttttgaggagcagacttaaattttgatgaagtacagtttgtcaatatttttatagttcatggtttctatgtactaagaatccgttgcctaccttaaggtaacagattttttcctccatattttctactgtagttatgaaaataggtttgtgattcatttggagttaattttttgtctatgttgttaggtgttagcgttgaggttaattttttttttttttttttttttgagatgttgtctagctccgtcgctgaggtgggagtgcagtggtgtgatcttggctcactgcaacctccacctcccaggttcaagcgattctcctgcctcagcctcccaagtagcggggattacaggtgcctgccaccacgcccagctaatttttgtatttttagtagagatggggtttcactgtgttggccaggctggtctcgaactccttacctcatgatctgcctgcctcggcctcccaaagtgctggaattacaagtgtgagccaccgcgcctggacttttttttttttttttttggtccaaatggttagctgtttgttctagtaccatttattgaaacgacatttattaggttggtgtaaacataattgcggtttttgcattgctgaaatttgctgtttgatattggaatacattcttaaataaatatggttatgttatacatcattttaatgtacatttctcgctttgtttttttgctaatgacttactactggctgtttaatttatatttagagtatggaaatgatgttagacaaaaagcaaatctgagcaattttcttatttgagtttaaaatgggatgtaaagcagcagagacaacttgcaacatcagcagcgcgtttggcccaggaactgctaatgaacgtaccgtgcagtgatggttcaagaagttttgcaaaggagatgagaaccttgaggatgaggagcttagtggccggccttcagaagttgataacaaccaattgagagcagtcatcgaagctgatccttttaaagctacatgagaagttgctgaagaactcagcgtcaaccattctacagtcgtttggcatttgaagcaaattggaaggatgaaaaagctccatgagtgggtgcctcatgagctgactgaaaataaaaaatattatcattttgaagtgttgtcttttcctgttctacaagacaatgaaccatttcttggattgtgatgtgtgatgaaaagtggattttatatgacaaccagcgatgatcagctcaatggctggaccaagaagaagctccaaagcacttcccaaagccaaacttgcaccaaaaaaaggtcatggtcactgtttagtggtctgttgctggtctgatccactacaggtttctgaatcctggtgaaaccattacatctgagaagtatgctcagcaaatcgatgggatacaccaaaaactgcaatgcttgcagctggcgttggtcaacgagaaatgtccaatttttctccataacaacacccaactgcacgtcacataaccaatgcttaaaatttgaatgagttgggctatgaagttttgcctcatccggcatattcacctgacctctcgccaaccaaccaccacttcaagcatctcaacaactttttgcggggaaaacacttccacaaccagcaggatgcaaaaaatgctctccaagagttcgtcaaatcccgaagcatggatttttatgctacaggaataaacaaacttatttctcattgagaaaaaggagctgatgtaatggtccctattttgattaataaagatgtgtttgagcctagttttaatgatttaaaattcacggcccaaaaccacaattacttttgcaccaccctaatacagcccgttgacttgacttggcaataccaagcttcttaaatttatatttagtgttttattgataccacaagttcagatattttttgttgttaatagaattcaaggaaataagtaatcttgaatggtttctgctaggtcatagaacagtgatgataaatttctccagattatcagaattcaatttttcactgattcattgttcttcaatttgatatcattttacttttaggtgttacacataatattgcattacttcgagaggtgataatcaactcacgctttgtaaaaggagacatcagcactaaatttctctccgatgtgtatcctgatggcttcaaaggtttgtatgcattaaaatattttagtgttttaaagttgttatttttatactttattgtaatacataatttcactctattttgaaattaaggccttttggcttatattatacttcatttttagaacatgcaagactgtttacattcatgattttgagtatttatggatgactcatgagtgtgataatctgcagtcttgtggagtgcagaattcaaccatgtgaattgttctatgagtccagtgttttggagcaaaacatgtagatagatcattagcctacctgacttcctggtttctgaaaatcaaatcagatttgtattttctactgaggtgagtatataaggaactcttctaaagtgatttttaagagatatattaatgaaaatagcactgaaaatttcagaaaaccagattctggtcctattaatgaaaatctaggaagatgatgattttattctgaaaaatgaagttttcaataaagtaatgagtggaatgtgaaatttaacacagcaaagttatcagcaagcatttccaggtagtagaaaaattgctcatcaaatgggagatagagaaaaccctttagtgagcattcaaaacatagttaacataagatattgagagataaacaagatttagactgagacttaatagaaatgttactcaggtgaaagcctctacctacatttttaatgagctagtgaggtatgaaggttagatagtctgtcccatatttcaagtgttctttgtatccattaaagtgttttaatgtaaaatgactcacattcatattaggagctatatatagattcaggtcaagttgatgtcgttgagttgttgggtgcatttataaagcagttttcagttcagaatttacaatacagagttttcataagactcaacagagataactgatttgaatattgttttaaaactttagtgttatagagttttatcattagtattaaggcaaatgaagaatggctctaagttgggatcttaaaacaaaaactaatgatttattaggttgtttttcataaacttttgaatttttaaaaatacaaaataaaatacaactaggatagtagttttatacttttgtgactattcttttaatatttgttggtttaatgaggctaagaaccccttacgtcattgcttttcattttatccctagcacaaaacatagtaggtactaagtatttgttgaattaatgaaaaaaaaaaaatcttagccataatattgatgagaaaggattactttggatttttttttttttttttttttttgagacagagttttgctcttttgcccaggctggagtgtagtggcacagtcttggcttactgcaactctgccttccggtttcaagcgattctcctgccgcagcgtcccaagtagttgggattacaggcatgtgccactacccccagctaatttttatatttttagtagaaacggggtttcaccatgttggccaggcttgaactcgaactcttgacctcgtgatctgcccgcctcggcctcccaaagcgctgggattacaggcgtgagctaccgtacctggccgctactttggatatttttaatcatttatacatgtatccagataaccagttcattctattttgatcctaacatttagtttcttgtccttcctaaaattttaattaaaagttgtagtacgttttgaagtggacttaggacttccatgtttttatgtctgcctggcaattcagtgatggtgataagataggaaacagtgggcagaaggagaaaacagggaaaaactacagagaacctttagaacaaacattatatgcatgtatgggtatttatatatatatacacacacacaaatacacatttatatataagtttgtctatatgtatgtatggtgaagtatcccagagaagaagaaaatggggcatttaaattttctaatcagagttgattagtatgtgctggacgtttagcaacaatagagaatatcccaaattctgtagagaagggatccccttcaaactcagaaatgtacttaaacctagatattgcagttttctgtgatgcatataatatattacatttctttttttgtaaggaattaacagcttggacaccacaattttgttttttatgcttagaccaatttttaaaattggcatacattgcttttagcaattatttagttgcagccttcattttacatgtgaggaaactagagctcagagatatcagtaaagctaaatgaccagtaagataataatgccaggaattgaacctaggcttattcaactcctatttgagtagtctttgagttatgctggggttcaaattcataaatcacaaatgttttcaatcagggtatgctacatgttgttatattgcctctaaatactttagaaacacactcctatatttgccattcttaatgtctccctcttgttttattttcttattttcatatcagttcattcttctttgagtggttactgtctgtcattcttcttcagattgctgtattttccccctaaatcaggtcttagatattttaaactgtatcgtcttttgactgtttgatatatgtgcccaagagactgaaggaagtggtaactacagttaatccaggatcctctccatatgtttggggccaggtcattttgcccctttggggtttcccatctgcttcccatctgttcagctatcctaggcactattcacaggcaagcacctatttttatgactgcattaaaattttctattgtatatgtttattatcccacatttatttgtatgtagactaagccagttttactagagattcttagagttaaactttgaaatgattgcttctaaaattaaaaaataggatacatgagaaattattcttgtcatctctttagatgtggatgttgaaaagcggtttcccttgattctgaaaaataaatggaacatgaggaagaagatattttaagaactataatttcatttggcctataatgaacattttgggcttatttctctgataccttcctatacttcaaccccaagccccatcgaaagaaattgtcagaattatctcattcttttaagaagttacagatcttctggtaaaaatttcactcaacacaaaaagtatataattaattatacttctcttttttccactgaatttagtcaagtatatctacactttaaaaaatactactatgatatttggactgaattcaatcattaaagtcattcaacaaataattgatataggctctagaagaaaatcaaagatgggtatattttacctgctcttagtgagctgacatcatgagagaaataataatgtaaagtacccactatactacaggacaggataaagtaagtgcctggtaaagatgtaagcaaagtatcttgacagaagagaaacaaaacaaaacaacaacaacaacaaaacaccggaaacccagttccatttgagggaataaagaaaggctttaaggatgaggtagcatttagactattggaatacctctccggggactctctccatgggagctgggctgcacttgtgagagccatgtgtgcacatctttataagccatcctctttgaagttggtagtttgtaatcagccatgaagaaagtatttactgtaaagaaattggttgtaccctgcggcttttctccttcccccacaccccagttgtttgttaagcatttaccagcaaaccactgcctaactctttggcctgcatattgagcagagtccctgatgtaaaaaggaaaagaattactcatctagggaggaagacctagaagactcactaaggacaggtggtgctcagttttagagctgctgttgtaggaggcagatgactgtgcttactgaaaaatgggaagaacacttaaaaatactgaattagaggagaaagacttaatgaactaaaaaactgtgatttttctaaataaaacaattcagcagtcaatgtggaaggtaggatggtcactactaagatccaaattagtgactcaaaggaataaatggaagtatctcaaaatatgcagcaaaaaggtaaagagaatgaaatcatgtggaaaatgatgagagatatggagggaagatccaaaagattttacacataagtgcatactaggagtttcatgaaaagaaaaatggaaatgaaggataactttgaaagaaataatagagatttttttctcactgttcttaagaaagccttaggtattcttggaaagactcactgagattcagactggattaatttaaaaagtaactccactaggcatataaaaaacaaatacttttttaaatcttctaaaagaaaagaaagaagatgcaaggaatgtacagtgagattatgttcatactctataaactggaagttagaaatcttagaatagtgtctgctacataggaaagaatttgactcaagagtactatacccagctaagatatcgtcatcaatataaacaaatttgttttcagttaaataaggattcagaactattttaccatatatactccttttgaggaaattgctaaagaaagtactttaaccagtttttaggtaagatgatagcttaaaaatatacatatttttccccctacccccaaatccactaacttgagttttttaaagacacaagcccactaggaagaagaaaggaaatagcatttggtaaaatgaacagctgaaagatgattcttaactgacttagtaacctaagaaagttgaatcctaagctgacaatgagagaaactgagaagtagctcattaccactgcagaacccttcagaagtctcaataattattagctccagataccctgggaaattcctaaaggtagcactactgacctaaaatatctgtaaaattttctccatatcacttccctcactcttcagagtaaggcgactctctttccctcatcctggtgtaagctttcagattcttctctgcagaggataaaaaccaggggacaccaggcacagttggacaaaggatcgagggaacatggacataataaatgtggtgacactctctgccccagctttgttcctcagttggttcccaggggactggcaggcagactggtactcacagacatgaaagtagacgatccttgaaaaatctaaccccctggtgagatgacctaaagattccccaacaaaacagtccagccagattaccctacagacaaagctgccagtggtcaacaaagccatagcccacgaagagagaacgggcctggattagaatcaggacctctatctgcattatttaatacaacactgtggccgggcacggtggctcatgcctgtaatcccagcactctgggaggccgagtggggcggatcgcctgaagtcaggagtttgagaccagcctgactaatgtggagaaaccccgtctctactaaaaatacaaaattagccgggcatggtggcatgtgcatgtaatcccagctattcaggaggctgaggcaggagaatcacttgaacccaggaggtaaaggttgtggtgagccgagatggtgccactgccctccagcctgggcagcaagagcaaaactctgtctcaagaaacaaaaacaaacaaacacacacccaaaaaacagaaaacactacatgtaatgggaaccagcgcgtagctgttaaaaataaatggtagacctaaaaccactcgggaaatacacaggtcaggcttcttgaaaactgcatcatgccaatgagggtggccagtagcatgagggtcatagtggcatgtcacaaagcttgtaggtgctgttacatggttttgaactccagtaattagtggcttaatgaacaaggagaggagataataaacattgtttaggggttgggacttttgcatgaaattatccccccaaaagtttaagaaggtaagagttagttgtgaggaggaaggtttttcttctttcagtcacaaatacttatagagcctgttgggtaaaagattgtgctctaggctctgggaatacagaggtaaaactgtcaaaaagcctaaggcttttagaaccaagagttgcagctttttccagccatgtcttcactgaagagcccactgtgcccagcctcgttgacttcgcagtagaggctctaagcttgaatgttgtgaacgttccaaggctgggtttaagaaagccttagaactccatctagacctgtaacaagtacaagtgacttgctcctctgaagagtgcttgaggctgcatgtgtcctgcatgtgaggctggagctctcagtccttctgcctcctcaccacctgtattccacatgcacccagcagcacctctcagtcttctctgtcggggttgggggagagggtaaaccaagtgtcagattacagcactcttggtttacgttcacactcgctaaaaggggtaggaagaattggagagcttttaaaatacttaccgcgcccccaagttttaggtgtgtaggattcatcagtaaacagaaaaaggagctgccctcatgggacttacattccagcaggttagcaggcagcatgcattcccagctcccctcatggcagccaggcagggtttacacattagaagctgctcagaaaagggaatgaggtacattcaccttagcttactagcccagaatgcagtgtcagtgtgtctgactcaacaccaagctggtctaccacccccagagggcaaacagtggagaccgttcaaagggagctcaaggtcagagccagggaagacatgccttacttagtatcaggccgcaggggaacttgcagaagtcaagtccactctggcctgtgatcaggagtagcattatgctaaaatcgttgtaagaataggtcagttatgatcagacttcttatacagagcctgttggaactgagtaccccccttttgaagtggaatatcagtaaaatgcttgaagttgatgtgcatcatatcagtttgcctgggagatgtgatgaatgatggtccattttatttgggagacctctctcaatattgcctgagtccatgcactaatagttggttagaccagatgaaatactgattgagcatcttgcagtgaatgggttcccctaatgcattgcctcctcccttgctgatggtatatacggtgcatatgtgtctaaagaactgacttgtaaaggactttgattgtgaaccaccatgagaaatacattttacatcctgacatagtatgcacatataaacacacacaacattttcatgtaaaatactgtgtttaaagtgctatgataatttgtcttcctgcacatgacacattaaactggcttcatgaactactaaacagtttctttacacagtttgataaatatcagtccagaacagttgtattcaaagtgagatctgctgactggcagcatcggcatcaccctggagcttgttagaaatgcagattattaccccttgccctcataccttctaccagtcagtctgctggtgaagtgcacacagcatctttaatccaggtgattctgatgtttggtgaagtttgagaagcactggttctttttacactccagagagcttttgtgattatatatattgatatttaccacattataaattaaaactgaggaacttgaaaatatttattcattcattctgaaagtaatggtaataaatccattacgtgttgacatgcatgagagcagtgatgtcatcacacaatatgtgtcccttggatctgggaacctctgcagtatactcttgagaaaatgagagttaaaaaagcaaatatattttagtagtactatgaaaatcatttgaccttgcaaggactcctggggactcccagttgttggcaggtcatgctatgagaactgttcttctcaactgtatgttttgacaagactgagagcaaatttttgtaatacttcttatatagagtaattatgtaatcatatgggatgttttcatcactgcttaggtgtcaggggaaaatgaggaactttccaatgcccataagagtatggtttattaggctgttgtgaggatctagtatggaattcccagaaccagttggtagatcccatatttgtattatgttttatgtaatgtctaggtttgtctcaaaagagggtggattacctgtgctctccctgcccttcagggagcagatagattacttccctgtggaaaattgtgctgtagatattggaagtatttgtatcttaattttgaatatttttagtcttatttgtattttgagtgattttttagacataatgtttaaattacttcatttcttccaaataagtttaggcaactagtttttttctttttttgaattgtacatttgtttcttggtatctgtgggtgattggttctaggaccctttcaggtacaaaaatccacagaagctcaattccccagtgtcgtatttacatataacttagacatatcctccctgcactttaaatcatctctaggttacttataatgcgtagtacaatgtaaatgctgtgtaaatcattgttatactgcattgctttgaggaaaatgacaagaaaaaaaagcctgtacatgttcagtacagacaacaatacattttttttctcaaatattttcaacctgcagttgtttgaatccatggagggtcgactgtaaaagtagcaccttatggctgacgagccagcattcaagttgctcatactgtcccatttaatactctactatctatatgtagtactctggtaaataaatagttttagatttgtggtgaagttacagagctgtcaaaggatgtgttaacctatagaccctggagtatttgaatcctaccttgactcacaaccttcttgaagaattacgcaaattcttcaatcagtcactcaccccaggcctttgcggccagccgactatcccaggtccagctgtgtaatggtaggaagatactgtgagtgagaggaggagagagattggttggttgattgggattcatgcagagaagcagaagaatcacggcgtgatattctttggatcttcgcaccagaaagcatggcctcatctgtgtccttgaccagccgctctccttttctccagggacaggggcttcttgcacgctatcctcacttccctcagcagggaagctgggctgggaaaggacagagagaagcagatgtgaggagcttatgcttttcctggagatctctgtgtggatggttttttctttttaattgtctttgttctgtgcatctgttgaatatcttctttcccaaattaaacttctttcccaatataaacttcccgtgagcaggattttgttgtcttatttgaatggtcttgcttcctcaatgtccgcacaccccagtgcctagtacaatcctagctgcataatagatgccctataaaatacttgtttgaatgactagtaattctataggagagaagcacagatgttaaaataaatgattgattgattgattggttgattgatttccctcaggacacatgctaaccaagagtgagaagaaccagttattggcaatagcatcatcattgtttgtggcattccagttaagagcacaacattttcaagaaaattcaaggtatggtagatcatttaaaacagaataaatgagcagaacaatattgataatccagtctacataggaaatactaataaaagatgtggctgatctcagttctagagatcttatgggtctttggagaagtataataaagtcacactgtataaatatgatattgcttacattttgtttaaacaagtttttttaagttcagaaaggataaaaggatcttggcccttttaatttggacataagaagatagtctgaaatccgatgggaaatccattcgagtagtttgtgtttatgatttctgttttatttacttatcttgaaaaacgtttggagaagtatatttaaatgtaggaatgaatctgggcagttaaaaaaatatatatcagaaactagtgaacacacaagaaggaattaacaccaggttgagttagtcatttgtgagacacaagtgtgccttttagcttcctagtgacccaggtaaaaggagaacatgctttatatcagggtaagtagaaacaaaacctcaatgccattggtgcttctagagagaggattgtttattatgaatgtgtgtttacttgctggagcaatccctttaaaggaatcatgctgttgataaattgttacttcagtttcttttcctttttactttttcacaagaggaagaacaaagtttaaaaaaaagaaaaaaaaagatggaaggtgatgaactagctttgaaaagcacaaatcagaaactgaaattacttctgaagaattaggtagaggagaaactaaattggatttaggctgtatcttagtggctaatgtggttttattcaggaaatctcagtgtagttggtactcttcacttgttctctttacctagaaagaataggaagcttacagtgtatctttttaaaagttatgatttggtagctaccagggagagatgagaagatatagaatatcagtaaatgactgaatgactggacggaggaggaaaatggtcaatagaaccgtgaatctgcttgtgcatctgtttaatatcttctttcccaaattaaacttctttcccaatataaacttcctgtgagcaggattttgttgtcttatttgaatggtctttgctcccccgatgtctgtacacctcagtgcttgttgtttggttgtttcccccccacatagttgtgcggtctagtatgggaggcactagccatgtatggcaattaagattaaagtgaatggaagaatccttttcaaagttaccggaaacgtggctacatttcaactgttccatagccacgcgtggttagcagctcctgcactgggcaactctaagaggctttccaccacagcaggtgtgtttccatcaagttctgttggacagcatttgtctggagggatatgtgtgtaggagagaatgttgcttttgttttaaaacctgaatttcatattttttattcttttgataaatgcagtattcagatcctaattcctttaccttcagatgttatttggaccttgattatttcagaagttctgagtgtagctaaatatgactggtttgatttttaagaaatgtatgcaagttattttcagagagtgctgccttactgtgtggaagaatctgaaaagggcttaaaaagatggagaataaaaattacctgtaatcccataattattcaataattacttttaatgttttggtagaacccttcaaagtatatatatatatatatatatatatgtatttatgtgtgtgtatatatatgtatttttatatacatacatgtagcatttatactttgcataattagagtcataaacctgggaatatggtttgaattacttgtgcaagataaacagcagtatattgaacacccatgcacacattatctagcttcaatgactgtaaaaaatctatcttccttgtttcatttttacctctacccactccacactttccccatttgttaattttttaaggtaaaatatacaaacacacatatacacttcttacctgtacagtttttgtttttgttttttgagacagagtcttgctctgtcgcccaggctggagtgcagtggtgcgatctcggctcactgcagccttcatctcccgggttcaagcgattctcctgcctcagcctcctgagtagttgggactacaggcatacactaccacatctggctaatttttttttgtattttcagtagagatggggtttcaccatgttggccaggctggtcttgaactcctgacctcaggtgatccacccacctgggcctcccaaagtgctgggattataggcatgagccaccgcgcccagccttacctgtacagttttaacaaagggatgcttgtgtgtaactcagacgactctatctttacatcgtctcttccagtgcactccctgcctccttttgcttgtggtgctacctgcggtgtgatttcttcagattgcttttttggtaaactttttttttttcttttctttttagagagatgaagtcttgcttttgtcgcccaggctgaagtgtagtggcacagtcataactccctgcagccttgaattcctgggctacagcgaccctcctgcctcagtgtccctggtagccaggattacaggaacataccaccacgcctggctaatttctgtattgtttgtaaagatggggtttcaccatgttgtccaggctagtctcgaactcctgggctcaagtgatccagtccaccagccttggcctcccaaagtgctggaattatagacctgagctgggcgaaaccttgtgtctgctaagtacaaaaattagcgggggcgtggtggcgggtgcctgtaatcccagctactagggaggctgaggcaggagaattgcttcaacccaggaggcggaggttgcagtgagccaagaatgcgccactgcactccagcctgggtgaaagagtgtgactccgtctcaaacaaacaaacaaataagctaaacaatctaataaaaaacgggcagtaggtttgacttagactttttatcagagaagataaatgaatggcacataagttcatgataagatgctcagcatcatcggtcagtggagaaacaaaatcacaaatctataccactacacacccactagaataatatgcatcaagtaatgagtgggtaaataaaaagtggcatatccatactatgagcttattcagcagtaacaaagaataaacagctacattcactaatgtgtgtaaatctcagaaataacatgtgaagagacagaaaccagataaagaagactatgtaatgtatgacttcatttatttgaaatttctagggaaggcaaaaagtataaagaacaaaagaaagatcagtggttgtctgggtctgggtatgggagcaagattgactgcacatgagttttattgttctaaaactggattggggtgatgggtgtacaactgtatgaatgtattacaatctcacttgatcttagccaaaaggccgagaagtgatataaatgtattacaatctcatcagactatacaattaagatgtatagatgttattggccaggtgcagtggctcatgcctgtagtcccacactttgggaggccaaggcggactgatcacatgaggccaggagttcgcgaccaacctggccaacatggcgaaaccctgtctgtactaaaaatacaaaaattagccaggcttggtggcgcatgcctgtagtcccatctactcaggaggctgaggcacgagaattgcttgagcctgggaggcataggttgcagtgagccgagatcacgccactgcactccagcccgggtaacagagcgagaccctgtctcaaagtaataaaaagtaaaatgtatagatgttatacaagtaaattatatcttaatgcaacttaaaaaactgtaaatgtggtaccaacaaagggcttgaaagaggtgggaagtattatgagaagtgttaagatgatggaagatacatgtaaaaataaattgtattcgaaacttgagtagaagcagatattaaggagtcaggttactgacttggaagacctggtggatggtggtaataacaaaagtgcaagagcagctttgaaaagaaaatatgagaagttccatttaggcagttgagtttgagatccttgacaggcataattgtagctcctaaagacttagcaatatgatatattcctatccctttgactgtttcttctttaataataatatatatgcccctttgagcccattaggaaatacttggggcatgcttttgtactcattagttccatgatttttttgtaataatcaaatgcacacagttttagacttcaacggtgttccttaatgtgtgctccatagagcgctagtttgggggagtattaaaatgcattacttaagaaaatgtttctgtgtttaaataaacgtggaaaatcccttgttaagttagaaacctcttagagactgtcatacaggcacacctcatttcattgtcctttgctttattgcacttctcagatattgcattttttacggattgaaggtttatggcaaccctgcattgagcaagtctttttgtgctgtttttccaacagcatgtgttcactgtctctgtgtcacattttggtaattctcattacatttcagacttcatcattattatcatatctgttttggtgatctgggattagtgacctttgatgttcccattgtaattgttttggggtgccacaaaccatgcacgtgtaaggtggtgaacttaattgacaaatgtgtgtgttctgattcactgacctggccattcccagtgtctctcactctccttgggtctccctattccctgagataaagtaatattgaagttagactaattaataacaaagcagtggcctctaagtgttcaagtgaaaggaataagtagcacatctttcactgtaaatcaaagggtagaaatgattaagcttagtggagaaggtatattcaaagccgaggcaggctaggcctcttgtgccaaatggttagccaagttgtgaatgcaaaggaaaagttcttgaaggaaattaaaagtgctattccagtgaacacacaaatgataagaaagtgaaacagccttattgctgatatggagaaagttttataggtctggatagaagatcaaaccagccacaacattcacttaagtgaaagcctaatctagagcaaggccctaactctcttcaattctgtgaagggtgagagaggtgaggaagctgcggaagaaaagcttaaagctatcagagcttagttcatgagatttaaggaaagaagctgtctccataacataaaagtggaggggaagctgcaagtgctgatgtagaagcttgcagcaagttatccagaagatctcactagcatcatcgatgaaggtggctacactgaacagcagattttcaatgtagataagacagccttctattgaaagaagatgccatctcatactttcatagctagaggggaaaagtcaatacctggcttcagagcttcaaagaaccagctgactctcttggtaggggctaatgcaactgatgacttgaagtagaagccagtgctcatttaccatttcataaaccctagggtctttaagaattatactaaatctattctccctgtgctctagaaatggaacaacaaagcctggatgacaaaatgtacatttacagcatcatttactgattattttgactccactgttgagacctacttctcaaaaaaaaaaaaatttttttttcaaatgattgctgctcattgacagtgcacctggtcacccaagagctctgatggagaagcacaaggagattaatgttgttttcacgcctgctaacacaacgttcattctgtagctcatggatcagggagtcattttgattttcaagtcttattatttaagaaatacatttcacaaggcgatagctgccataaatagtgattcctatgatggatctggacaaagcaaattgaaaactttctgggaaggattcaccattctagatccccttaagaacatttgtgcttcaatgggcaaaataaaagatcaacattaacaggagtttggaagaactggctttgaggtgttcaagatgtcattgaaggaaatagctacagttggggtggaaatagcaagaaaactagaagtggaacctgaagatgtgactcagttgctgcaatctcgtgatagaacttgaatggatgagagttgcttcttatggatgagcaaagaaattttgcttaaaaagcaaagtttttaagatggactctgcttctggtgaagatgctgtgaacattgttgaaaaggattttagaatattacattaacttagttgataaagcagcggcaagttttgagaggattgactctaattttgaaagaagttctactgtgggaaaaatggtatcaaacagcatcacatgctacagggaaacctttcatgagaggaagaatcaattggtttagcaaactttattgttgtcttattttaagaaactgccgcagcctccccagccttcagcatccatcagcctgatcagtcagcagctaccctctatcagcaaaaagattatgactcactaaaggctcagatgagggttagcatttttttagtaataaagtttttttttttggagatggagtctcgctctgtcgcccaggctggagggcagtggtgtgatcttggttcactgcaacctccgcctcctgtgttcaagcagttctcctgcctcagcctcccaagtagctgggactacaggcacatgccaccacaccccactaatttttttgtattttttagtagagacggggtttcaccgtgttagccaggatggtcacgatctcctgaccttgtgatccgcctgcctcggccatccaaagtgctgggtttacaggtgttagccaccacgccagcctaaactactttttaattaaggtttgtacattgtttttaagagctatcgcacacttaatagactacaacacagtgtaaacgtaacttttatacacattggaaaagtaacaaattcatgtgacttgctttattgaaatacttgcttcattgcagtggtctggaactgatctcacagtatctccaaggtattcctatatactaaaatgcattctgaaactcttaagagcaggatatagttggactcttacctacactctttttttcttgtgaaaacctttttcctaaaagctctttgaaaaattaatattccaatgaatgcttttgggaaacacagagtatgttatattgtgatttgtagtgttttagatagtttaaacacaacattccttagagattgttgaaatatttagggcaattgctttataaagtggaggttaagaagcaatctttatagtctttgctaatttctagctaaaattgtaaatgtgataattgctacattaaaaaatttaagtatcttattttttaactcattatcttttagaagttagaaacaaaatatgtatttatgaaatatgtagactgcaagttcacttatccagataattgcacatttattttctatacaacaagcaattgttcatttttggtgagtttattttctgttgaaaaaaaggtactatcacttatttagtattatcagtttattgtaaaattgctacaccctataacagtgtagagctgtaacatttagtaaatatagtgttcttcttcaggaagcataatcttgtgtagctaagtgaagctatgtttctggcttgcttactgaggaggtccttgacacctacatcatgaaagctgatgtacggtgtttgaaccttcacattttggctttagagtcatgttttcacaatcggcttgggaatggattctaagagtcaccctccaggtgtggctctgtattgctttgtcatgggtgtgtccgtgaaatgtttttccttccaaaccagtagcccacagcccttcctttgtgttgcttgttttggctgctgatcttattttcccaatttctctatgggcttcactctttcatcatttatgacttggaaaaacacattaataatacatacccctagtatttggatagtaaaacaatagtggttcattttagaaaaaaagaaaagttaatgtcagaaacaatagccattttttgggggatgactataaaatgaatttgatgagctcaatctttttctgacttaccatgaaggcttctttttaataattattcttaaacacttatattgacagaaatgaatcattaaaagctagttatattaaacaaccactttttttaaaagctaaaatgattttgttgacattgtagtttgatataataatttgtttcactaactggtaatgattggaagaaaaaatagtaaaggtaacattttaatcatttttagtaatctttatttttgctcaaaatgtctgttttttcttggatctggattcagctttcttgagaatcagcttttactttccgttttttttcctttctttctttctttctttctttctttctttctttctttctttctttctttctttctttcttccttccttccttccttccttccttcctttctttcttttctctctctttttctctttctctcttcctcccttcctccctttcctttctttcttttctttctttccttccttccttccttcctttcttttcttttcttttcttttctttcttttctttcttttctttctttctttcctcagtcttgctctctcatccgggctggagtacagtggtgtgatcttggctcactacagcctctgcccgctgggctcaagcagttctcctgcctcagcctcccaagtagctgggattacaggcatgcaccgccaggcccggctaatttttgtattttttgtttgtttgtttgttttgagacggagttttgctcttgttgcccaggctggagtgcgatggcgcaatctcagctcaccgcaacctccacctcccaggttcaagcagttctcctgcctcagcctcccaagtagctgggattacaggcgtgcaccaccatgcctggctaattttttttgtagttttagcagagactgggtttctccatgttggtcaggctggtctcgaactcctgacctcagataatccacccacctcggcctcccaaagtgctgggattacaggcgtgagccaccgtgcctggcctaatttttgtatttttcgtagagactgggttttgccctgctggccaggctggtctcaaaatcccaacctcaggtcatccacctgctttggcctcccaaagtgctgggattacaggcatgagccaccacgcccggccactttctggtttctactttatcctcataatttccctcttggtatttgagcaggggttaaagactcagaaaaagaaacaacttcactatggcctataatattaatggaaatacttcagcctgaaaggttaaaataaagcactccctttggtggaggatgactttggctgcatggaatcagtgtactttgtgctcaggcttaggagaacatatcaagtatcacggctggctacacagcctggtgtcagtttaactctttcagccacagtagcataacgggaaattacttcctcttgggttctttgtatgtgcagtcattgtgtctgcatttgtattgtattatctttcctcatctggcttcctgataaaatggagaatcgattttttagtgatttctgcctagcagagacaattatctgtttatttttctttgcctttcctggtttcagatatagaatttattcacctgttattaaattttcaattagatgataaaagtttaaggtttttgaaatatgatcttaaccactgaaagatgagtggggtgagaaacatagaaaaaagtaaccgtgtgaaaataattcccaaggaaaagccggtattgttgaacgggtacatactggctcttttactaagatgtcttctgaattaaaagagcatgtgaaattataacacatttatacgtcaatgaaaataaaacaacttatcataactcgtttcatactctcagataagccacttcactgtgacaatgaaggtgacgtgatacctaactatacaataaaaaaaaatagcactttaagtatatatttacaaacgtatgtatacactctttgtgtttggaaatagctacgttcatttgagcaaataaatcccctaaaagcaacaagatgggagaaaacattaactcaatcattatcacttaagcttgccttactttttactgtctctgttatgatattttcagttacttaatatgactgtgttgaagatggtttagaaatctatgtgagattaagtacaagatactaagtggataagaaagcacatttacatatttttgcttactattacattgtaaaatatttttattttgatcctactataagagctgagggaaaggcagaatagcctgattattgctggagaatttctctgttccctaccatgattccagaagctcttgcacacttcatcagtattattgtaattctttggctgcaggatatttggcagctgttgcaccccactggcaaatcctattcatacttctttcccattcaccattgccattggagaattgatttctctctcctctactctaacctttcccaattcattttggattgttcaatgtgaaacattttaatttcatatcatacagctattcagcttacaatcccttttttaacctgtcaccagggtaacagcatagcatgctttctttaggcaatcaagtttttatttcacatgcttaatgttgcattaaatgtttgcattttgtttaacccccttaaatagtttgaactctggatatgttttatagggtaatgaaatccttgatttttgaattgaaactaaatcaacaccatcagtgcatttataataaaatgtcaaaagattaatttccataatacaaagattattattaaaaacgcaagttagctgatctgtgtaaggcaattttctgtaggtaatggaggaatatttgtatatattatatttgtgttcagccttgttccaaaaaaagatttaaaagtggtttagagattgtcagtgagataagtaaaaaacttaaaaaaggaatagatttggtgcaaatgggaaaatatatcttttgaacccattatttgatttttcagtataatgcttttttctctgttcgtatatatgaagatttgattacttgatttttcagtataatgcttttttctctgtttgtatatatgaagatgtgattacttgatttttcagtataatgcttttttctatatttgtatatatgaagaccataatgatttatgcatgtggagatgggtgaagtaacgagatgtactagaatgagattagacatcttttctaggagaccagtgtgggcattgtgtgctttaatatctcttcatcagtttactttagaactaccttttccttaaaataagtaatttaataataatagattagtgaagataaaaatgcatatgtttagatattgattatttgacttgaattggatagacctcagtttccctttacagaactacctagtcatcttttcagccttatccccaataatatgttcaatgaaatttgttctgtgaataaatcctgtgatatttggaaaatactaagaaatgtgtaagacaaggtagagcagagactagcaaaccatgttgcttggaagcatggttcaaattgtaatgcccggggtaaccactaagaaaataactttaaaaaatagtattagtaaaagaaaagtcaagggaattaaaataagacaatagaaaacgttgatttaaaacaagacaataataaaggaatagagggagaaaaaagatatgacatatagaaagtaaaaagcaaaatggtagatgtaaatcctacctgatgggtaattaattatattaaatgcagatggcttaagcctatcaagagcagatactgacagaatagatttaaaaatatgatcaaaccatatgctttacaagagacacactttagagttaaaggcataaataggtcaattgtaaaaggatggaaaaaagtatcagacagacattgtattcgtaatattattatcagtattttattactaataatgctgatgtcaaacaaaatagccttttttttttttttttgagatagggtcttgctctatcacccagtctggagtgcagtggcatcacaggtcactgcaagtttgaactcctgggctcaggtgattctcctgcctcagcctcctgagtagctggtactagagtgcatgccctaacatttggctatatatatatttttaaatagagatgaggtcttgctatgttacccaggcaagtctcgaactcctgggctcaagtgatcctcccacctcagcctcctgaagtgctgggattataggcatgagtcaacacacccagcctttttttgtattttttttttcttccagagacagggtcttgctctgtcacccaggctagaatacagtggtgtgattatagctcattgctgcctctaattcctgagctcatgtgatccttctgccttagcctcccaaggaactaggactacagatgtactccaccatgcccagctaatttttaaaaatctctttagaggtaggtttttcctatattgcccaggctggtcttgaactcctgacctcaaatgcctggactcaagtaatccttacgcctcagccttccaagtagctgggattacaggcatgagctgccaagacaaaatattgttcaagacaaaattattgctagagacagaggggtattttataatgataaaagggtcaatccatcagaaagctataacaagtataaacatatatgtacctaataacacaattcccaaatatgtgaagcaaaactgagacaaagagagaaataggcaattccacaatacatcactttgaaaaatggatagaacaactagagagaatatcagcaaggaagtaaaagtgtcggacagccctatagaccaaatagatctaacagacatctctagaataatctctccaacaacagcagaatatacctgtctcaagtgcacgtataacattctccaggctagaccatatttaccataccatatactaggccataaaacaagcctcagtaaatttactagaattgaaatcatccaaagtatgtttctgacaaattaaatgaaattagaaagcaacaaggaaaatttgggaagttcatacatatgtggaattaagcaatgtactaccaaataaccaatagatttacaaaattacagaggaaactagaaaatattttgtggttaatataaacatcacaacatctaaaaacgtgtgggctgcacataagcagtgcttagagggaaatgagagctgtaagcacatgtattaaaaaaagaagaggccaggcaaagtggcttacatttgtaatcctagcactttgggaggctgagacgagcagattgtttgagcccactagttcgagaccagcctgggcaacatggtgaaaccctatctctataaaaaatacaagaatatgctgcgcatggtggcacgtgcctatagtccttgctacttgggaggctgaggttggggaattgtttgagcccgggaggcggaagttgcagtgagccaagatcgtactactgtactcctgcctgggtggcaaagtgagaccctatctcaaaataaaagaagaaataaagctgggtgtgggtttggtggctaacgcctgtaatcccaattctttgggagattgagactggaggatcacttcagcctagaagtttgagaccccatctctacaaataataataataataataataataataataataataataataataaaataattcgctgggtgtggtggcacacacttgtaatcccagctactaagaaggctgaggtgggaggatcggttgagcccaggaagtcagggctgtagcagtgagccaagatcatgccactgcactccagcctggctgacagagtgagaccctgttgaaagaaagaaggagagagagagagagagaaagaaagggagaaagaaagaaagagagggggcggtgggaggagggagggagggagggagggaaggaaggcagtcaggcaggcagggaagggagggagggagggagagaaggaaaggaaggatcaattaccttatcttccacttcaggaaacatggaaaaatagagcaaacaaaagcagagggaataaaatactgaaaactagagtacaaataaatgaaatagatactagaaagcaatagaggaaatcaataaaagcaaaatgtgtttgttggaaagatcacagaaatgacaaacctgtagataggctgaccaaaagaaaaaaaactgaaattgtaaaatcatgaataatagggggtatgcctactgaccttacagaaattaaaatggtcataagggaatattgtgaacaattgtttaccaataaacaagataacttagataaaatggagaaattcatagaaagatacagactgccaacactttctcaagagaaagtaggaaatccgaatagacttatcataagtaaagagatggaactaatcgttgcaaaacttcttagaaagaactcaggaccagatgacttcattggttaaaaaagttaaaggaaaattacttaatactaatcctcacaaactcttccaaaatcccaatttacaagaccaatatcatcatgattccaaaaccagataaagtcattgcaagacaaaaactaaaggctgatatccttcttaagtattaatgcaaaaattcccaaccaaatagtggcaaactgaatccaagaatatatacagtgatatacatcataaccaaatgaggtttctcctagagatacaaagttggtttaacatacaaaagtcaatcgatgtgatacatcatattaatagaataagagaaaaaaaccacaggattatctcaaatgcaaaaaaaaaatctgacaaaatccaacagcttttcattatgaaaaacactcagcctactcggaatagaaggcaacttcctcagactgatgaggagcatgtgtaataaacccacacctgaaaataagggcatctagattggagagaagtcaacttacctctttttgcagatgacatgattttagatgtagaaaatcttgaggaattgacaaacaaatctgttagaactaatgagtcctggaaggatacaggatacaagaatgatatgcaaatatcaatttttgtttttatacagtggcattgtacaagccaaaaatgaaattaacaaaacaactctatatagcaccaaaaaatatacaatacttaaatgtaaattttaaacaagaaatgcaatacttgaacactgaaaactataaaatgttgttgaaataaagatgacctaaatgaaaaacaccctatgttttgaatcagaagacctaatattgatcaccaaactgatctacagattcagcacaatccttactagaatcccagctgcattatttttggaaaaatagacatctgattccaaaattcatatgaaaatgcttttgcattgtaaaagaggaatgaagttcagaggctcctacttcccgatttcaaaacactacaaagctacaataatcaagacaaagtggtactggcgtaagcatagacatgttgatcaatggaatagaatcgagactccagaaataaattgttatatttacagtcaattgagttcagtaaggataggaagaaaattgaatgagttaagattaatcttttcagtaaattctgcttgggcaattggatatgcacatgtaaaagaatgaagttggtctccttcctcacaccatacataaaaatgaactttaagaatcatagacctaaatgtaacagtgcatacaacaaaattcttagagaaaaacataggagttaatctttgttacgtttggttaggtaataatttcttacataagatgtcaaaagtacacgcagcaaaagaaaaattagataaattggacttcagaatttaaaacttgtgctttaaaggacatgatgaagaaagtgaaaagacatccctcaaaatgggagacaatatttgcaaatcatatatatttaatagtcttttgtctagtatagggaattcttacaacttaataataggacaaatgatccagttaaaagataggcaaaggacatgaataaaaatttttcaaaaaagatatagaaatggccaataagcccataaaagatgctctgtatcattagttgataggaaaatgtaagtcataaccacaatgagataccacttcacacccatgaagtggtgaagatgtggaaacatgggaaccattacatgttcctggtgggaatttatgactacagtgatatgaacttgggaataatttgacagattcttaaaatattagacgattaccacatgacctagctattccacttcctggtatatacccaagggaaatgaaaccatgtgtgcacagaaatgttgtatacaaatgtttatagtggcatttttcataatagccagtggaaacaaccctaatgtccttcaaatgatgaatgagtatataatagtaaataaaatgtgatacgttcatagaatggattatttttcagcaataaaaataaatgagctattgatattttctgcaacatggatgaattttgcaaaaatgctagatgaaataattcagtcaaagtagatcacaaattttcccagaataagcaaagctatagaaatcgaaagtacataacagttgcttagggctgaggaggggaatgtagagtaactgctctcgtatctaatgtttcccttatgaggcaatgaaaacgttttaaagttgcttgtggggatggttgcataactctgtgactatactaaaaaccattaacttgtacacttcagatgggttaaatgtatgatatgtgaatttcatctcaaactgtttaaatgtatatagtctgttacacattttatatttaagaatttgttttcctaatggtataatagatgttcaaattttaggaattaaatgaggcatttcttccttctagtttgatggagtctttgagaatatttcttttcaaattgtaaaatatgtttctatgtctgctctcaatttagtgcaagagtagctcttgggggtagcaatatcaagtgttcctgggctaccacctggaaggtggaagtagtagatgtatgtgaacccgcgttcttccatcttttctttcctcttctgccttgaaatgcaagtgacataaaattaaaacaacacggaaaagtttcagttcctacaatggcagtgtagtgtattttcaatgaattcctttccagataaataattataaactctggacaaaatataaagcacaactatttgaaggctgtcgatgtacaaccaaatacgacccctaaaagaagaaaactacaccagtgagatgcacatttatgtggcttttcctctgaaagcagtcactattgcatgcattaaggcatggctgtaactcagttattggttttaggtctcagagaatgatgttcagtgttgtcagaactgctggaaattaagcagggatatcatggcagaaagggagcaacagagtgaagagttccatatgtgaattcaggttctctcaaattgttggttgaccctggaaatgtgcgtaacaaagaccccagggatcccagaagatcccagaactgctggaatgctgaatgaactgagctaaaatttcagttgcctaccatggttatgataatgttggaatctgaatctcatcaatttgaggtacttgtaaacaccttgagctttccattaaaaccctggaaggaccatgccttgggagaaaagactgtttctggaataaatggtttggactttttatttattgagagcaaaaccaaatagttcctagtacaacataaaagtgagcctccacaacttcaggactggtaactagcaatgtaactgcctgctgtaataaaaatcagtacttttcagagggagataacatgatgagtgaagtctgacaacatctccacaatacagtttacttggcatgcaatctaagaataaagacaactataatccagaggaaaagcagtcaacagaaatcaaccgtgagattactaaaatgtttgtttcatgggcaagagctttaaagtagctattaaaatcattttcaagtattaaagatgaaaatgagggaaaaatgggaactatcagcatagaaatggaaattaaaacacactactaagtggaaattccatatctaaaatgtcctatatctgcaatggataatttgctggataggctgaaaagcatactggtgatggcagaagaaggaataggtaaccttgaagatagaagaatagagattatgcaatctgaaaaaagagaaagaaaaatgtgtttaaaaaattgaagagacacaaaaggacaaaggaaacttttggaggtaaaacatgtttattaccttgattgtggtgataatgtaatgaccgtatgcatatgtccaaactaatcaacttgtgtgcattaaacatgctgttttttaaaatgtcaaatacacctcactaaaggtgtttagccgaggtgggcagatcacctgaggtcaggagtttgagaccagcctggccaacatggtgaaaccctgtctctactaaaaatacaaaaaattagccaggtgtggtggtgcacgcctgtaatcccagctactagggaggctgaggcaggagaatcacttgaacctgggagctggaggagcttgcagtgagctgagatcgtgccactgcactccagcctgggcaacagagcaagactcctcaaaaaaaaaaaaaaagaaaaagaaaagaaaaaagctgtttaaaaaaaaatggaagacagcctcggtgacttgtgggcactataagttatcaggaagcatgtattaggaaggacaaaaagaaaggcaagagagtgaagaaacttcagaaaaaatatttaatgttgtcttcttaagattgggaacaagacaaagttgtctgtttttatcgtgtttatacagtattatcctggagatcctagccagtgcagttggaaagaaaagaataaaaggcatagaaatcagaaaggaagaagtaaagtcatttctatttacagaggtcataattgtttgcatagaaagccttataagaatctataaaacaattgctggaactaacaaatttagcaagattacaggataaaaaggcaatcaaatgcaagttgtatttgaataaactagcaacaatgggaaagtgaaaattaaagttccacttaacatagcataaaaataggcaaagcagacaccgtcactagttagagtatgaaggcatgcaagaaataacggagcctaatgattgcaaaggaagctttccacaccttaattggttacctaagaaaactctaaggagtctgccatacaatgaataaaactaaggcaaaaataggcataaagttaacaaaagagattcatgactaccacactttatgaaataaattaaaaatcagaagaagtaagagttatatcctgctcatggactggaagagaaaatattaagatgtcacttctctctacagtaatacagattcaatgcaggcccgatagtaattctattgggattgtatctcagggaggatgtggaagaaattggcacattgattttgaaatttctatggaaatgcaaagggacttgtattagtccattttcaccctgctgataaagacatacctgagactggacagtttacaaaagaaagaggtttaattgaacttacagttccacatggctgaggaggcctcagaatcatggacgaggaggggcaagtcacatcttaagtggatggcagcaggcaaaaagagttttgtgcagggaaaccccccccttttttttttctttaaccatcagatctcgtgagactccttcactatcatgagaacagcataggaaagacctgcccccatattcagtcacctcttactgcatccctcccataacacgtgggaattcaagatgagatttaggtggggacacagccaaaccatatcagacctagaatagctaataggaacaaagttgcagtacttggtctacaaattttcctgaaatgggctcacccctgtctcctaccacacaggaaagttagagatgcatcatagacagatctacatgtaaaacatctaaaacatgtgagtatatcttctgaaactttgtatgtaggcaaaaaacttcttagcaaggacacaaagcactaaacataaaaggaaaaattagtgagttagattttgttaatattaaaaacttccattaaaactgtaaaaagataccactacatacctattagaatgtctaaaatccagaacaccgaacaccacgtgctgctgaggatgtggagcgacaggagctctcatgcattgctggtgggagtgcaaaatggtaagccactttagaagacagtttggcagtttcttacacagcataaccttaccatataatcaaggagttgtgctccttggtatttaccaaaatgagctggaaacataggcacacactaaaacctgcacgtgaatgcttacagcagttttattcataattgccaaaactgagaagcaatgtccttcagtaggcgagtggataaactggtatgtccgtacaatggaatattatttagcaataaaaagaaatgagctactaaggcatgaaaagacagtggaaacaaatacatattggtatggggaaaaagctaatctgaaaaggcagcattctgtatgattccagcgctaagtgacattctgaaaaaggcaaacctatggagatggtagagatcagtgattgccaagcattcgggggagggaggggaaataaataggtggaacaggggacttgtaggcagtgaagctactctgtatcatactgtaattctggacacatttcattagatatttgtcaaaacccacagaatgtataacacagtgaaccttaatgtatggacttcagttaacagtaacattgatattggcttatcaattgtaacaaatacaccatacaaatgcaagatgttcataatagaggaattcatgtgggggaggatgtatgggaaattgaaattctgttgagtttttgtcaacctaaaactgctttaaaaaataatgtctttttttttttttttaaatctgctgaaggaaagacattgttaagaaaattcataagcaaaccacagaagagaatacttgcaatacataaatctgacaaaggccttgtatccaaaataaagaactttcacaaatcaataaaaataaggccaatgacctaataaaaatgggcaaaaacttgaatataaatggccactgagcaccataaggtcctcagcattactagtcatgggggaaatatacatgaaactatgataagatgcggtttcccagcctctagcctggctagaattagaaagactgacaatgccaaatggtggcaaggatgtagagtaactcattgcagtggaaacatggaaatgttgtaatcttttggaaaacaatttagcaactcatataaaattaaacctacatttagcctacgacctctactccctagattttttaccccccaagaaatgaagacatacctctttaaggggggaaaaagcaatcaagtacaaagaatatctacagtggctttgtttataacagccccaaactggaaaccaccaaaaatgtccatccacagaaggatgaacttattttggtgtgttggtacagtaaaatacttctcagcaagaaaaaaaggatgaactattcaacaacatggatggatgcacctcaaaaacattatattggtcaaaaaagccacagttttttttggagtctgttcttgtgaagctcagaacaggcaagcataatctctggttgactgttagtggcaggcagagccaagcgactggaagggtgaatgacagaacttaagatcttggaatttgactgtatgttagttgtatgcgagtaaaatttaaaaaaaaataacagttgctgaaacaaaagagagggatttcagatatttctgcacccaattatggtaacaataataactaatttagcatttatgtgccaaacactactctaagcattttacaccttttatctcatgtaagcagcatatgggttaggcattcttattatctttgtcttgctgatgaggaaactgaggcacaaggaggctaagtaagttgtggatggaggtcacacagcttttgtaggtctgcacttggtcagtgagacatggggtctgctggggtgacagctgtgccacagtgcctttcctggctaatcatgcccagtgtctaaattgagaaccttaagcccttatcggtggaagaaggaaagggagtatgcataatatttaaatatatgagattatgagtaacattacgtattctatcctagattcagatgtcatttgtgtaattatttgtaatgctaataacaccaaacttgggggtgttccctgtttctcagcatgattatgtgatacagactcttccacacagtctcatgtatttgaacatacacattttcaattgcatgtaggcagaattctaatcctcctctatgccaattcctagctttgaagaggttctctgaaaatgctgcttttatctttcttctgcagtgatgaactttaatgttggagtgttgtaagttctcacataataaggctcagatttttgtttggtttggcagtagacttctgtttaaaattcctttaatctgttcattctatgctttttatattcattttaataactgatggctctgtaaagaattttttttgaatttattgcactagttaaaaaactactaaaacttgtacttaactattcctccatctcaacgttctaaaagtgagttttccagtgaattgctgaatttttatcttccctgggagttgttcctccccttccccaaccctggggaaataagaaacaattcatatactagatctaaagtttcattaaaattgcttatgccctgtctcaggcattttaagtgggccatctgtctaaacatctctctctccttttttttttctgatcatttcctcgacttattcatgagccatgggagggctcctttgtagtctccatgtagctggttctgtctacccccactgaatacatctatgtgcttgcataacatatcttttcaccgtgctggaaattctctgaacttggttcagatgaatggcccactttctgaaggcctttttcttcctgcaaagatttgtatgcagaaactgacctcagtggccatggaatgcagcatattattctcgatcattttacagcccacccactgtgaaagttatgatgaagcatttcttaatgattccttgaccattagcattgttttaactcagtattttacttctaaagaggtgatggcacaacaaaaaccagcttttttgagtgtctgataattatggtttaaaatgcttataatcctttctaactgaagatgctgagagtttttatgtttatacagtcttcttttagcaaatgacttgtaatagcaaagtatttactcaaaagcacccttttgagtaaaatattccagtaagttaaatgtattagtattaatagtgactatcagctgacagttcttcaccatcaaatataaaaaatttagttatgtcgagcatattcatcctggctggctgatgataaagtggacagacctgggttagagctattattttatttgctttgtgagtcactgtttatgtgagttcttttttactggggtttttggtttttgtttgtttgttgaagaaataacttaattggtatcagctttgcaggtgactaataagttgcacagattaaatttttggtcagatgacagcatctttcactagaaatgtacttcgttaaaggaaactgtatcattactatggtgagttgaagttctaagaccttttccttattgtcagagagttgttcataaaaatcttctttgagactattttgaatttaatggatctgtgtaattcttttctaaacatttagcacataattgtaggtaattgttactatcataaatctgtctgtgctggttaaattaataagaatgtttcaaagtaagtattataaatgtattttcagtgattttgcagaaatagagcatgcattctttcaggtttgtattttttaaaatttatagcttatttctattgcagagcatatttatatctgccagttaactggcatatatgcccaacccatccattttatttaaaaacccaaacaaaactagtttcaaacttatgtcaagccagaaggaatctttgcaaattttgtttgtagaagagtgaacttacaaatagatttcacagtttcgactctgttttggtatttagaggtcttgcacagtgaagcctttttcctatatcctgttaacatatcaccctgaaagaaattgttagaaaaaggctgggtactgtgactcacacctgtaatcccatactttgggaggacaaagcaggaggatcccttgaggccaggaattcaagaccagtctgggcgtcatagcgagatccaccccatctcttaaaaaaaaagccagacctggtggtggcgcacacctgtaatcccagccactcaggaggctgatgcagaaggatcatttgagcccaggagttccagactgcagtgagctatgattgggccactgcactccagccattgtgacacagtgagatcatgtttcttaaaagaaaaggaaaaaattgttagaaaagtgccactgcaggagttaagtttgtagaagaagcagtagcttcctatcacttgcctaactctgatacacttttacaggtgtagaaatattggttcaaacagattgaataagttctcaggtacattgctagtagaacaggctgagatttagacctggatgttttaactcgaaaccctgtactctttccataaggcccctcctgggacaaattataatatatatgaaacagatgtgaatcaaaataaaacaatggaaaaataaatagtacttaggttttggagagtggcaactgtatctcatcaccatctataaggtccctttctgtgggaaaatgggttctgggttggaacaggatgtcaggatcagcaatgttccaatgcctctggaagcagagacttgttacgtgatagaagaaattctcaatccctactccatcaggctgctacagtttgaaaaatattacagcatatgacatagattaaatggaagaaagatctcttgagtttatgctataattaaggaacaatttgtgagggaggcaatattttccttgaaggatctgttagtgtgagaagcagagagatgagatgagaatccaaagtttctataaagaaagaggtttcagttataggggaaagtaagaatataggccgagagccgggacaactactcataataaaagctatagcatgtatacacctaatttaatcaacacctccctatcaatgcagatattgttacaatcttttatacatacataaggaaactgagacagacagtttgctccgggttttgtgtcagcttctgtgactcatcaaggcctgagttcaaaaccactgtcttgctctctgcctcatggtagcttggtttaagagtctgtcctaaccaaatagacaaatcagagaataagcagaaataaaattgaatgcaaaaggtgggttcttacttttaaggcattgaatggtagttaggttaataaagatgtaacttggtgtggggtagaaaacgatcaaatgatcatgagcaagatagtgacataattcttgaggaaagcacagattcaagaaagccaagttgcacggtcatctagatgtgaggctgtttctgcaatcacaatacccctgtgaaattggagtattgaccccattcgaagtgagcaaaatgaagtcttagtgagatgataggcgtagtccagggacacccagggagtatccaggagcttggggcacacagtcctgtcacacctgtgctcttgctctcctgggcaagtcagcctccccttctacacgtgcttggtgcatagtagacactcctcacagtcttttctacttatccctcatctctttgtctccatcctgtgccaggagctggagatacaaaaataaggaatgattttggtcttttaggagcccacaggacactgggagacaaacatataaacaaataaatgccctgtagaataaaggtgctaagaaaaaaaagaggaatactggcacagaagccctttcttcccttcttcctttctgctcagacctccttttctttccctctcctcctcccctccccactgtgtgttgtctccctcaactcccctgcacccccattcattcatactcttctgtgtgaggctctatcccctgaaacagttcttttcacactgccagaaagaatcgtcaaggcctgtgtgtacagtgtgcattattgttgatgcattttttttttacttttatttttacttccatggtatttaaaacatatccttatcttcagaataatgcagatcaagaagtggtaggtcaaatacaaatatgtatttaaattaataatattaatcagatattgaatctagaggtgattggattagaagcatagtttttgtgactctgatttttttaatgctgaatacacagagacttcttttgaaaatttggtgggtttaaatgaaaacataacttggaacattttttcagaactgtggtttaagctggagcccagatactacaaaatgctgatgtttagtacttggtaaatattacttcacaagtataaatatgcaatacctaaattaggttaattctgaaatcattaaattttgttactttaaaaagtcgtgggaaacatttatattctaaaaacacttttgtctttggctgcttgatacggattttctgaaccatgtaatactgataatatgcaagaaaagacccgtatgataagactaacattgttcatagatatggagtcctttctggggggttttaggtgatggggaaaaccagggctagaaaagaaataatgtgtaagtttccaagatgaggactgtgttttatttctctgtggtgccccacaatttagagccaagtgcttagtgtttgttgaactcataagtcatttagggttttgtgtgtgtgtgtgtgtgtgaatgtgctttattttagcaaaatttagatgttgtcctattatataataacataataagtgggtatctgagtaatgtttaaattcgttttttaaatttcgtgaatttttagtaataacattataaaataagtatagttttttttttgtttttttttttttgcaaaaaataattatatcggccaggcgcggtggctcatgcctgtaatcccagcactttgggaagccgaggcgggtggatcatgaggtcaggagttcaagaccagcctgaccaaaatagtgaaaccccatctctactaaaaatactaaaaattagccgcgtgtggtggtgggcgcctgtaatcccagcctctcgggaggctgaggcagaagaatcacttgaacccaggaggcagaggttgcagtgagccgaaatcgcaccattgcactccagcccgggcgacagtgcaagattccgtctcaaaaataataataataattaaaaaaaattatatcctagctaatgtactaagatatttctcttctaattgacatcatgaagaaacattctataagtagaataatgtagagaggttcattgtttaatacatttttagtctcatcaccagtaaagaacaaaatgattctctaggccacatcatgctaactcagtaattcattttatgtctctgaagtttaaggcatggcatacttacttatttcattgtaatttttttttaaaaaaaccattttgaatagtaaccaaatattgaaaaaaactaatactgcttcaggcagatgaatttgtgaatgactgtaacaattaggcaattcaaattcatagatacatgatgattcttagagtaggtgtttaaaatgttcgcaaatacattcaatggcagttttagcctgtgcattttatatcaaagggaaattagtttattgagaaataataatataaaattattaactctttttcttttcattctacttcagaatgcctgttattaaaccagacatagccaactgggagctctcagtaaaattgcatgataaagttcataccgtagtagcatcaaacaatgggtcagtgttctcggtgagttttctttctttattttcttggtaatcttgatgttatctatgaatatttaaagccatttttaacctgttcagtgactctcgtcttttgaatttgtagtacctctatgtatttttcatcttctttaggaagctgaatggaaatggaaatttttgttctcttatgcttattaggaaatacatttctagatttagccacatcctaaactcactttctgatacttgattcatttttcttttatgctgtgagaagtaatacttttgcctttgttacagagaagagcattttgaattacagttccaaatgtatgatagtggtggtaggtaaccatccttttaaaacaaataatctgaagcctcacataacattatctttaaatctcatgctgcaagacactcttgaggctaaatttaccttgtggtgacactctttttgttttgaagaacttaaaccccttggatatagggtccaagatagaactgccacagttggaattctagtctatagtgaacaagattacagtaagatttcagtgtttatactgtagtatgagtgatatgtttaaaactgtgatccgagtgtgccagaaaaataccattaagagttgctgttttaagtcgtatgccttcgtgttttcagcctgaactcaaggaggttgctattaatatatagttagtataatgaatattctgtttatctacatttctcttcttacggctaaattgcattgaaatgtcattttgttttggggaaacaagtgaatttttatcagaatattgaaataggatatgaacatcaaaacaatataatttcacacaaataagacctggtgtggcttgagaggggtacggcagtttcttgatctcagtgagaaaatatcacaagttgaagattcatgagaattcattcattccacaaataattgttgcatgcctactgtgcaccagatcagttccaagctgttgccctggagaagctgacattcttgtgtggtgtcagactcacagatcaatgatgtcagtccatgaactaagggtagtctccttggttttctttaaatgttgtgattcactgtatacgccaaaattgctgaaacgttagatactgaaagatacttcactcagctctcttaaaatgaaagctatgatggagttaaacagctgtctcatgagatcttgtgtgactctctacattccacctattgacatggtcatttcagaaaaacagctttgtaagtgcacatttaaccagagatcaggttgagtagcaaattataggaattgaatagtaaagagtatcaatattacaatgtagcatttttttttctgggggaagattaactttacaaaaatgtagagtttagcataattttcagttctatattgagtcaccactgaagccttactgtaatctgatattctgatacaatgttcttttaagtagtgccttaccttaataaagaaaactgtctagattacttttcagagctgttacttctttttttttttttttttttttttttgagacagagtcttgctctgtcgcccagaggctggagtgcagtggcatgatctcggctcactgcagcctcttcctcccaggttcaagtgatttctcctgcctcagcctcccgagtagctgggactacaggtgcatgccaccacacccaactaatttttgtatttttagtagagatggggtttcaccatgttggccaggctggtctcgaacacctgagctcaagtgatcctcctgtctcagcctcccaaagtgctgggatcacaggcgagcgttgcttctttatgtttgttttagattccatgttgaaaagtagagacctctggcctgactgcatacgtggtatctttcaaatttttttctgtagaattatctccagcttcactttttagcttatgaggaaaacagggctgtttttaaaacacatcaaaattagtgcattaaaaacttccctggaaaatatccaccttagtatataatatcagaaatgatttcctatatttattggcttagctactgtcagagcatcaatagcccaatgaaaggcatgtgcacatgatagtgtagccctttttcctaggcatatttaaatttagctactttcatttgacatcagtattatgaaaggaggcaggttgaacagcgtggcgaagtaaaggctcattggtagaaatatttcaatagtatggcactattgtctgcttttagggtcatagacgggagaactgtgattgttaacttagtttcccagatcacccactgtcacatcaagaaaaaaattagcctacaggtgacaagccaggtctgggttaatgactctggagatagtgcaggcaaaggctttactgagcacacagtaaagctttaggtgccctacatttccagagttcttctgtttaatttttaggagtttaaattataagatatttctaataaggaaagtacagcagatgttgcagattttccatacaggtctcctatttaaaaagaaaaatatatagattaaactaagtcctttctttacatcatcctgttccactttctcccaagtggtggcagctaacctgatgatgctgtgtgtcctttctgtatgtgttgttaagacttttggtacagatgtatacaccacaataatggtaaaaaggaaagttgcaacaatatacatacttaatggcaccatttatgtaaattttaggcaaagcaatttcatttacaatagaatgaaaaggactaaaatacttaggaatatatttgaccaaggaggcgaaaggcttacacactgaaaactataaaatgttgctgaaagagcttaaaaaagacacaaatatatggaagggtatcttgtgtcagggactagaagacttaatatggttaaaatatcagtacctctcagctacttggaaggctgagacagtaggttcacttgagcccaggagtttgtgcccagcctgggcaacacagcaagactccatctctggtgaacaaaagaaaaatgaaagaaggaaatgtcagtactacctgaagtgatctacagatacaacgccatccctatcagaacccccaaatacattttgttgcagatatagacaaatttattctgaaattcatgcaatttcaagggggtcccaaatagtcaaaacaatcctgaaatagaagaagaaagttgaaagccttatacctcctcatctcaaaacttattacaaaaccacagttttcaaaacagtgtggtactgcacatatatagaccaatggactaggatagagagcccataagtaaacccttgtatgtatggtcaaatggcttttgacaagagtttctaaaatattcagtggagaaaagacagccttttcaacatgaataaatttgggtccttttcttactctgtatacaaaactaaccaaaatggatcaaagacctaaatgtaagagctaatgctataaaattcttagaagaaaacacaggggaaggctgcgcacagtggctcatgcctgtaatctcagcactttgggaggccaaggcaggtggatcacttgagctcaggagttcaagagcagcctgggcaacatggtgaaaccccatctctactaaaaatacaaacattagctgggcttggtggtgcatggcacacacctgtaatcccagctactcaggatgctgaggcaggagaagctcttcaactcagtgggcaaaggttgcagtaagctgagatcgtgccactgcactccattctaggtgacagagtgagaccctgtctcaaaaacaaaacaaaacaaaacaaaacaaaaaaaccagtagataacataggggaaaagcttcaaggtattggatttggcaatggtttcttagacatgacaccaaaagcacaggcacaaaagataaattggactatgtgagagttaaacacttctatatatgaaaggagaatattttcccagaattttcatccctcctttaaaattttccattctaaacactataaatatataaatgtttcatgcaaatattttctcccattctgtgggttgccttcttactctgtttttttcccaaagtaaccactctgtcagagtacaatcaacagagtgagaaggcaacccacagaacgggagaaaatatttacaaatcacatagatgataagagtttgtttgtttgtttgttttttgagacagtctcgctctgtcacccaggctaaagtgcagtggcacaatcttggctcactgtagcctctgcctcccaggttcaagtgattcttctgcctcagcctcccaagtagctgggattacaggtgcatgccaccacacttggctaatttttttttgtatttttagtagagatggtgtttcaccatgttggccaggctggtctcgaactcctgacttcaggtgatccacccacttcggcctcccaaagtgctgggattacgggtgtgagtcaccacgcccagccctcccgataagagtttaatatctggaatatataaagaaatttttcaactcaataacaaaaaacaattaaaaatgggcaaaggactttcatagacacctctccaaagaagatatacgcatggccaataagcacatgacaagatgctcaatatcactaatcattagagaaatccaaatcaaacctgcagtgagatactacctcccacccgttagaatggctagtatcaaataaacagaaaataagtaccggtgagggtgtggagaagctggaacccttgtgcacagttggtaggaatataaaatgatgtggttactttggaaaaaacagtatgatggtccctcaaaaacttaaaagtagaattacatagtaaccttagaaagttggtaattctgatatgtgctatataacacagatgaatcttgaggacattatgctaggttataagccaggcgcaaaaggacaaatactgtacgattccacttatatgaggtacctggagtagtcagactgatagagacagaaactagattggtggttgccaggggcagagaggaaggggaatgaggagttattgcttcaagaatacaaagtttcactttttaagatgaaaggttttctggaggtagatggtggtgatggtagcaggaaaatgcaaatgtatttaataccactgaactgtacatttaaaaatggttaagatggtaaattttatacgcgttttaccacaagtaaaacatacacaaaacaaatcagtatttataatgaaaaacttaaaaggagggttgtggccaggtgcagtggctcacacctgtaatcccagcactttgggatgctgaggtgggtggatcacctgaggtcaggagttcgagaccagcctggccaacatagtgaaaccccgtctctactaaaaatacaaaaattagccaagtgtggtagcacgcgcctgtaatcccagctacttgagaggctgaggcaggagaatcacttgaacacaggagatggaggttgcagtgagctgagatcacgccactgcactctagcctgggtgacagagtgagactctctctcaaaaataaataaataaataaataaaataaaaaaggaggtatgaaaattctgggaaatgaatgcatggtaaaaatgaaagttaagtgaagtgttaatcgtaggagaagtgaagtattttatgtattttaggtctttattctgatttctgaatacagctgtctgaatgaatgacagaattaattaatagtataaaacctgctagacacaaagtagaaatattattcagcttgtcatggtgataagccgaaaagtacccaataacaaactgatttttattataattattttcatgattcccttctggattcccaggatgttttccatttctgtcttgctcaatataacacaaaactggtcaaaatagtttttggccaggtacagtggtgcgcacctatagtccatccactcaggagaaaataagtttatgatgaattaaaatattaacacagttaatatcttaaagatggtgaaaaactaaattcatattgaatgtgattcacttgaaagaaagagttgaaagaagagtgtcagagtagtcctaatgtataagaaaattagttagaaatttggccttcctagcgatggaaaaaggagcactatacatgcactttttgaaaaattttgcctgatgtttcatgtttactactaataaactagaaagcaattgtatatgatcctgtatattgaattgttacagtgggccaatgatagaaaattttgtaaggacctaagggtttttcgtgtctctgtctccttcagttcggctctgatcttagttatttcttgtcttctgctaggttttgaatttgtttgctcttgcttctctagttcttttaattgtgatgttagggtgtcgattttagatctttcctcctttctcctgtgggcatttagtgctataaatttccctttaaacactactttagctgtatcccagagattctggtacattgtgtctttgttctcattggtttcaaagaacttatttatttgtgccttaattttgttatttacccagtagtcattcaggagcaggttgttcagtttccatgtagttgtgcggtttcgaatgagtttcttaatcctgagttctaatttgattgcattgtggtctgagagactgtttgttacgatttccattcttttgcatttgctgaggagtgttttacttccaattaggtggtcaatttttgaataagttccatgtggtgctgagaagaatgtatattctgttgatttggggtgtagagttctgtagatgtctgttaggtctgcttggtccagagttgagttcaagtcctgaatatccttgttaattttctgtctcattgatctaatattgacagtggggttgttaaaatctcccactattattgtatgggagtctaagtctctttttaggtctctaagaacttgctttatgaatctgtgtgctcctgtattgggttcatatatatttaggatagttagcccttcttgttgcattgatccctttactaccaggcctgccttacaagagctcctgaaggaagcactaaatatggaaaggaaaaaccagtaccagccactgcaaaaacataccaaattgtaaagtccatcaacactatgaagaaactgcatcaactaatgggcaaaataaccagctagcattataatgacaggatcaaattcacacataacaatattaaccttaaatgtaaacgggctaaatgccccaattaaaagacacagactggcaaattggatagagtgaagagccaacagtgtgctgtattcaggagacccatctcacatgcaaagacacacataggctaaaaataaagggatggaggaagatgcactggtttttcctcatctttatggatttatctaccttttgtctttgatgttggtgaccttcggatggggtttttgtgtggacctcctttttattgatgttgatgctgatgctgttcctttctgtttgttagttttccttctaacagtcaggcccctctgctgtaggtctgctggagtttgctggaggtccactccagatcctgtttgactgggtatcactagcagaggctgcagaacagcaaagattgctgcctgttccttcctctgaaagcttcgtcccagaggggcacctgccagatgccagctggagctctcctgtgtgatgtgtctgtcaatccctgcgggggggtgtctcccagtcaggaggcattggggtaagggacccacttgaggaggcagtctgtccgttaacagagctggagtgctgtgctaggagatctgctgctctcttcagagccagcaggcaggaacgcttaagtctgctgaagctgcgcccacagctgccccttcccccaggtactctgtcccagggagataggagttttatctagaagcccctgagtggggctgctgcctttctttcagagatgccttgcctagagaggaggaatctagagagacagtctggcgacagcggctttaccaagctgccatggctttgtttattctctgaggggaaaaccacctactcaagcctcaataatggtggatgaccctccctgccaggttgacttcagactgctgtgctggcagtgagaatttcaagccagtggatcttagcttgctgggctccgtggggctgggatccgctgagcaagaccacttggctccttggcttcagccccgtttccaggggagtgaatggttctgtttcgctggtgttccaggcaccactggggtatgaaaaaaaactcctgcagctagcttggtgtctgcccaaacagccgcccagttttgtgcttgaaacccagggccctggtggtgtaggcttccaagggaatcttctggtctgcggggttgtgaagaccgtgggaaacgcttagtatctgggctgaatagcactgcccctccctcatggcacagtccttcacggcttcccttggctaggggagggagttccctgaccccttgtgctgcccgggtgaggcaatgccccaccatgctttagcttgccctttgtgggctgcacccactgtctaaccagtcccagtgagatgagccgggtacctcagttggaaatgcagaaatcacccaccttctgtgctgatctcgcggggagctacagaccggagctgttcctgtttggccatcttgccagccacttgagaaaaatgtctttttactgtttttgacttaaagctgttttatgtgataacagtatagctactcctgcttatttttggtttccatttggatggaacaattttttccatccctttactttcagactatttgtgtctttaagggtgaagtgtgtttcttgcaggcagcatatatttgggtcatatgtttattcagtcagccagcctccatctttttattttattttattttatttttttgagacagagtctcgctctgtcacccaggctggagtgcagtggcgtgatctaagctcactgcaagctctacctcccaggttcacgccattctcctgcctcagcctctcgagtagctgggactacaggcgcctgccaccacgcccggctaattttttatatttttagtagagacagggtttcaccgtgttagccaggatggtctcgatctcctgaccttgtgatccacccgcctcagcctcccaaagtgttgggattacaggggtgagccactgcacctggccaccagcttccatcttttaagtggagcatttaatccatttacattcagggttattattgatatatgaggttttgttcctgtcatatcattaattgctttctgtttgttttatatgttccttgttccttcctattttatattgtttatctttgtggttggtgttttccttcagtggcaacattagagtcttttctgttcctcatttgtgtgtttgccttaccagtaggttttatacttgcacgtgttttcatgatggtgtatattgtccttttgcttccaggtttaggactcccttgaacatttcttatagggcggatatggtggtaatgcattccactggtcaaattcggcgtttgcttgtctgggaaagactttatttctccttcattaatgaaggatattattactgggtatagtaccactgagtggcagtgtttttctttcagccctttgaaaatacgattccattctctcctggtatgtgtggtttctgctaagatgtcgactgttagtctgatgggacttcctttatagatgactagatacttttctcttacagtttttaaaactctgtatttggctttagatagtttgactataatgtatcatggaagagatactgttttgcattgaatctggttgaggatttctggaccttctgtatctggatgtctgtatctctcactagacttggggagttttcagttattatgtccttaaatagagtttcaaatcctttcattatttctttgccttttgggatactgataatcttgatttttggttactttattgtgtcccatatatcatgaaagctttctttatgttttaaaattactgaaaaatttttttgtgtgactgcattatttcaaaagacttctcttcatgctttgagattctttcttctgcttgatctagtctgttgaagcttttgaatgcattttgcatttcattcagtgaattcttcattccagaatgtgtctgattcttttttatgatacccatctttttggtaaatttctcatttatatccttaattgtctttctgatttttttgtgttgtttttcagatcactcttgtgtctcactattattagtatcaaaatttttagttatttttctggaatgtgaatttcttttggatgggatctgttgctgcagacttattgtattcctttggaggtatcatattcccttgctttttcatgtttcctgtgtccttacgttgatatttgaacatgtagggtaatattcgcttcttccaattttagaatttgttttcataggggaagactttttcctgaagatgtatccatgctgttggttgggtaggaccctttggctttgattctgggtgcatgtggtagtcactgtatagtgtagtcactgtatgatttctttggctgtaaacagtatcggtggtatctgtgatttctttagtggcttagggtactgttattagtagaggctgtaatgaggttttctggggacaaggatgccacatgggccactctttgggcctaatggtggtagtggtgggctgagtatgtctgtccttgggccccggggttgcatgtgctgacactgatgttagtgggtccaggtgagtaaatttaacaaaagaagtataaaacttgtattgtgaaacaaaccattgaaaaaagaaattaaggaaaatccaaataaatggaaagtttctaatatttgtgaattgaaaaacttaagatggcactgcttgcctgtattagtctgttctcacgctgctaatgaagacatatccaagactgggtagtttataaatgaaacagctttaatgaactcacagttccatatggctggggaggcctcataatcatggcagaagatgaaggaagagcagagggacatcttacatgcagcaggcaggagagcgctcttgcaggggaactcccctttataaaaccatcagacctcctgagacttattcactatcacaggaaccacacggggaagacccacccccgtgattcaatttcctcccactgggtccttcccacacatgtgggaattatgggagctacaattcaagatgcaatttgggtggggacacacccaaatcatgtaattcccaaattagtctaaagatgcaacacaattcctgccgaagtccaagctgtatttttatcagaaattgacaagctgatcctaaaatttggaaaatatggaaacttaagggacccagaatagccaaagtaatctaaacacacacacacacacacacagacacacacgaaaaaacaaaaaaacacgccagtcacattggctcagacctgtaatcccagcactttgggaggccaaggcaggaggatgacttgagcccaagagttcgagaccagcctgagaaatatagtgaggcccccatctctacaaaaaagttttttttagctgatggtggtagcatgtgcctctagtcccagctacctagaaggctggggttggaggatagcttaagcccaggaggtggaggttgcagtgagctctgatcacaccactgcactccagcctgggatacagagcaaaactctgtctcaaaaccaaccaaacaaacaaacccacaaaaatccagaattggataaatcatatttccatctttcagaagttactacaaacagccttgtaatcaaatacagtgtagtacttgcaaaatgattgtcatataaatcaacagaatagaattgagaatccagaaataagcccaaaaatatatggtcaattgatctttgacaaaggtgccaaaataattcaatggtaaaaagaataatctcttcaacaaatggtgtcgaaacacctgggttcacatgtaaaggaatgaagtagaaaccctacctcatattgattagtatacaaaaattaatccaaaatggattgaagacctaaatataagaggcaaaacatctttaaaaatagatgaattgttcaacatcaagattaaaatgtttgcttcaaaggacactaacaggaaattgaagacaaaccagagaatgggaaaaaatatttgcaaatgaaattttcagtaaagcacttgtgtttaaaatacataaagaacacttacaacttaacaataaaaaacagcccactctaaaaataggcaaaagatctgaatagacgtttctccaaagaatatatgcaattgccggtaagcacatatagagatgttctgcatcataaggcatggagggatccagatgcaaatcaaaaccacagtgagattgtcctttgtacccactacatagctctactttaaaaagtcaggtaataacaagtgttggtaggccaggtgcggtggctcacgcctgtaatcccagcactttgggaggctgaggcaggtggatcacgaggtcaggagatggagactgtcttggctaacacagtgaaaccccgtctctactaaaaatacaaaaacaaaattagctggggcatggtgatgggcgcctgtagtcccagctccttgggaggctgaggcaggagaatggcatgaacccgggaggtggagcttgcagtgagccgagatcgccacactgcactccagcctgggcgatagagcgagactccgtctcaaaaaaaaaaaaaaaaaagtgttggcaaagaggtggagaaattgaaaccttcaaatgctattggtgggaacgtaaaagggtgcagctgctttggaaaacaggatggcatttcctcaaatggttaaatatctgggttattcagaaccttggctctgttgtatcaggagtatttaatcttgaatatttatataagtatttatgtatttctttattactatggtgaatatatcttacctttcaaataatattgaagcaagttatttccctgacccctttgcgggaccgctttgccacggggtgcctcctttaatcagcctatagctctcaactccttgtgggagggagcacacgagcgaaggaggcgggaactgtagtgcaggagcactggaactgaccagccgttttggcgccagtgggatcaaactccactcatttgcacctgttgccttccacacctcgtaggagggagtgcacaggtgagtgggtgcaggaaccagagcaagtgcttttgggcgccagcaggagcgaactctgtgcaggccccatggcagcatccaggaggggtgcctgtgactcccaaagccccagagggcatgttacagtgctcttttagctctgctctccacaggcggcttaagtgttaacagctcagttggcctgctgctgccctccaccagcgagggcaaagggccagcgtaacaaccttttgtatccacacacatggctcctgaactcttgtctggtgtccaggaaaaatgaggtcacacgaactaattgaaggatggtaaatgcaggaatgattttattgccgatgaaagtggctctcagtgggaagagaggggagctgaaaaggggacagaggaggggtaggtgatcttcccctgaagtccggctggattttctccggttactccatcaagctgtccctctgaagtcaagtcccttctctccaacattcagctgcttctcctctctgctgattgagtctggggtctttataggcacaggatgaggtggggtggggccatgggtagtttaggaaaaggcaacatttgagctggaaaacagggagagaagttctcactttgggccacggtctcaggcttttcagcttgagggtggaacttcaccagggacccacacctgtctgcctagaatttctctgcctcctgtctctatcattgtatcaatatcaaacaatagttgttggcctacatgtcagtaatttaaagatgaattaaatggttatatatgataacatttatcagagacctttagaaacattcatattctttggtctactatttttacttctagaacatattccaagcaagcaatgaaaaatcgctaattcaacatataatattttgtcagggaaaaaataaattaaaggcagttgggcttggagatatccatgtaaacaatctgtacttataagggaaggcagagttggaagtaattaaaataatgtaataaatgcattaatagaggtgtcatcaaccagttaaatctatgagaaagaaagaaaggcactcaactgcttgggggaagggaaggatctgggggaagatgaaagaagttcctcttgggggagatgactgatgagtcacagcttagaacatattttttagtatatataagccagaacttgcctcaaaattattgtataaataaatgaggaaaaacattagaatgtggtagcatgggggagagcacctcagtcccccaagtagctgagactacaggggcatgctaccatgtctggctaatttttatattttttgtagtgacagggttttcgccatgttgcctaggctggtcttgaactcctgggttcaagccatctgcccaccttggcctctcaaagtgctgggattacaggcatgagccaccgtgcccagcctgtgatttcaagttttatccaagcaatattttttgagagcaatataagatttgagactgggtgcgtggctcacgcctgtaatcccagcacattgagaggctaaggcgggaggatcacttgagcccaggaggtctagaccagccctggcaacaaaaaaaattttatatgattagccggtcatggtgatacacgcctgtagcctcagctactcaggaggcccaagggggaagatgctttgagcctgggagattgaggctgcagtgagccatgattgcaccactgcactctagcctgggtgagagtgaaatcctggaccccgtgtcgaaaaaaaaaaataaagatttgagataggtaagcttttgtgtacaagagagtttgtgctacattttgttttctttataatgtttgttttggttgatgcaaaattgtttcatcttagatgcttgaggtggaaggagggaattgttttgtagtattcatataattgaaattaccaccctatatttttctcctcaaagaaagaatatggtgatgaactaagaatagaaaataataactacatatggatgcataataagaaataattatatacgcattgtttgacgttttccttctctgctataactcaccctttttcctttgttctaccaccatatgttttgttctggatttcttgactaagaaaacattccaccatagtttattttaatatttaaagagcactttgaaagtttgatttttttttttttttttgagacagagctcactctgttgcccaggcaggagtgcagaggcacaatcttggctcactgcaacttccacctcccaagttcaagttattctcatggctcagcttcccgagtagctgggattacaggcacgtgccaccacgcctggttaatttttgtagtttaagtagagacggggtttcaccctgttggccaggctgatctcgaactcctcacctcaggtgatctgcccgcttcagcctcccaaagttttgggattacaggcgtgaaccactgtgcctggccaaaaattcaattttaagtaaatctgtttaaatgtttttgtgtaacgttttcataaaaatgaaaaattcgatgaacttagaatatgccaagaatcttctgcacaaaataataactttgtgttctcaaatagtaatataaagaatctgtaatgtatcttcattaagaatttatacatgcattttacatcataatctcttttattctatgaatagagcataatactaaattatgaagttactggaatttttataggaacatgataagaatcatgtggttcttttaaagagttaattttggaacatcttttgttcaaaaaatagaacattattatatgtattcttttgcctctattgtcagtttttaggataggcttttaatcttgaacatgaaaaggacatcagtaaacaaggtgagttaactattacatttatgcctattataggcttttagtttaaaaattacctatggcttaaatacagagaaggcagacagaaaaagaacctttttttccctgagcattttaaagagaatactacagtaccattaggggtttataataaaggactataattctatttagaaaactgacttacagtacatgacaaatgatagaaaattgaggtaagttttttgaagtcatattttatatttattttttatttttcattaatttgtcttttgccagaattaaatgttatgatcattaaactacttctcttcttaggtaattttttcacttagtctttctacccctctacctttaaaaagtatactgaacaaagcagcaaaagatattctctttgaggaaaataccttattttctgtgaatagttttttaaaattaaaacataatgcataaacatagaaattcttttacattggcaagaactttttccttgataaaattatttttccatttgaaaaattattaggataataagtcaagataatgcttaaaaatgtaaaaattttctgcaaagaatgtaaaactgtcgtaagtgaagccaacaggtaagccaaaaaaccagagagaaaatttgcagttcattttagtcacaaaataagggatgcccttcatatatgcagaactcttacaaatcaatatgaaaatgaacaaaagccctggtaaaaaaatattcagagacagtttacagcaaaggacatgtggctcctgcacatatgataaaaagtgctaaaagccacacacacattcaagtgaaaatcatgatgagatacgattttccatgcacattttggcaaaaatgaaaaatgtgttaattccgttttgttttgattttatttatttattttttttgagaccaggtcttgctctgttgcccaggccggagtgcagtggcatgatcacggctgactgcaacgtcggcctcctaggctccagtgatcctcccacctcaggctcctgaatagctgaatagtcagcatgcccagctcctttttgtattttttatagagacagggtttcaccatgttgcccaggctggtctcgaactcctgggctgaaacaatccacctgccttggccttccaaagtgctgcaattataggcatgagccactgcacctggcctcttcctaagattgtagaaacgtaagctctcaaacgctggtgggagtataaatggatataacaacctccatggagagcaatttgacaaaatgaatttatactgtgtgttatgtccacctgtaggagatgtgcaagaatagtcatgttagtattatttcttagagcagaagactggaaagaactagcaaaaggtagtgaaaaggtagctcactccaaaagttttgcttagggttccagagttcatagtaatttcatttgtcctaaaacatcacaggactattttaaagaatactatgtttctccctgctattggtttaaggaagaatgtctaaaagtaacttactgtaccagtgtaacatggtatcaaactgcctgtcagactggaatagttaaataaatatgatacattcataacattgaaatactgtgcagcctttaaaaagttgagagtgtcttctatgtgctgctttctttttttttaagacggaatctcgctctgtagcccaggttggggtgctggggtgcagtggcgcgatctcagctcactgcaagctctgcctcccaggttcacaccattctcctgcctcagcctcctgagtagctgggactacagatgcctgccaccatgcctggctaattttttgtatttttagtacagacgtggtttcactgtgttagccaggatggtctccatctcctgacgtcgtgatccacccgcctcggcttcccaaggtgctgggattacaggcgtgagccaccgcgcccagccctgtgtgctgctttatcaagtgacagaggcaaacgacattcattggcataaaaaagaatgtgtgtgtttgtgcttgtgatatccacagaatatctttggaaggagccacaagaaactgggacccatggttgcctgtgagttggggagctggagggctgactccataacaagtgagaaggatacatctcttagatcatatctttttagtattttttgaattttgaaccctacatgtgtattacctattttttttaaaaaacatttcaaaattgtgcagtggaagggtctgtaagatggagcagtgttgaaataatggagccttaattacctttcaagaaacttctgcagtgacttggccatccggggaagcaatcagaaaagcagctggctcattaaatggagagtgctggtcccacaggtgtaagtacacaaaacgcaatcactgaaattctttggctagcacttccaactcggagacagttgctggagatcacttaataggctctggttacaggttgatctaatctgaattaagaaattggaaaaagcaaagaaagagcagtaacataggtcagagtaaggaagctgagtccgaacagttcctccacagcctcctgtttccccttctgtaggtgtatgaactacccagagagattactgtgaatgtagaatagttggagagatgtgtttcccaatagcaaaaggcagtgtaaaggtagttcactccaaaagttttgcttagggttccagagctcatagtaatttcactcgtcctaagacatcacaaggctattttagagaacagtatgtttttccttactcttggttcaagcaagaacatccaaaagtaacctgatgtaccaatgtgactccttatcccaagctaaagaatatcctttcaaggcaaattcatccaaatcagcttgacatctgatgggagggggttggataaacaaggttgtagagaaatcaagtctgaagagtaaccttgcacagcttgatctgtttactttttaaatgcaggtttgttcagtgggtatcgcactctacttttgaaacataggactaaattttcacaaaaatgtgaagatcctgcccgtgtactctggaaaattgcttgtctaattgggtgcacagctgcacctgtaccctcttgaatgactcagtcatggtgtgctcaagggccaagtaacttgttatggtgctaagtgaagaacaaaaatatataaaattcagttactttggcaatgaaaaacactgaatggtattggttgttatattacagttggcaaatactgtaattaagacttcaagtgatttttagtattagccctggattcactttctgaagaattttatttagaataaaactttcagcgttgataccagatagtcacctttagttcagttcagtttcataaatctttataaaatatttatagtagtcaaggagcctattacgggtgctagtcaggtttctgcaacaacaaaaagtaaattaaagttggctgggtacagtggctcacgcctataagcccaacagtttaagaggctgaggcaggaggatcgcttgagcctgggagttggagaccagcctgggcaacatagtgagaccctgtctctacaaaaaaaaattagccaggcatggtggcacatgtctgtggtcccagctactcagggggctaaggtgggaggatcaagtgagcctgggaggtcaaggctgcagtgagctgtgatcgtgccactgcactttagcctgggcaacagagtgagaccccatctcaaaacaaacaaacaaaaaatgtaaaactcacaaatttaaaaaagttttaagaccaggcgcaatggctcacgcctgtaatcccagcactttgggaggccgaggtgggcagatcacctgagatcaggagttggagaccaatctggccaacatggtgaaacccagtctctactaaagatgcaaaaattagccaggtgtggtggtggtcacctgtagtcccagctacttgggaggctgaggcggagaatcgtttgaacctgggaggtagaagttgcagtgagccaagattgcaacattggactccagcctgggtgacaagagtgaaactccgtcttaaaaaataaaaataattaaaaagttttaaaattcactttggtatgatattttgacccctcaaagttgtttataaatagaatgaacagtggagccatctgttaaaatgccttggctgagtgactcagctagtagatgaattttgacatatttatagcaccatgcattgatcattttagttgtaatataacagctgtttattgagtaccttttatgacataggtcctggagaaccagtggtaatcaaaagagatgatacatctgacttctcacagtgtcatctgttgagggggacaaggatgaaagctgtgtcagtgaaggaggaaaattgagtggtaacagggagggcaggtgctgtggtgagcatgtatgtagcggaggccccgaactgaacacggaggtggttaggggaggcttaggaaggaaatactggccaggctgagacctacacaggaggtttgggggagggtaggggaaggagtcagagtttgaaggcctacataaaaagtagatacagctataaagaacgagatcatgtcctttttagggacatggatggagctggaagtcattatccttaggaaactaatgcaggaacagaaaaccaaatgccgcatgttcacatttataagtgggagctaaataacaagaacacatggacacaagggaacaacacactggcgcctaccaaagggtggagggagaagatcaggaaaaataatggatactaggcttaatacctaggtgatgaaataatctgtacaagaaaccctcatgacacaagtgtacctatgtaacaaacctgcacatgtatccctgaatgtaaaatagaagttaaagaaaagaaaaacacacacacaccaaaaaaaagcagaaagagaactaagaaagttaattgtgtctgaagcaagagagaagttgtgtatgactgcagcacagaaagcttgaagtgtgggacctggtggcaggcagggagggggaaacgagtggtgagatgggaggggcaggccccaggggaagcagctgggacccggccatgtgaaagtgccagccctgaacctggtctggatgtgtgtggagtgcagtggagagccacagaaggcttgcctgcagggagtcggacagagttgcctgtttgggagatcactctgccttcatgatggagaataggtttggagaggcaagactggaggaagagggcctgctagaagcagtcatgcaggtgggcgctgtgagcctcagctgcaagtattttggagaaaaaatggatcaacatggaagagatttaagatgtagaattaaccgtgcatttattgagcagtaataatattagctaatatatattgcatatttaatatgtgtcaagcactgttctaagtgatccacatgcaatatgttatttaacaacaattgtagtcaacatgtacaatctactttcatttctattccaatcctataaagcataagtactattattagtcctatttttaagtataaggaaattgaagcatagagaggttacgtctagagaaataggaagacaattttagacataattttgaagggatctgtgagatacacaagtggagatgtttcctgggtcattgcatgtgaggttctgtggcccaggagagagtttgggggagattcggtctccagtagtataaatggcagttgaacacgggttgaattgaggagaaagtagaaaagggaagaggaccaagaaagatgaaaccttgaggtatgctaaagatttaaaggatgggcagaggaagaagaatcagcaaaggatactgaagaggagcattgaaagagactgtgtcagaaaacccaagaagttgtgttgtttcagaatttaaaggaagaggctgttttaagaagatgaggtcattgatgccagtgaatgtaagaagtcatgttaaaacaaaaaaaacaactaaggctgagatttatccattggatttagtgaaaataattgagaacaatttcagtgttgtaatggggccagaaatgaaattgtggtgagttcagacattgagatatgcggacaagtggagtgaatgactcttctaaaggcatggtcgttaagagtgggccatggtgttgaggggattgactttttaaaggtttaataaattcttaagtgctgataacaggtgccagaagaagggaatttttgatgattaaagaataaggagaaaaagaagaactaggagaagggcctctgtgcttttttttttttgaaatggagtcttgctctgtcacccaggctggagtgcagtggcacgatcttggctcactgcaacctccacctcccgagttcaagtgaatctcctgcctcagcctcccaagtagctgggactacaggcgcacgccaccacgcccagctaatttttgtatttttagtagagacggagtttcaccatgttggccaggatagtcttgatttcttgaccttatgaaccaccacacccagcctctgttccatttttatatgaaaggacaaaggagcgggtggagatgaagggagagttggtgacttattcacctgtgatggctgctgtgggggaagaggtgaggtgagactgggaggagttgattatggcattagaaattggaagtacgtggaatgttgttgaggctgggagcaagaattgacttaaacacaacagaagggctaggctaaccaagcttccatttgaagtcgtggagcaggagttgatggggtatcaatccatgtggtcagatagtgcaaggcagctctgcatgtccaggaggccaggacacagggaggctaggcggagaggtgccagtgagggaggtggagataggcagatcctgaagggcctttaaactatgggtttcgattttattgtgacattattcattatctagccagcttttataggagcagtttataaagtatgttctagggaatactattgatcaacacgtttttcaaaagtctaaattgtgttcaaattggtgtcttgtgagaattaatagaatacatatttagatcactttcataaataaatacattaacatcatattttcagtaagctcatatttgatatctaatcaaattcttttagtcatgaatttgaatgagaggttttttgggttattgttactgtttgttttgtcttctgtgtttttatatttggaagcagaattagcttttggtctcttaagtgaccccttagtcacttaagatggtgttcatttccatcattgtgcttatcatgcacttgagttctcgtgtttatttctttgtccacttgtttaatttcagcctcttcacactaaaataggagctttgtaaaggcaaggacctagtcttgttcactgtcacacttcttgtacttctcaggaaatattcattgggggcagggtagaggagttggggaaggaaggaaggaaggaagagagagaacagtgaagcgggaaggaaggagttccaaaaactgcttccctagtggtcatggaaactctttaataaattagaatgttgtctccaaaaaatacaggcagatatgcgttgacaattgcctttcatacaccttaacaaactagttacataatgggatatcaaaattcagtcaatgtgtttgctagtttaatttgttgtgattaaagaaaacaatgattttatttataaatttagcacctaggaaatgtgatttcaaatatcaaagcataggcattttttactctttttaaaattgaagggtcaacaaaatctgccttattcttcacagttttttctctgtcagtaatgtagcagtgtgttaatttccagaaatttaatctcttctataaaatttcctgtgacctgaaaacttttgaattggagttaatttaccaaactgtcatggaatgcctgaaatttccttggggcagaggaggtagcagagaggtggtaagttaccatgtttccattgtgtgaataactgataagtgggattccaaacagaatccatgtagcgttttaatgaattcacatttggagaaaaaagtcacagactttcaaaacttacaggaatttggctgtcctagggcaactcctcacttaacagcaagaggggatgagaaggttgagtgactcacccagggaagtgactcacccagggaaggtcaagtgactcacccaaggttacttggtaagtaaagagagaagccagaagcctggggcctcctgacggctcctgcttctctttttactaaggtcttctgccatgggaagaaactctgaatgttagcaaccatctggatggtgttagttgtatgtctctctatgtatgttgaaaagaaaatgttgaagaattgaatttctcctgcttatgggttgtgtcacatttaatagcgttctttaagaaaaaaacacgattgctcaatatgattatatgagctcaccataaccaatgacaggcagaaaatcctgggaggatagacactaacaccacattatcctgttgggataatatcccaaattctgaatataactttcttttaccactttaaaggccaaaaaatggctgttaaatggagtatttttgtcaaaccaagtttttaaagttttcagcagctgcttctgctggcttttattaactactgaagagtctttttttttttttttttttgagatggagtcacgctctgtcacccaggctggattgcaatggcgtgatctcagcccactgcaacctctgcctcccgggttcaagcgattctcctgcctcagcctccctagtagctgggtttacaggcgcccgccaccgtgcctggctaatttttgtatttttagaagagatgcggtttcaccatgttggtcaggctggtcttgaactcttgatctcatgatctgtacacctcgggctcccaaagtgttgggattacaggcatgagttaccggaccctgcctactcaagagtcttaattgaacatcaaaatcctggttttgtttataaggaaaaaaagttaatggtgcaactaggactaattctttgattaattttttaaccacttctacttagcaagtatatgaaacacattaaagactgatgcatctgttttgtttttgttttgagatcaggtagaagatctacaaaactagttggaggctggaaagaaatttcagatagtgatacatagaaatgttctgccttaactctgaatttttagtcatgaaatagtgcaaactcttaacattacttttgtggagctttgtagtccataaaaataacattgttgtagagcctctgtatgcgtcagctgtgactgagtgttttgatgtcttagcaaaaggcagaggagtgctttcctttgaaatgtgtgaggcggtttgagatgcagcttctcagatggatttaattagtccttcgtagaactggatgtccgtttgttgcaactgaattctcatttcattcatccataactagaaacacctcgcttcaaacgggtttcttcaaagaaagaggggtttagggttctatgttgtactgctttttgatgttggtttccctttaactgagaagaccttatgtttatacaactgttattattaagaaaacacagctttcttcagcgaggttccttttgcatcagcgctggttcttggtggcagtcagaggtctgtggaatggatctctgtcagactatcacagcagctgtgtgtttgcagattttgcttatgagaggcatgaactgaaaataggcgtaaacttgagtaattccctaaacccaaaatataagatagaaaccagtaactgaatctggtaacagggtagttgtttgtttcagaagcttatattaaccacaaaaacaaagtgaatcaactaacaagggttaccatgacccaaatagtaattgcattttgattcactttgcctacagtgcacaggtcaggtctgcttctcaataaatatgttgaaagaatgaaatatatccttcatagtaaaattatgttttttaaaaaatatgtcctactactaatattttttaaattatccctaaaccttcacatttcattagaatagctacttcaatttactctgaaaaaactgctttcttgtctttccagtttgtgtgtccagggtctgacgtgctccatcatcaaggcagcttttatcttctgtgtccgtgattctaattacatttcagggggttgtgatctctcccagaatcccgttcatgcattgtgtttaggatgaaatgcttgagggggtttggggctgtacactcatgggcacaggtttgcatatctaaaactttctttgctctaacatcctgatttgtataaaaatcctaaaagcaaatttcagacttctaattattctttgcctttaaggaaagacaaaattaatttagactgttcaagcttaaaattatcccaaagccacagatcacactgaaaacacatagtaatatagcccacaaattattttggtgtcttgtttccatattccatccaagagtctgtagaatctgtaggcttatatttctgtcttgtttcttagccataactgatcttttccatcttattcaccagactcagcactgcgtaactgtggcaatttctgaaactcagtggcaagggatataccaccattgaagagattaaaaataatcaacaaaggctttaaaaagtttaaaaaatgtatttggagcaataatagcaataggtcagaaaaagttttcacggaaagggccaatatacaattaggtttccatctctgtattcttgattgtgtgttttatgtcttgtgactatcttgtggagttcctaattttaaaagaattatgggtgtggctcaggaatattttattacatttgtgtaaattaaataattttttaaaattatggatgtgatttaaatattcttttagtggttctgcctttggtacagtgttccatgattttgtaatgtttttatttgttgaaaaagctctaaaaatcttggtagaaatatagaatctcagaaggcagaacatttggtaattatcttttatatcaatttgcaagacaacttgttagggagccctatttctagtagttgaagttaataagtaacaaatcacagcaatcacgttttttatcatgcagagtgggcagtcttataaaaaagaaacgtcagtctttttggatatagggacacaagcaatcatagttttcctctgttatctttagtttgtaaaaatcaacctatctaccatcagcatttacccacaaggtttagtttggagttacctaaggggatggtagagaaacaataatttaacgttatgctgaaaacaatagtctctgaagatagagaaacctctgtcacttaccagttgtgtaaagttggaaaagttacttagcctccctgaaccactgcagcagtggtgtttacctgaatgttggcatagaggaaaaccaagggtcacgaggcaggtggacttgagtttaaataccaatcctgaacctgctggctgtggaatccagcagaagttagttatcttttcttagccttagttttccttatctgtagaatagggatagtattctccagggtttttgtaaaaattaaatgagattttatataaaggctctagtacagtggctgatgtaataagcaccccagaaatgatttctcttccctctaaaacacggatattttgctttttaaaagaagctaaagtagcttttactttgcaagcagttcttttccattgtatgaaaaattcttggaaagttttaaaaataagacaaaagggagccacagtggcccaggcctgtggtcctggcacataagcagccgaggctaggcgttcgaggttagcctgggcaatatagaaacctcttatctatataataaaaataagacaaaaaataaaatgtgccaacatatattagcaaggtttgtcagtactgattaatatttttacattctaatattctttgttagaattgtatttattttatgaagccccttttgaatctacagcagactacctgggaagtagttatagaggtcatcatcgtgtcttggtgattcactttgggaaattttgttgagtgaggctggtgaacctagaaagctgcttcttctgcctccccatttctgtccccaaggccctgctgtggttcaaaagcccatataaacctgcagtttccctttcttccacgatagggcgcgcacctacactgttagggtatggggccgactggctcctgccctgtgggaggtttgatccttgtccatttagaggcccttccttattcatggacactctactgagtgtctgttgcaaactccctggtataaaccccagacgtcatggatttaccacactaattattagagtggccattatttgcaataaaatagtgacccttgccactgtgttttcctaccaaataaacttactgacaagtatctgcattggctgggtcgaggtgtcatcaaatcagcctaggtttggatgtgctgttttgctagctgtagacccttgagcaattatgtaacttctctgagtgtcagatttgtcatctataaaatgtggttagtaacgtctccattgtaggatcgttcctaggattctgtgagtgtgatgtatattaaaatacctgattgatattagggcctcagtcatgttcctttctttgctttagactcatttctctgaaaaagtaatacgatgtttatagttggggaaaaaaacccaaagagcgttcataatctggatattaccactattgaaatttctattttgattcagtgttttttttgaaggtattcttatttttaagagagggaattataaaatatgccattttctaactcagtgtttaaaccttaaaaaaagagacatttcttgaaatgttaaacctatggctttgagcatggctgtgtgtggctgtatttgctcttggccatatttattgtggcagcgtggtaatgggtttatgcttgttttatcgcttgtggtttttataaaataaaaactgtgtttggctgtgtgactgtcgttcagaacaagattaaggaaactagatggagattaaacatagcacaatcttctgttgtaaataaccatagacaaacttgtgagcagctaccaaattccccagttggacaaaaagtgcttctttttagctttgaaaacctagtgatgatgatttgagaactggcataagtctctttaatcattcaggttcagcgtgattagaagaagagttgttttaaatgtttttgtgattagatttgaaacaaagcttagaaggatttatgattttgtttacaaccagctacgaaaaacaccaaggaaatgtgaaagctggtagtaattggtgagcttgctgggagtggatgttgtttccagtagtgtaacttaacaaagattgaaggaagctccgtgccattttatttcataccactggtttaggtgcattaattgatattttaaccaaaattttaatctaaatcaagtcttttaggttcaacctattccactgggttttaaatgatcatatatgcataccacagcacatctcacattgagaacgttacctcagtgggaaggttgtttcattcttggttgagtatagcattccagcttgtaattaagctgcaatacaaaaaatatacgcacttgctagaaggatattcttgctagcattctgtatgtatcatttgcttattcaagcatataaaacttcaacaagaggaggtaattttgcttagatctcttgatttgaattgttccgctatttggcactgggtggaaaagggaaaaaaatcatattgaaagcattgttctgttaatgaagttgcttgtccttttttgtgccaaatttggcaggtaaaattaccatttattctacttgctagagctggagaatagactgttgaggaaaagtagcaatttaagtaatgacactagatagaatgtgctacattatatacatctcccatacttttagatattgacatgcaatttttatttctctttagtaatgcactttgtctttaaccactacattacttcccgtaagctccatcaactacatgcaatttgcttcagttgtgaaatttaaaaatttactattaattataataaagtgaagcattttgattcaagaagaaattaaagattgctgtattttgttctggatatttcagaagtattgtattctttttaattctgaatatttaacataaaaaagatgaaatagacgcattggttaatttgaagaaatacaatcaaatttgaggtattcatggttttttccatgttaaatatgctttgcctatttatatttgccttaatttttgttttgtagagtataaaagagaaactttaaactcgtatacaaaaatgggaaaatatctaaaaatatgactaggtagttttaaaaattactcacgtattcaaatgaaatgcataagtttagcatttgctaaatttgagatattttatttcatattatttgtaaatatatttttgtttggcgtgaatttgtaattcactaagtttcttgtagattaaatttttcttagttgtaaaacttcaggcttaaaaaaagtattattattgttacaatttacactataatggctaaacttgcccctcctccttaaaagaaatataaactaatttgcaaaaatatattttttgaaaagccaattggtgaatttgtagacttgtaaatgttaattcaggaacagagttgagtattgctggaccttctaaccatcactcatttctttctgcccactaaactaactggtaggcaggtgcagatgttacaaaatctagcatcgcaattgacactaattggcatagttgttggcagtcttatcagaaagcaaagggctgaatggttgaatgggtttagagaacttgaatggtaataagcatttttatatgcatcttgaattacttttgtgacccagactaacaggaacactttattctgacctcattcttcaatgaatagaaattgtagaaagcataatatgcagtgtatgtgatgactgattgtttttcaggtaaccttttacagctatctgctctgttgcctacttcctccccccactacctcccttcccagtgctcagagaaaccaaagtactgtaaatgtgtggaataaaaaggagataacaatcattaatgaatattgaattaatttatttgagtggtttgttgccaaaagcttgaggatgtcataagagttaggctaaacttaagaaaaagtattcattgaatttatggatgaaacaaaaggacgactgggacttgcttcttaatagtcttggagcaggtgggtgaatcagtggggatatggataaaacaggattggctttgagtggataagttttgaacttgggtgatggatatatagaggtttattaaaccattctttctgtttctatatatgtttgcaattttccagaacagaaaggttgtttgtttagtatgcggggtgacttcaccctctgctgttgtcaggttttttcaatacctgccagttcctttccaggatctgccttttctcccccagttccttttatcaaaaagtacccatctaaagtgagaactacatcacctgacaagctgttctgtgcgcttatgtataaatgagttattttctaggcagtgtggattttaataggagttttctaaagacactgccttaattaaaggaatggctcttgggttgggaattatagtgttggggtgggtctttgtgtctatatgtgactatatgtagaccactcttcacacttacagaagtgttaggtgataattttaggtgtaatatgatgattgatcttagttctttttagttctttttttttttttttttgagagttttgctcttttgcccagtctggagtgaagtggcgtgatctcagctcactgcaacctccacccactgggttcaagcgattcttctgcctcagccccctgagtagctgggattgtaggtgcccgccaccatgcttggctaatttgtgtatttttagtagagacggggtttcaccatgttggccaggatggtttcgaactcctgatctcaggtgatccacctaccttggactcccaaagtgttaggattacaggcgtgagccaccggcatggcctcatcttagttctctatgttagaggtaatgatgtctttttcttctgtagaaagactttccaaaaagaaagtgcttttctttaggactttttagaatatgttcaaaatactgatctttgactaaggagaggaagagaaaccaagatcatatttcagactattgtttcttttcccatggttttggcttatcccgagaattgacttgacgtgttcccttttttatttcaaagtagcattgcttgaaatattttagattttttatagctttctaaggaattaaactctaaaaacactttaactgtttttttgttgttgttgcttgtttgtttgtttgttttgatacagagtctcactctgttgcccaggctagagtgaagtggcgtgatcttgactcaccacaacctctgcctcctgggttcaagcgattctcctgcttcagcctcccgagtagctgggactacaggcgtgcaccaccatgcctggctaatttttgtatttttagtagagatggggtttcactatgttggtcaggctgctttcgaactcgtgaccttgtgatccacccaccttggcctcccaaagtgctggaattacaggcgtgagccaccgtgcccagccaactgtttttttgtgttttttttatttttttttaattgtatcttgggaggccttcatgagtgaatgtagcttgctcattattttttgtaccattcccagtcattttctactcattcctttccttactagttttcagtttggccatgttctgtgtacaatttctggtaagtgctaccaaaaccaatatatattagacatgctgtttttcaagactcctgaaaaagtgccaatcttattctcctttcagtttgggagcacagtttcacaaataatagaatagtcttactttgtttgcagaattagaaggatttatctaacaacttgaatagataattttttttttgtagacgtgaaagtgaaaccttagtattgggatagaattttaagtagcattttaaatttgtttcaaaatcttttcttattgcctgcctttcattaaatgagctatggtaagtatgctggggtgtatacgtgtgcgtggtgatgagatgtttacctctgtgtggatcccttgtagattttgtattgtaaaagtgcataatagagtcctttatatagctggaataactgtaatctgctattgtaagcatatatggatttttaaatacaaccattataatactttataggacattacaactgaaaatattttgacttaaaagttgctttattagtcttacaaaagctatgttgaagagttttttgttttttgttttttgttttttttttaaagaaccatgttgtcagtggtcaacaatcaaatgtaaaaaacacttagctggaaaacatccattaagataatgaaagtgagccacgatgcttgtgtcagtttttatattttagtttaaaacatagttttttagcaatcctataattataaatataagttagattttctctctaatttaattagataatttttattttaatacaatagatacttatcaaggatctgtcgttcttcaagatcagggcactgtgctgagttcttcatgagggccatgaaggaataatgcccaccctcacgaacttccagcctagtttggaggtgttgagattaatacagtaatgattgtaatataaggcttactctgataagtacattgagatataaagtgttacagagattcagagcaaggaaagacccagccctatttagcagtgggcaaggggtggtatgggtgggtggtattggtaggggcaggggggatgaggcagaaaatcaagagcaaactgaacaaaatgaatagaataggtgtcaggtcatggaagatggatggtagaattctgttaggctgaattggctagtccaaatttaaaaaatagtaggactaaagtttaggatatagtgcctgtgcacatttgctgaatgtaagagaaagtgggaagaaaaattgaaatgatagttagattgtgaccattagtacagaagacccagaggaccatgtggagaacttaattttttttttttttttaattaagcaaccagaagccaagaaggattttgaactgagaaaacttgtaagacacagtaaagccacatttgtaactggtctatcgaagtgaatacaactgtagcaggttggagatggggctttgggaaggttttcttgtttgatgggattgtcagtagtaaaagaaatgggaaggaaaagagttcacattcagcttagaagttgagaacaaaatttggggagatagatgagagagatgtcaggtaatagttgggggttgggaagggccaaacaaacaacactcagttattggcatgtgtgttaggccgtttctcacactgctgtaaagacatacctgagactgagtaatttataagaaaagaggttttagttggcacatggttctgcaggctgtgtaggaagcatagcagcatctgcttctggggaggtctcagggagcttccaatcacggtggaaggccaaagaggagcaggtgcatcacatggtgagaaccacagtgagcgggggtggggatgtgccacacacttttaaatgaccagatttcactaaggagatggcccaagtcattcatgaggaatccacccccattgttgcaggactttttcttggtttagctaaggatggggttctttgtcccatggccatgaaaattcaggcccacagacaatttgaatggtgagtaagacagggttttattgggtgaaaaggaaaaaaaacgggggaacagggactcttcaaggccagagtcctgctacagtgcttcctgcctgcagcttgaatgtttggttccacacaggaagaggaggggccaggttcctccctgctgcaaacactgcgaacttcctgaggccccaccccagtgcgcagctggttggaatttttccaagaaccccctccctcccacctggctgtctcattctcccctctaaagaagtacatctaactgccattagaatacggataaggacaaagaccgatcttaactgcttcctgctgacaggggatgctgttttggggaaacagcagtcagagatccctcaaaggcctatctaagcgttcccggcagaaggggccgttgtcagagtctccagttgcatgaccatttggagtttgatggcctgaaggcaagaacagacaaaccgggttgttagaaaacatgtatcaaaaggaaaccagaggacgggtaaagatagctaaaaaattaggccttttaccagtttgcacagggagaaggaggccaaaagcccgactggtcaggaaaacttcacacttttgctggcatgttgggcttctgggttcccttcccctgagcccagtcctaagccaacccgtttaaggtttgggaaattaactctttccagcttggaggatgcatctgaggtgagtgtatcatagtatagagacacaattacctatttgcaaagagagaactgaggaggagaaagaagaaaagaaggcgttttttttcaaaggagtcctgggggtcccggatgcattcaaaaggcgtacaaactgaagatgaatggctacctatctagaaagaggggagcaggtgtccctggttcccttctcttcctagcagatactcagggttagtgagggagagaagagagagcatcctctttcctttcttctatccttgcatccctgaatcccagcaaccttggtaggtgctgccatggctgtcaaatcaacttgcaccggtgaagcagggggcctagggggtgagaatcatccactcttacccacgtaacgccctatctcccctgctgtcagtagctttgaattctgtatgccatggatactaatgtggcctttatccatgaaacaggaagccttggggttggcttaatcagcaggaatcagccactctcacctgtgctgtgccttttaaccttggtgttgtcatctgcctctggatcccttacatccagttttctttctagggctttgacccgaagcttggaattgagtcgggaacacaaatgtgtctcgaggggagttgtgtggactccttaccataagtggaatactaaggtgaaactgtggaactgagtcctcctccaacaagggagaggaaagcatgtcttgtgacacacccagataactggtgactgtagttatgcttgctaggatttgggtgcatggtgcttggctttggttcactcccttggtcttactttacccaaaggaaacctcggagtgatgggcatcctatttattcccatcccctggcaggatttacaggataattgctcagaactagaatattgatccagacttttacattacccatccctcttgttctttctgagctgcagccagagattgctggttggtttacaggaacaagcagggttagtctaaaatgtaggtgaaaacttaaaaacaactagtgagtttagaatttaatgacaaatgtatgataagttttggaacataatttctctccagtcctcatttttgttaaacaaaaaaaaattatgataggactgagtggtttgcaaagtagactttagtcttattctttgcctgaatatttgcataaaatgcaacaagaataattatttctacataggccttttggattggctttgatggatgtctattccacaaggaatctcagataagaccttttaagccgagcccagccatggctttctatcctcaaatacttgcgagttgggtggtcctctccttttaaggtcccaagctaaacttggagctcctggacctgttaggaagtgacattcttttttttttttttttttttgagatggagtcttgctctgttgccaggcaggagtgcagtaaatctcggcttactgcaacctccaactcctgggttcaagtgattctcctgcctcagcctcccgagtagctggaattaaaggtgtgcgccaccatgcccagctaatttttgtacttttagtagagacaagatttcaccatgttggccaggatggtctcgatctcttgacctcgtgatccacccgcctcggcctcccaaagtgctgggattacaggcatgagccactgcgccccaccagaaagtgacattacttactgaccacaggtcagtaaccctttacagggactgcgtagacaggggtatgaggccattttccccactgggctcttactggctctgcaagtcaagattcactcctttcacagtgaaagccttggtaaaataaccactttctccaattgtgtcctgttgcaaaagaaaaatggattcttactacactgatgcaaacaactattttgtcataagttaagaacactcacagatagtttccaaattctagaggaagcaggaagagagaaacaaacatgctccaaaccttcatcacagtagtgtataccttacttaattattaaagtccgtaaacagttcaaaattggccgggtgcggccgctcacgcctgtaatcccagcactttgggaggccaaggtgggcagatcacctgaggtcaggagttcgagaccagcctgaccaacacggagaaaccccatctctactaaaaatacaaaattagctgggtgtggtggcacatgcctataatcccagctactcaggaggctgaggtaggagaatcgcttgaaccgggaaggtggaggttgcagtgagctgagatcatgccattgcactccagcctggctgggcaacaagagtgaaactgtctccccacccaaaaaaagagaaaaatagttcaaaataagtttccttgactctgaaaaactaaacaaggatcagcaatattccaagcaaaagtcaaaaaggttgcttcaggtttctgagttcactccattaagttctcttgttttgcttgatatttgtgaacacttcagctctttatgagtcttgtactttttcctttattttaatgttacaatcttcaaagttattagaagcctgtatttgagaggacctgttaaaattctatagcttattataaaccatcttttgaaaaggattaaaacaagacaacaattgctgtgaatagctaaatatccagggtagttacagttagaaacacaactgacaaagaagttcggttatctccatggtttacaataacttaacataacaaccttaattatgattaatagcatatacttggacattagaattttagaaatcccatacaatttgggaacacatattagcattattcacaaaaatataacctaaagaagattgaacatcattttggcaatcccatgtaaactaaacatgttaaataatcctgtttacctctctttctggacattccaggggccctctggactatccgaaaagccagttgtcaggaaagacaattttgaaactgaagtttgattttgagaaggccgttaaacgttcaaggtttaaatactttgtgttataaaatagaattccagattaccataaattatttattttgccaaagtaatgactcagaagttttaaataagtaaaaaccttttatagccctttacgaattttgccaaagagcagattagcgccttacaaaaaccttgttgtgtttttatttcaatgctcaatctacagaaaaaccatattataccttttggaatttagtcaatatgttcacatagagaacctcttctgcaagattcatttccacaattcttccaccacttgtttgaaccttcagctttttcctaatttaaaactgtcctttaacctagacaaaaatttatatttccatgcctccttgtaaccttttgctaaaaaacacattttactgttcttacataccttgcatgtaaatctatttccagtagtcttaattacatgttataatagtaactcctagcaatttttaacttttttaaaacttggggctgggcatggtggttcatgcctgtaattccagcactttgggaggctgaggtgggtggattacctgaggtcaggaggtcaagaccagcctgaccaacatggtgagaccctgtctctactaaaaatacaaaaaattatctgggcatggtggcgggcgcctgttatcccagctactgtggaggctgaggcaggagaatttcttgaacccaggaggcaaagcttgcagtgagctaagattgcacgactgcactccagcctgggtgacagagtgagactccgtcttaaacaaacaaacaaacttgataagttgttttaattgtttaattgtgtgctaagtgctgccaaggtttgccttcttaattaagagcatggttatatgtccccagcccttaccagttgtgaagccagcaagtcaaatagttcttaaaactcaaaaagcagcttgtaacctcaaaatacttagcaaactttgtatctgacctgcattgtttagtccacctatttacattttgacaacatctgctctttaccaataatccttaaggctgtttttgtttctcaatgattaaagtcacgtgaactgaaaggtatcacagtttttatcttccctttaaaaaatattagatccaagtgcttgtctttgtttaggccaaattaattagagctctttttacagataccacacacagtatatacacagacaggcaaaagaaaacccagtcactgggtggggccctttaagagacagggctaggaagacatgcagatatggaaccagagagggctcatcccctaaggcaggattgctaaacaaagccttgccactggagttagaagccatgccctcaggatgtaaaacaagatggaagcctgatttcacaaccaacaccttgcagagaatacaaacagtgatagttccggggtgggggtctggcctagtaaagtgttttctaaaagagaaaaaacttaaaagttaactgttgacagggtaaagtaggaaaaaaacaacaacaaaacaacagcaggttaaaaaatgcctaggaaagaaccttttattctcatgcaagtggttctttcaccgaggagagaagcttaagcttaattactgtccgatggagttgaaacccttggctggggaaggggaaggctccagtggctcgtggcagaaaatgccagccagccaccccgggtgcccttggaccatgtgtccaagcctcagcagtggaggagggaggtagggagctgctgctctctggtccctcccaaaaaaggaagaaaagggctatggaaaggtcgggttggttctcaacccctgggagcagcaggcggtgggggcacagtttcctccaccctcagaaatctcaggataaaaaggcttaggagccacagtgaaaggttttgagtccccatttcactcactgcttcttgagccccacattgggcgccaaaaatggttcctggacttttccttagttcggctaaagatgaggttctttgtcccatggccagaagaattcaggcttgcagtttgaatgggagtaaggcagggttttatagggtgaaaagggaaaaaaagggggaacagggactcagcgaggccagagttcctgctagagtgcttctcacccacagcttaaattcctacttccacataggaagaggaggggccaaacggtgcagatggtgaggacttcctgaggctccaccccagtgcacaggccagttggagtttttccaggggccccttcccgcctggctatctcaccatgatcggaacacctcccactggtccctacctccagcagtggagattacagttcaacatgagatttgaacagggacaactgtccaaactatatcagtgtgtcttttagagttggccatttttgtcacccccactcgtttatttatttttttgagatggagtctcattctgtcgcccaggatggagtgcaatgacatgatctcagctcactgcaacctctgcctcctaggttcaagcaactgaacctgttgagtagctgttgggattacaggcatgccaccatgcccagctaatttttgtatttttagtagagacggggtttcaccatgttggtcaggctggtcttgaactcctgacctcaagtgatccacccacctcagcctcccaaagtgctgggattacaggcgtgagcaaccatgcccagcctgtcacccgtacttgtgatatgattcaacaaacccgtttctatggccaaattggtttgctaattaatgtactatatggactgggattctttggtacaaaacgtgactgtccaaatagcctgactaattatctattttccttaattttttgccagggaaattttttttgtttttgttgttgttttgttttgttttgtttttttgagacggagtctcgctctgtccccaggctggagtgcattggcatgatctgagctcactgcaacctccacctcctgggttcaagcaattctcctgccttagccctctgagtagctgcgactacaggtacatgccgtgatgcccagctaatttttgtatttttattagagacagggtttcactgtgttggccaggatagtcttgatcacttgacctcgtgatccacctgccttggcctcccaaagtgctgggattacaggcttgagccaccacgcccagcctgccaggaaaattgtaaagtctacacacagtggagctactagtgtagtgagcaccatgtgcagttcttgcggacctctccttgcacaccactgtttttattctgaagtattttatagcacgtattgcagtcctgtaaattgatgctattttttttaaagtttgttgaattgcagtatcctaaattcccaaacccatgtccactgacaacctagcacactcttttttttccccaagagaaactcgtttcttattaaattttgcattagtgtcaaatcggttgactgttttttttgttaaagcactgtcatatttttttctataatatatactctttgacctactgtgaaatatatttaaagtagaagatttatgtgtatgtcagacaaattgtgaaagaaaatagtagcaaacttgttagttagccagataatgtgaggcagtttctcactgtctgtctttgaagggagttgcaaatatagaataggggaaagttaaaataaatcctacattgttgaaatgtttggaatcagaggtatcaatgtgaagtcattttttttttaatcagtagacacagaaacagatttagatgtatttgcttagggcttaactttacaaacttggcagaaaccatcttaaccagtaataaagtaaccttactggtaatgggacaggtgtgcctcttgattttttttttttttttttgagacatggtcttgctctgttgcccaggctggagtgcagtggcacgatcttgactcactgttacctctgcctcccaggttcaagtgattctcatgcctcagcctcccaagtagctgggattgcaggtgtccaagccatgctaattttttgtatttttaatagagacagggttttgctatgttgaccaggctgtgcctcctgatttgatgctgaaaaaagcacaacattacttctgtggtattccagataaaaatacattaatcaagaggaaacattttcccaaattaactggtctatgccctgcaagtctggaaagtgtcttagtcaatttggactgctataataaatataccgtagaatgggtggcttaaacaacagtcatttattcctccagttctgtaggctgataagtccaaaatcaaggtgctggcagatccggtgtttggtaaggacccacttcctggtttgcagatggccatctttcttgctgtgttcattcatggctgagagcagagggagaggaagcagctcttgtgtctcttcttataagggcactgatgccatcaggagggctccacccccaccacctcattacctcccaaaggtcctgtctcctcatactgtcatattgagagttaggcttttatcatatgaattttgaggggacacaaccattcagtccatagcacaaggaaaatcatgaaggacaagcaaagttaaggaactattcaggttgagagagacaccaaagagacatgaaaactaaatgtatgaacctaaattagatcttagacataccataaaggacattattagggctattagaatttgaatagagtttgtggattagttggtaatattgggttaatagtaaattcctgttttgttgactgcactgtgctgtcgacaaaatgttagtgacagcaaaatgttgttgatagcacagtgcagtcaacaacatcaggaagttactattactccagtattgccatctagttcacagactctgttcacattcactaaggagagggtccttgtacttgggaataaatgcggaagtattaaagggtaatgggacatcataaaatgtattctttactgctcagaaatgttagcagctagggaatctgggtgaagggtgtaagggaactccgtgtactattgctataacttttatgtatatctgaaattgttttacaagaaacaaacaagatacaaagaaatacctccccaggatgtttattagaacaatagaggctaactataccatttttctatttcttattaggtgcaataaaaggacactggtaactgtaaatttaacagttaaaagtaaggtcatggcggtggcttacagctgatagtgccctgtatactctgtacaagtgcatgctttattatgatcaacctaatggatagttagttttgtttttttttaaaccagggtcttccttgagatgtaatgggcacagagtaaacggctgattgttagcttattctgtggatgtatgtgatgagtgggtctggggcatcagtttctatatctcacctttacctatcaaagaaattggacaaaccatgatagcaaacaaatgaaaagaaaaaggagttttattgttcatgcttacaaaagaatcctgttaatcaatttgtaatccaccaattattttgggaataaaattgtagcaaataaatttaagatagaaacataaaactattaaacatgttatttgtattataatgtaaaatataattaatattttagtatgtacatattaggaataatgtcactggtggccccagaggctaaaaaacagaatgcaaacctgctggaaaatccttggtagataggagcatagaaaacagaatatcaaatgcatttattgttggccaggagacatggactactaggggaaattctgagtgtctaaggatagtactagaatgctaaacagtcacagataataatataaagtaggtaggattaacaagaaacagcacatcacagtcacaatgtgtgggaattaggcaaaggaaatacgtagccatttttatggacgtcttatagtccacttagacaatagatgtattctgtggtggtaaaccaccagcttaggtaatgggatttattggaggacatcagtggtagcaaaatacatatgaaaagcaaaagcatactaataggaatctgatgaaattaagagaataaataatggaggagatattagtgaagaacaagaaaaattgaagaacagtaaaagtaggcatgcttggaaaaggagaaaaatagatctctaataatcatttttggggaggagtatagagcgtcactaagttgaactaccaccaacagccagcattcattgagggcttattatgtactaggtgctgttctaagggcttgacttcattcctcacaaccactccttgaatatgcattttacatatgagaaaatggacacatgaacaattaggttacttgtggaactgaggttcaaacacaagcattgcgaccattcacggcaatactgcatagaaacacaggattccaccataatcaggtaggggagcgaaaggcagtttcaattgttctttatgtaaagaactcatctacctggagttattcattaagctgatataatttacagtgtgatctgcagagaatgaccttatcacaccaatccaaaagaaactactactataattaaactgtgggcaaaataatgtaggatatttttgtagaccgtaaaactgaaattaaagttgttactgatcaattaatgaggtgataattaaacagaaactagccaacctgactgattgtagaccaatacctaaaatttgtttttgcaattcacatcctttgagatatatttaattacatttataacacatggatatttaatataatcttttgtgacagattgacagatcttcactatcattatgtgtaattcctcttgatgtttttgtcattattacatatatatttgggagagaaataaaaggctgtttccaaggtgatggtgataaagagcaaacttataaaaatggttgcctccttttgtttgtataaaacaaccatctcatttccctctgggaggtcactagaggtatgatagctctgttttgaaataatattttagtaaataggaaagcagggtaaagaaagcctcccctttttgtgttatgttaaggtttaaaactgtgttacagtttatactaaaacattaagaatcaattattataagagcattaaattgtttgagttttgtcatgctttgcctagaaatcagcactgaagcgagtgacttagcaacgttattagatctattaaataattggaaatttatgtgcttattgtcagcatcttggctttttagaattttaaagtatgtttgtgcttcacatctctagttgcagtttatgtagaatttagtgaactataataacgttggatggtggtaatgtcacagtgtaattaactgcatagcatacaaagttctttgttaatggggaatgggatatacatcatctatttgatatataagttaataatcatactttttgttagcagtagttaaatgataagaactaaaaagaagcaataaacatctccatctctaaaacagtcttgcaaatatgcagtgagcatctactgtatacaagcactatatcttcatatttagattacatttgctattttgcttttcacatgtgaacttaagtgaaatactctaaggagtattgcaaggtaattgcccctataaattacataatttatatggctctttaacttttttagatgtaaaatgggaggaggagagcgttgagttggagtgtattatttctaggattctttctagcccacaagtcgaatcagaaaacagtggctcatgcctgtaatctcagcactttggaaggctcaggtgagaggattgcttgaggccaggagatcgagaccagcctgggcacatagtgagaccacacctctacaaaaaaaaaaaaaaaaaattagccaggcatgatggcaaacatctgtaaccccagctactcaacccgctgatgtgggcaaattgcttgagcccagggggttgaggctgcagtgagctggatcccaccactgctttccagcctgggtgacagagtgagaccctgtctccaaaacaaaacaaagcaatcagaaatgtacagatctttttccacagtttgtgcagaacagtcacttctaagatatactatgaaagtctattacaggagcaggaactagttattcctttctgagaattagatataacttgaccaacaaatcggttttttatccttcatatcatcttcagaagtagaagcaagatatatgatcaaagtctttttaaaaatagcagaataccggggtttttattttatattttcactctgcacaatgctaatctccttaacatttgatgacaaagaaaaaacttggaatttgtgtatgacaaaaagaatgacttatgaggtgaatcgaaaacactttttacagcctctgtcttcctaaagtttattgtttttggaaatagttttttggcaaatattttgttttgtaagttttacatttctaaagttgaataaaattaaatgtttagcaggtgcttgttgtaatagaagctataatattttaactatgtcatgaggtatctctgaggaagtgtttcttttttgttttttaatggtaaaggatgtcagtaatatctctcaaatgtcaaattaatttagggtgtgtactttctttttccctatgatgacgtagataggaaaatcgaatgttccaaacaactcatggaaaatgttccacttcagcgttatttgtaccacaaatgcagtgaaatgcttttaatggaatccagagtgataggtggattatgacatgtggggagatgccttcttgaaataggacataaatcatggttttttttttttttctgagacggagtctcgctctgtcgcccaggctggagtgcagtggcatgatctcagctcactgcaacctccacctcccaggttcaagcagttctcagcctcttgagtagctgggattacaggtgcccacgaccatgcccatctaatttttatatttttagtagagagaaagtttcaccatgttggccaggctagtctcgaactgttgacctcaagtactccgcccgcctcggcctcccaaaattctgggattagaggcgtgagccaccgtgcccagccaaatcatgtttttgaacttgttttaaatatctgtgtgtgtgtgtgtgtgtgtgtgtatgtatttttttttttatggagtcttgctctgttgcccagggtagagtgcaatggcacgatctcagctcactgcaacctccacctgccgggttccagtgacctcagccgcctgagtaactgggattacagacactcgccaccacgcccaactaatttttgtatttttagtagagacggggtttcaccatcttggccaggctggtctcaaactcctggccccataatctacccgccttggccttccaaagtgctgggattacaggtgcgtgagccaccgcgcccgaccagtattatgtatattctttttgtttgtttgttttttgagatggagttttgctcttgttgtccaggctgcagtgcaatggcgcgatctcggctcactgcaacctctgcctcccaggttcaagcaattctcctgcttcagcctcccgagtagctgggattacaggcatgtgccaccacgcctggctaattttgtatttttagtagagacggggtttctccattttgggcaggctagtctcgaactcccaacctcaggtgatccccccgccttggcctcccaaagtgctgggattacaggcgtgagccaccgtgcccggcctgtcatgtgtattctaattataaataattttcaaccaaactgatatgtttggttaagctggggaaagttttcagaaaatagagtacactgagatgaatttcatgaactgtacccaccaaagccttgtcctggttaattcaaatttataatgccaatagtttaaattagcatttagcctttaagtgacggtggaatggtgaggcatatgatgtttttataccaaacactccgtgctccatgtcttttttggagtttacacttttcaaaaacaggcggcacttccatgtgtttatttccccttcatctctgtttagtgaatgattggtttcatctttacaaagattattctggctgtagtggggagaaccagttggagatatggaagatgtatgtggggaggccagagtatcgtggcagtctgcctgagagatgcagtggccggggtttggtctaagatgttattggtggagacggagagaatttgcggtatttgagagccactccagcctccattatttctaattctatgtcctctacccttctctgtcatctctccactgcctcccagccccttccactgtgccccctgtattgcccactttcagaccaacagccttttgtatcagccttttctggaatgttccactaattacttaccctaactaaaaccttagggtagttttgttctcataccacacgcacctccaagacaggaggtgggattactttcctccttgtgtcattcaggacgactgctccgctctttcttgtaagccctttcttttttgaaatcacatcatcagtcttcactacctcatcttcctcttggcaaccttcagctccccttccctgtatccctctccctgcacgtgaagaccagcagccagttcctggtctgtctgtctgtctccatacaatcattattccctgtattttctctccatccacagacaccactcctgtttttacatcctttatccaatccctggcctggcattatagtcactcactcatgaatacccttaactgctcactccttcattcttccatcagtctcaaacttagaggaactctgcctccaccttccctatgcctgcgcatgagcaccttaccatggctggtgaacgtcccataccaagggcacagttaacatgcgtctgctggtcagggccagctgagcatcctacactgggcagaagggttgctgtttctctgataacttctcctcccttatcctcagtgattccttcctgtcttcaccactgtattcacatgtcccacgctcctgctgcagctgacactacttctgaatgtccctcttctctataccaccagggctctagatctgatcaccatgacttttagttttatttcctctaattcattgtccaagctatagcctgcatgatctttcaaaaatggacagtgtggctcacacctgtaatcgcagcactttgggaggccgaggtgggcagagatcaggagttcgagaccagcctggccaacatggtgaaaccccgtctctactaaaaatacaaaatattagccgggcatggtggtgtacacctgtaatcccaactactcgggaggctgaggtgggagaatcattggaacccaggcagtggaggttgtagtgagccaagatcatgccatcgtacttcagcctgggcaagagagtgagactccacctcaaaaaaaaaaaagaaaaaagaagaaaaaaaaggacagcagacaatggcactctgcaggtggaactgcttcatgtttcccactcctgtccctgttcttcaagagccggcctccccttctctctgctccatccacatgggtttcaaagaagcttagctctttctcaccccagggtttttttctttctttttttttttaaatatgatattccttctagaatattcccacacacccatcactagcatacttaattcctactcacccttccagtctttgctcaagatcacctcctcagagaggtccttcttcctgctgacaagtaaagaataatgagaattcagaagaggctatagaaattggctgggtgtgatggctcacgcctgtaatcccagcactttgggaggccgaggtgggtggatcacttgaggtcagaagttcgagaccagcctggccaacatggtgaaaccccatctctactaaaaatacaaaaattagccaggtgtggtggtgggcgcctgtaatcccagctacttgggaggctgaggtaggagaattgcgtgaacctgggaggcggaggctgcagtgggccaagattgtaccactgtactctagcctgggcaacagagcgagactttgtctcaaaaaaaaaaaaaagaaaagaaaagaaattgctgaagatttgtgatttttcacaatacagttttagtagtcagattatagaaggttatggggaaaggtgtatggtaagaaaatagctgcagagaacttgttttagaacctgtcagagaaaggaagagacacagttagggagctatggagtcgtgcatgtgtttgaaagcagaggcgagacgccagtgtagactgaaagctggagaacagcgaagttaaaaggattaactaagaagcagagagggcatgagatgggagtgaaggaaagagcatggctggttaggcgagaaaataaggacttgggcctatggcttcgattttggtaaagagaagaagtcatctgctgagagtagggggcagggttataattaatgtaagtttggtgcacttgagtccttggtcaatttcagggcaaattatataatctttgtttacattagcatggctgctaaacacctctagcgttgtgtctttggatagtttatgaaatacagagttttttgcataatttaaactactccagtgttttcacagtgctaagacattttgataatattgtctgccttgaaaggagcagattttacttgtgcctcaggatattatgtcatttatcacttcacttttggcttatttttctttttatccccacactgaatttgatttaatttgttagcttttattgtcaattaaaggcaaaatgtcaaaaagttctaacctcaaacagaggtatgtgagcaaaacactcactttataatattggaaatagccatattagaaattaaatgtctgaggtcagatatggtggctcacgtctgtaatctcagcactttgggagaccaaggtgggaggactgcttgagcccaggaattcgggaccagccctggcaacacagtgagaacctgtctctccaaaataaattaataaatatataaatctggaggtggtagctcgtgcctgtagtcccagctacacgggaggctgaggtgggaggattacttgagcctgggaggtcaaggctcagtgagccatgatcatgccactgcactccagcctgggtgatggagtgatgccctatctcaaaaaaacaaagacattaaccatctaaatacatctgaaataaaagggctttgtaaccacagaattatagatgtagcagagatatttgaccttgttagttcaggtctctttcagatgaggaagagagattatctgaaacacattgtaaaatttggtgttgtagttgaagtctgtaaatctacaaccagagaaatagaaattagtatccacctgttaactcaaatgcagtttaaaaaaaacagctacgatttattgtgtgcctactagtgaaaggtctgaagtggttgttgattgcatattgtaatgacagagaaaatgagcacacttcacttgaaaaaaaaactttagagtggatgtagtggctcatgcctgtaatcccagtactttgggaggccgtggcgggccaatcatctgaggtcaggagtttgcaaccagcctggccaacatggtgaaacaccgtctctactaacaatgcaaaaattagccgggcctggtggcaggcgcctgtaattccagctactcaggaggctgagacaggagaatcgcttgaacccgggaggtggacggaggttgcagtgagctgagattgcgagactgtgctgcagcctggtccacagagtgaggcttaaaaaaaaaaaaaattaatgtactgtatgtatatatggtacaaagttcaaaaagtccaaatggatttgtggggaaaaacaagcctccctttcatacctgttcctcagctattctgtcgctcttaagcatttgtccagagatactctttgcatttaaaaacacacatgtatagttatttttttcttaaaaaatgatagcacactgtatacactattctgtattttcttgaaaatggtttcaaatcaatatgtatagagatgactcatttttttaaagaaggggcactaagtttttacattctacagaatatgtatttatttgatatactttaaggaaatctttgctgggtgtaaaattgggggacaacatttccttttttttttagtacttagactatattgctgtgtggtcttctgtatctgtgttgcttttgagaaattagactgacctgagtttttttcctttcttgtacatgatttcttattttttattttttttgagatggagtcccgctctgtcgtgcaggctggagtgtggtggcgcgatctcagctcactgcaacctctgcctcccaggttcaagcgattctcctgcctcagcctcccgagtagctgggactacaggcacccactaccatgcccggctaatttttgtctttttagttgagacgaggtttcaccatgttggtcaggctggtctcaatctcctgaccttaggtgatccgcccgcctcggcctcccaaagtgctgggattacaggcgtgagccactgcacccaacccatgattttttatttctaacttaatacctccatactttctttttattctcttcttttctttcttttccttttctcttctcttttcttttctttctttctttctttctttctttctttctttctttctttctttcttttctttctttctttctttttttttttttttttgacagcattttgctctgtcgtccagcctggagtgcagtggcaaaatcatggttcagtgtagcttggaaggcctgggctcaagcaatctcccctgcctcagactcctgagtagctgagactacgggcactggccatcatgcctggctaagtaaaaaaaattttttttgtagagatggggtctcactttgttgcccaggctggtttcaaactcctggcttcaagcagtcctcctgcctgggcctcccaaagtgctgggcttacaggcgtgagccaccatgcctggccataattctttctctagccttaaagttctataaacataatcaatccacaaattccaggttttacttattttgacaagttttatcctgttatgtatctttgaatgtacatttgttctttttgctttgtgagcctctttggacagttacatattctttctaacccccttcctcctccatatctgttgtcttctcagtaaattggttttatattgttagtcttatctatttcattttatatgatttcttcagtccttatctttcttttagtcacatttattctatttttggttgcttcttaatgtggcttttatctcaataatgttatttttctctccattttttttctgagttctatcagcttgactttcatttccttctgttgttgtataatctcttctttgaacctttgtttttcttctttgagctctttttttatttttatttttttaagaggggtcacgtttcctatggttgcctttgagactttggagaactatttatctgaactcttcctgtgtttctttgagtagttcttgtgttatatgctactaatttacctttttctctgagttttttttttttttccaaattgtatgcagacatcgagtattggttgttttctgagtgttgtttatgttgaaataggccgggagggtaggtgaagcaggctacagccttttttttggacatgttacttagtcatttctcaccaaatctgttatttagtttgaaagggtaggctggttcttcgtgtcggagtctatcacgaaatgccacctccactccacatctgccccttcagtgacccttgactgaagggttgcatgtacacagtggatctggcatggtaacaaggattcttcggttcagccagcccacctttctctggtattaacccgtggttcaaagagacattctctacttctcctttggcctatacttccatctagattccctccttggatgctagcatcattagaatcactgtacctcttattcgggattatgtatctgtgtattgctagaagcctgagaaggcctgtgatggctttccacacatcccttgccccgcttatactggcagataggtttcagtttatgatttggagtcatgatagcttccttgtttcagttgtgtagggaagttgcaaatttctactcatgactcattgtgtagatgatgaaatgtagtgtattttctatcacctatcatctttgtcagaggccctctacctttagtagtggatggtgggaagaaaaatttgtgagtaaacaggatcttggcctctgttggtttaaacagtctctttggggtaatgtgtttcagttttcttctatccccagcttctgctgaggtgaggtctgggagcagtgagagaggcctttgggaatgatgcttagatctgcctcgcggcgctggcatggggagaacgtagactcacacgcagtcttcctgaggctttgctacgagggcctgggtgggtaaccactgagtaacatctctcgctgttgaggctttgaaagccttgaggaggcttctcctgtccttagacctactacagtcggcccatgggctctgcatctgtggatccaaccaactgcagatatttgggggagcggggaggaaaagatttggatctgtactgaataggtactgccttttttccccccatctttattccctaaacaatagaggataacaactatttagatagcatttacattgtattaggtattataattcaaaggtattataggtaatctagagatgattcaatatatggaagaatgtgcctgggttagatgcaaatactacaccattttatatcagggacttggagcatccccggattttggtatctgcagggcggggcgggggtggtgctcctggaacccgcctcccatggattccaaggatcacctgtatttgcctgcagtcatcatggagttccccatactgtgtggtcttcatcctgacccagaccttcactggtcagaacttcaggattcctatcacgatgtacttgggttatttgcccagcccctccctccagccatgctgcgctgttgctgccacgccatattcagaatgccacaaaactgagccctgggcttcactgcaagcctgcagcctcccctacactgtgtcccagaagcagacctcttgcctggatatttttagggcaccttatacttgtcagaatgttttcagcaatctttgtccactgccacccccgccctatccccaagggtccagcagaagaggaaatagtgaagtctctgataatctgattttaatgagtatcttttaagagaaataagtgatagtgggggaattgttagggatcatatatcatagttctgctgcaggtttatctggaaacttgagcaagattaagtatcaccttgttaggttgtctaccatataataataatgtcatctgtaagcctctcatattaaagagttagggaataagcatcagtgagtgaaaggaagaaaaccaatagttctttcattttaaattagctatgatttttaaatttccattacttttatatttatttggaaattattttttttcttttacgagtatccctgttttgaaagattatgggtctttttttgcatattcatgaaggatgactggatgaaatcagtcatttatgattgacagaaatatgacagaactttgcaaagtttgaatggacttttgatattcaacaccaaagaattttgtctaattaaagcttctgtttaattaagataacaatgcatagtccttcattaaaattaacacagaaaaagttcttccttggtccttggagaggatattatatgcaagccctgttgtgtgggttgcaagatgtcactggaatttatatgcattacttgtctaattgcagtaaatgtagcatgtccagataggtttcgagttagaaggctgtttgttacttacggaaatcacttgaagcctcagtacccggaggcagctgttcacaggtccttcacctctccccagagatgactgggaagacgctgttgttggaccctgtctttcttggctggagcagtaaacatgacaggttgtttgggagccatctgtttaaaatggctgctgctttgtatgcagcaatgaacttgagatcagttttctgtctttcttcatggtaatggtcttatttggtgtcacaacaggtggaagttgatgggtcgaaactaaatgtgaccagcacgtggaacctggcttcgcccttattgtctgtcagcgttgatggcactcagaggactgtccaggtgagtgttgtaaggatttccttagagggcctcctcaagtccagaatccttgtcagcacctgtgtggctaatacttagagctataggagggaaaagctgtattttattcaccttatactttttacagtcgaaaactttttcttttcttattttagaggatcttaagttttaacctgagcatttaatgttttcttttttcagacaatccaagaaggttcatgtattgtactttgttgtaaacaaggaattctgcaggcttttctaaaaatgctagattagctgtttttttttttcctctgtgggtttttagttgtaaaatacaacttactttgttacctttcttttctgtgcagttgaaattacgtagtgttaggctagtaaaacttgtgttattcaggttgactttccacagctcactgatgtcctttaaaaatttagtaatcttaacttattaatctttcttttcgcctcaatataaaatgtcctgccttgaggagatgccttggaacccagagtcgatagaacattttttgtaacctgtgacttccattttaaagtagaaagttatgaaaagagattctgccaaaattcttcaccttacctcatatttgaggtttagcgttttaggaaaaaaaaaaaaatcatggaacatgtggctatcacaggctaataaaaatctagccccacccatagcattaaatgctcattctttgttcttttttatgaaaatcatcttaacttgattttacacaggaaactggttttaaaaaccttgagaaatcaggataatcacagattaagactacttactccatacctgattcttatctacctctatgagagaccgggatagtggacatcagaatccacaaaaactatgtgatgactgaactgatttctaagtcagtttcaattgatatattatctctatggttccaagtaaccttgaactcttggtaataagccctatattttgactttggttttgtgacttgtcccagtatattttttctcatttttttaattttctaactcctgtcttttctcatattttataacttaactcatattatataactttatataatattatatcagtataaattatgagttgaaatagtttaagactcttgaaaaaaatatcactacataatttcacattacttagatccatgtattattatgtctttaaaaactgtggtgtctgggcacggtggctcacgcctgtaatcccagcactttgggaggccaaggcaggcggatcacctgaggtgaagcgttccagaccagcctggccaaagacagtgaaaccctgtctccactacaaatacaaaaattagccgggtgtggtggcgggcgcctgtattcctagctacttgggaggccagggcaggagaatcacttgaatctgggaagcagaggttgcagtgagccaggatcacgccattgcactgcagcctgggcaacagaacaagactctgtctccaaaacaaacaaacaaaacaaacaaacaaaaaactgtggttttgttatactggtttatgttcgatagactgtacagtgcatcgaatatgttatggctcaagtgtttgtcagagggacatagtgttaactctcagtagtcagaagaaagaggtacaaactcctattatgcaaattttttgtattgtgttactttcatcatccttttcagtgagtgcgcagatagttgtcttgatggcacttttacatgtagaatttatagctagattaatagggatacatatgtagaataatcaaaaatattttccctagtgtagggatcatgttcggtaaatccctttttaatcctgtaagtactttgctactaaaagaattaatgtgtctgaaataagtgaccccttaaagagagatcccttgactcttaggaagaggtcgttgcatcaagttaagtactctctaattggaaggaaataaactcagagaggtaaatggtgtactaggaaaaacagtcgtttacctaaaaaaaaaaaaaaggtaaggagagtttttccttgtgaaaggggatggattttatttactttctgtaggcattagcattatatcgactctttccaaaaatgtaatgtggcccctatgaagataataacaattgtagtaataataaataacacacagtgcttactgtgttatcaggtgtagttttaagcatagtacagatatgaacttctttgatcttcacaattgtatgaagtaggtgctatttatagttttataaatgagacaactgaggctcagagaaaagtaagtgacttactcaaggtcaccagctagtaagaggtaaagccatgattttttttttttctttttaaatgagacaggatctcgctctgtcacctaggctagagtgcaatggcacaatctgggttcaccgcagctttgacctcccaggctccagcgatcctcccacctgagccccccaggtagctgggactacaggtgtgcctgccaccacacccagctaattttgtttattttgtagagatgaggcctcactatgttgcccaggctggtttggaactcctgggctcaagcaaccctgcctcctccccgaccccccctaccccccacccccacccccaccccccccacaccctcagcctagatccatgatttaaatccgagcagtcttgctgtaggtaggatccttgccatcaagcattgcaggatgctgaggcaagctatgtaacttcctgggcatcacaaagctaggaagaagcagagcaaaaacttggtccgtggcagtcatgtgtgctttcccccactatgctatagtactttgcgatttttcctatcacattcttcttcaaattataattacctgtcattcatgctttaaaccagagatgcttaaactttaatatgcttcagaatcaactagaagccttgtggaaactcaagttgttggacccacccatagcttactctgatttagcaggtctgggctaggtctgcatttctggcaagcccccaggtaatgctgctggtctgggccacatttggacaccctctgctttaaacctttgtagtcagagaatgagctgaggagtggtgtgccccagcaaggtgggtaggaaccgagtcacatgagccttattaaggacataggagaggctctactttatccctaggtcagtagggacccgtggaagagctttcagtaaggaagtgatgattgaacagaattgtagcttacgaggtttttttggtttttggctgctttgtggagagtggcttgaagaagcatgaggtgaagattggaggcaaagagagaagtcagcagatgttagggattcggaggtaagaagtctcagcagctgtggggatgagggcactgtgtgcagaagggatctgcaagcgtgacaggagaaagaactggtggctttacagtcatctgctgatttctcttctgaccactgttagcatgggcaaacctccaaattctattcctgactcccccttttctctctctgcttgcttcctgggctgcattgctccaagagttccagcttaacacctccaagcagatagctacgaaatgcaattataagtgtttgtgtgtctctttgcaattgtttattctgagaaataagggatgaatattaccaaaggcatttttcaagtgattttacagtaatcacttgaaattgattactgtagtaattgattactatagtaactgtaggtactttaaagtaataactacaattcttttttctctggatttttgagcatacatataaactttatattcttaaatagtattaaatattactatttatcattaacttgtatcattaaattttattattaaacctcatttaatataaaataatatgtattattattattttgagacacagcctccctctgttgcccaggctggagtgcagtggtacgatcttggctcactgcaacctctgtctttcgggttcaagcgattctcttgcctcagcctctggagtagctgggattacagacacgcactaccatgcctcgctaatttttgtatttttagtagagatgaggtttcgccatgttggccaggctggtctcgaactcctgacctcaggtcatccacctgcctcagcctcctaaagtgctgggattacaggtgtgagccatcacacccagccaaaaatatttattatatctatataaaagctaaagaatgacccaatgaaaacctgtttacccactatctagattaaaaaaaagaaaacaggctggtcactgtggctcacgcctgtaatcctagcctttgggaggccgaagcaggcagatcacctgaggttcggagttcgagaccagcctgaccaacgtggagaaaccccgtctctactaaaaatacaaaattagccaggcatggtggcgcatgcctgtaatcccagctactcaggaggctgaggcaggagaatcccttgaacccgggttgtggtgagctgagatcgcgccattgcactccagcctgggcaacaagagtgaaactccgtctcaaaaacaaacaaacaaacaaaaaaccaaaacattatcagtgctatttgtatcattcttccttgattaaatcctcctttccagtgtccctgaagaacaccattatgagttttaaattgatcactaccttgcttttctttagggatatttatgaatacaccaacactgtgagcagtatcttgttgagctgctcttgtttttgaaccttgtaattgcccccatcctctctgtgttcctccaggagttgtcttctccccaccagcatgatgtttgtgagcctggcccatgttgctgcctatagctgcagtttatctacttccatacatcatattaatattaccaccaattacttattctcctctaaatagacatctgtgttattttccttattttgttgtcacagtgatgcttgtatgaacaccctacttcctgtttcctcttgacataggaggttctccaggtcatgtgccggtataacagccatgctgtggggcctgtgctttctcattcctgcatggcaaggccaggtgggtttctctgtgtggctgtaccagcttatgtgcccatcagtagtgaagatgatagtcacaatgagaacaatgaactaaccttattctgtacttattatgcccggcactgactgttctaagcactttgtatgtatgaatgcccccaaaaacccaataaagtacgtactagtgttatccctcattttgtatttgggaaaacagaagcttgtagaggctaaattgctttcccatctggtagtaaatgggagtgccagaatttgaaccaaggaatctgtgcccttaacattttttttcacatcctggtgaacccttggccttcccagactacttaggtttttcctgactggtgggtttagatggcatctcattatggttttaatgtatacttccctgattagtatgacaatgaacattgaaaatatatatttattggctctcttgttttctcttctgtaaaatatctgctcatgacttttgcccactttttaaattggattatctttttcttattgactcataaaagttcttcctgcgttatggctcctttttgtcgtatgtgttgataaagtagcttctgtttttattgttttaagttatccaagttaagttttaaggcaagatttaatgtcagaattttcaatattttcctttatggtttgtgtgttttgcgtttgtgtagataatcttgttctactcctaagctcacaaagatacctatattttcttttaaacctttttaaattgtgcttttcaaagttaactacttaatcctcatgggattgatttttgtacacggtatgagtggctcacgcctgtaatcccagcactttgagaggccgaggtgggtggatcacgaggtcaggagatcgagaccatcctggctaacacagtgaaaccccatctccactaaaaatacaaaaaattagctgggtgtggtggcgggcgcctgtagtcccagctgcgtgggaggctgaggcaggagaatggtgtgaacccaggaggcagaacttgcagtgagctgagatcgcgccactgcactccagcctgggtgacagagtgagactccatctcaaaaaaaataataataataaataaaataaaatacagataccaggccgggtgtggtggcttaagcctgtaatcccagcactttgggaggccgaggcgggtggatcacctgaggtaaggcgtttgataccagaccagtctgacctgtaacatggtgaaaccctgtctttactgaaaatacaaaatattaaccggggatggtggtgcacacctgcagtcccagctgctcaagaggctggacccctgcactccagcctgggcaacaaagcaagactccatctcaaaaataaataaataaataaataaataaacaaacaaacagataactcgttatgccagcacaatttaatgatagtcgtgcttctcttcccttactaccttgccaccacctcacctttccaaccccgaaattctttaaaagcggtttctgtgattctcaattaattgtaaataaaaagatgatttttcgcttaatacgatcctcagtatatttgcttctgtgagctctcagtcagttgcactcttttattttttgttaatcttctggaaacccttagccaagggcatcagatgatatttgagatacaccttagaaaaacgtgtttgtgaatcaacaggcaaattgggaagtattcatttagggaagtaatgagagctaaacatggaaaaataggttggaggaccagatagtgaatgagagcctgaagaatctatgcttttcagtcagcagtggagatattacaactttttgcagagtacagtaacgtccatcaaaatgccattgtagaatattaatgtgtcctcataatagaggaggggttaagggattgaagggtgaagtggagatggagttcatttagaagacaatcctattactgccttcatcctccactagggtgcaagcagtgtagagaaaaagggggttgagtttgagagaaacctatgtttccatgcatagaaaccactttctgtttctatgaatttgactactgtgggtatgggtaccgcctataaatgaaatggtatagtatttgtcttttgtgactggcttatttcacttagcatactgtcttcaaggttcatccaggttatagcatgtgacaggatgtctttcctttttatggctgaataatattccattgtgtgaatatactacatgttgtttatccattcctctgtcaacggacatttgggttgtttctaccttttggctgctgtgaattatgcttccatgagcatgggtgtacaaatatctgtttgagtaccccattcttttgggcatatgcccagaagtggaattgctggatcacgtggtaattgtatgtttaattttttgaggaacctccatagttgctgcaccattttacattcccattagcagtgcacaataatttcagtttcgtgccatctttgttaacacttgttattttctgttttgttttgttttttaataatagccatcctattgggggtgaagtggtatctcattgtggagcaggacttatctagatagtaactgaagaaaaagcattccgaatacttctaggatgtgtccttcctatattggtattactctgtaaccagttcactgcacaagtggcacttttttcagtccaagtagaagcaagtttcttagagctgtttttttttttaaaccctttatttcaacttctttccttcccatatataaaaccacataccattctaacagtctgtaatgttgctaccaggtaataaacaagccatactgtatttgggagaggagggtgtgtttcaaagtctagttcattgtaatatcaaaactggtaaaacctctcctctctaaactcagtttgacctcacactgagaaacctttactagtgcagaggagaatgttgctttcttcttgcttgctttatattgtaggggcaaaagggtgtgatcccactcctccccatcataagggtgtccatggcagacactcctataacaaaagacaggttaacaagagaaaagtataactgatttatttaatcaaagttttatgtgacatgagagtcttcagaacagagatccaaagatacaaggaaagctgtccattttaatgcttaggtttaatgaagaatgggcagccgtgtaaaactgatgggacaaagaatgtaagtgaatgctagtaggctgagaggaacccagcaaggcctatgttcagatcttcctggcctctcttgtactatttcttcctcccaggtatgggacaagacccatctgggatgacggtcttatgacctgctactgttgtagagaagggtaggccagagaatttctttatgagcagctcttagaaaggcagggaggggttagagtcctctttctggtttcatagttgtctttgcgggagaggaattctgatgtctgtgactcatctcaggagagaatgaggggtgagagacaggaaggcagaaggtcagagatcttagttctgaggttacttctgaggccttctctttggggtatcattttctgagcctcaacaatacccttttctacttcagagctgctatattgggtctctcagaatttgcagtatggggtaaagatgagaagagcatggcaggaagaaccaggttttctggggcagaggcaacctggcattcactctcttggggcatggcagatgtccaaagctggccggtagccctgggatactttcatgtggatttgggggaacttctcacctgcagaacacttaatgcctcctgtcttttccagttgcctttggtctcctgagcaactactgtgttgactctgaatgttctcactgggcatggtccctcataatgaccccgcctgcttttctcctgcacaatccacgtctggccacaggaaatagtaataagtccttgcctcaccaaaccaacaaagtacaagcttctcttcttggtctgtctctaagaattcgcatgaataagtgattctcatgaagtcgctttcacgtagcttaagcagagttcagccttaaattctaagcttaagaattcgacctcctcaaattaattttcctcttttattcttttaaggtgggagatggacagtcactggtcccacagcttcctagcacattctaccaggtagccttggctagcatctgacttaaagatgtatgggtacttggcgtctacttctttttgttgctgaacccctgtgattccatgaaaagtagtgcgttcatctgttcttatattgctataaagaaaaacctgagactgcataatttatcaagaaaacgggtttaaatggctcatggttctgccagctgtacaggaagtatggtgccagcatctgctcagcttctggggagggaggcctcagggagctttcagtcatggtggaggcaaagcaggaggaggagcatcacagggcaagagcaggaatgagggtgagagagaacggggaggtgccccactcttttaaacaaccaagatctacctctgtgatccaaacacctcccaccaggccccacctgccatgtcgagaatcacatttcagcaagagatttggagcggacacatccaaaccatattaaggagcatttaacttctttatctgattagatgagtaagtagttgggaaggcaacttacctttgcttcaggaattagctcccgattcatccagtccgatcacgtgtattcatgttcctggttttcattggtaaacttcataagtttaatattacccattaaattcctttaaaagtaagttgtattttggtgtatactgtcactggtagagggtcatgattgcaagttatccaggttcttggcgttttgaacaaagaattggacaacatgtccagcaaagcaaacaatgaagcaacaacagaacaaaaacagggatttattgaaaacaaaagtataggcggccaggtgtggtggctcatgcctgtaatcccagcactttgggaggccgaggcaggtggatcacctaaggtcaggagtttgaaaccagtctggccaacatcgtgaaaccccgtctctactaaaaatacaaaattagcctagtgtggtggtgcatgcctgtaatcccatctacttgggaggcaaagacaggagaattgcttgaacccaggaggtggaggttgcagtgagctgagatcgagccattgcactccagcttaggcaacaagagcgaaactctgtctcaaataaaaaaaaaaagagagagagagaaagaaaatgaaactgtactccacagtgtgggagcgagcctgagcagtggctcaagggcccggataccgaatcttcttggttccaaatacctgctagaagttttccattgattactttatactcacctcatgtaaatgaagttgcagcctataaggttgcagaaagcagccaaccagaggctgaagtgaagttacaaaggtcacactcctgtgcaaacatgttgcaaagttatactcttatgcaaatgaagacttggctggcaatcagtctgattggttttggacagcaaccattcagagactggagtgaagttacaaagttgcaaagactggacccacagtcaatctgattttctgatttgttattggatgggaaattgactgtccgatttcccatctgccacacagaaaaggtgggtggtttgcaaagggagtagcccctggtccttttattacttaggtgtggaaagctaggattttcctttcaatttagttctaggaagttggcgtgaaacagccttgggttccctgcctccagaccctattctcctgcctcagtgctatcattagaataataaatttcataggttattaacctcttttaattgatctaaatcacctgtttccttttggatttgacttttaattcccactgccctgctgacttctcggcgcatataaatgctcaataattggatgaataggtgtgggtgggtgaatgggtaagtggacagtcatcttacattatagaatgttttgctgattctttttagttcctgacctcccaacatttgcgaaatccatactccattagtgtggctggtggacctctcttgatacagaataaccatggtttctgtgagagcaaaaagaaacaagagggctcccaaggacttgcccacagaggcgctttgctcaccaagcatggttctttcctgttggcctctgtttgctctgggtagcacctcggctgttttaggcccacagtatcacctattgacaagtgtagatagctattgatagtatcaataggtgtaggaaagggtctgcctcctgctattcctggttttctctttctcaaaggcttgtgcatgccctaggctttctcactgtccgttgctgggtgaggtcatatcagctcttactcccacagaaccacccgcacctgctttaagtacgctgcctttctgacttcaagaaaatcatactctcggaaaaagtctaatcattgtggataactttgaatatggagctagtgatatattacctaagggaggaggaaatcacatattttgaaatgataaagaaccaggggcataaacattgagaactcttgaaaataattaaaagttctcttcagaattttaaagtctttttctattaatttctctaataatttagccaacttttcttcaaatatcatcatttaaggaaaatgaaataactattttatatttatttgtttatttgtttttttttttaccagtgtttctgttttcattgccgaagtagtcagttggtaatgacgtttattaaatagccttatctaatagaaggctaacacaagccatatttaaaatttctttgttttaattaattagctctttgttttgttttgtgtttgagacggagtccgttgcccaggctggagttcagtggcacaatctcagttcactgcaacctccgcctcccagactcaagcaattcttctgccccagcctcccaagtagctgggactacaggcacctgccaccatgcccagctaattttttgtatttttagtagagagggggttttaccatgttggccaggctggtcttgaactcccgacttcaagttatctgcccgcctcagcctcccaaagtgctgcaattacaggtgtgagccattgttcccaactgtcatttaaaatttcttagtagtcatattaaaaaagatgaaacaagtggaattaattttactaatacattttatttaaaccagtgtacctgtggagacaaaagtgattccatcttaattgctaatgcaccatgttgttttttttttcttgaaggcaaaccttgttgttttaatgtaatttattttttattttactttttttttaatgatagggtcttgctctgttgcccaggctagagtgcagtggtgcagtatggctcactgcagcctcaacctcccagactcaactgatcctcctgcctctgccttctgagtaggtgggactgcaggcctgtgccaccacatgcaattaattttgttgattttttgtagagatgagggcacactatgttgcccagaactcctggactccagtgatcatcccgcctctgcttcccaaagtgctgggattataggcctgagccaccactcccagcaaagccatgttgatttctcattagccccagtctcgtgaatgcctcctgattctgattttatttactgtttttagtgtaagaacaaagcagccttgatcttaccacacaaattataggcagtgacgcacatagcattcccacctgttctggaggatgcctttaattgcctctgtagagcacgtacaccctttccctgtggcatataagctctgggtctggccagtaacagagtgggttatacctgtcttgcagccatccgagatcacgcttctgtctgtaagttcccccaagaaaacaccctttaccaacaaattgagtttctttgccttattctttggtttcttggctccctccgcatttgggggctgctttgcatttatggccctttcacagaataataccccaaatgttgtcatttcaacatgaaagacttttaaaaattactaatgtgataccagaaacaacatagacattggcattaatacaacagtatcttaaacaatggaacggtcagagtggaatgtagtcctaccaaaacaatggagttgggtttaacagaaaattacactgcttcagttttaaaattaacattaaatacaattgaaaatttaactcctcagtcacaccagtcatatttcaagttctcagtagctacgtgtagctagtggttactgggttagaccactcacaggcaaaattttttgtaaaccagagagtgtttacagatagagaaaactctacataatggtttttaaagtattcccccttaatgtcaaccacagttttggtttttatctcttaaaatttggaatagatgagttgaatttatttttaaacagaagatgaatttatcatctagctgacaaactttttaaatttcccattagaagatttaaaaaattacaaccatttttaaaacgtggaatgatttcctgcctgtggcatataattaaagtgatgaaacaaacagaagattcgctgtgtcctggccatggtgagctcactctctgttttcctcacaaaccccagaacctttgtagtgtggaacctgctggatgaatagaagttttttattttattttatttttttactatgtctatattcctgtgaagtaatttttttgaccttgaaagaagttcttcaattttgctgttctctatttcttacagtgtagtttgtgtaccgggatttaatgtattgtttgtcgttagcgttttacatactagattttcatcgtgcatagtcacgttgtttgaacatttgcaagcagagccgactaactgctgttggcctgtttctttgtatggcgtgatttcttctatccacctgctcacagcaggttgccttcaggcctgaggagtagctaaatacttttgaaaatatcttgagatcctgctaaggtctaacaatttctgcatttgtgtgatgtgaagctattcatgctgtacctttgaagacttttttctttctatttctcatattcttgctcaaatattttcaaaagaagataaatttattataaataacagtgcagagctgattgtagcaccactgcattctatattgaataggtctttgatattcagctaagtggaactaattttctatgttaaagcagacaaatttggaatagtgtcacatgaatctcatgttatttactgaagaataccagattaaatggattagttgtgaaatgactagagtattaaattatatatatatatatatatatatatatatatatatatatatatatatatatataaaacgtgataacttaaaatgcccagtgggcctatgtaatataaaatattacacaagcacatgaatatgatggacgagatgttattctgtttgcagattgtgaaactatctgtagtatatatacaaatggttgtccacacagaatttgaatcaattttaaaattgtaaccttaaatttcagttttgaagaaaataaattgttgattttcatatctacttgagaggaagttaaaaatgttattttcttttcagttttttttagattaaaatagctcccacaccctccaagaataaactttagttttaatcctaataactgtttatagatagtaaaattaatattttaattagaaaaataaagcggcatacatttttgcctgtactttgctggtacacaaatgaattgggaagtaattgtcttatgttttcagtcctaaagtgttttacaggttttaaaaatgttccccccacccccatctgtttgaagtcattattattttgtactttacacatgtgatttctctagaatcattgcatgtgacatgacactctcaggatatataggatatataaatatataacttagaataagtagaggttggtatttttcgaatgaagtaggaaatgaaagagtaattattaaccatatcctttttacattcctgacatatcaatacagctacacatcttagaaacaagctcaccagtagaacagaaataactctgttgactctgctttaaaatatttcaaggcagtttaacagctgggatgtatttacagctatggtataaagtattaattttgatgcaaggctacctgcttttgtaatgtagtcctagaagcttagcagttttctgggttttataatttggagttgcttttaaaatttaaccgaatgggaaaatgtctttctgaacttccccttcccacacccccacacatacaagcttttctcctcttctgttaactagaaaattatattttcgttgctgcctgaggaagagaattttgagtagtataaacactgattgtagtaaatgtggaaaataatacaaacagctgcactgcagaccgataagacaaatcccacagtaatggcctttaaaacatattaccaagttggaaatcagtgaggggaaaaagaaaactattactatttcttcctcttactgttcagtgacattatttttaaaggtgaaattacctctggttttattatcctaggaaggtatttttggaacatttgatttattgttttgcaaatgtttttgcctttgtgtgaataactttgctaattttgtatgaatttgattctaacaaatgttgaagtcattttgttaacaaaatcttctaaagtattttttaaagaaataaaaaggaatatattatgtaaacattggagcagactatcaaaataagaaaaggagaacatttttatctggctttggagtgccatttaaaataggaaaagggatgaaatatttgcagaaaatattttaataagcgtggatatgtttcatcaaatacaagtcttaatttttatgaagaattttgctattagcatatcaagtggtcagttcatatttgttttggcatgcattagactcatgataggcattgaatactttgttttttgtggattctaaaactgaattatcttaatcctaggctctaggaaaagtatatcttactgctagggaagattgaaataaattccagttctgagtgaaattttatttctgtttttctttacatcaatcttttctttttccttttttcttttttttttttttttatttttgagacagagtcttgctctgtcactcaggctgtagtgcaatggcatgatctcagctcactgcaacctccgcctcccaggtttaagcgattctcctgccttagcctcctgagtggctgggattacaggcgcgtgccaccatgcccggccaatttttgtatttttagtagaggcaggatttcaccatgttggccaggctggcctcaaactcctgggctcaagtgatccgccttccttgacctcccaaagtgttgggattacaggcgtgagccaccacgcctggcctgtccttccttccttccttcctttacaaactgtgggagagtggtgaaaaaaaggtgacagtcattatatatgtaattgtgacctgctttaaattgaatgcaatgttaaggacagcttattggtacttatacctatggtcacacattcattgatacagtttgtttttaatgtgaaaatttgtttccattttacataatacaaaattacttctatttgcctgggaatgaatctaacctttgtagtgtcagccaaaggaatgataatattgttttagtgtctcctacatagaagggaacgcccagtatggcctaggcagtgttctagactctgcagatagaacaaggaacaagacttaccttccagcagggggaagtagatactaaacatgtaaatacctaaataaggtgattttagtactaagaagttggatgaagactatgaaattgatagaaagtcactagagaaggcagctttagcaaggatggctaggaagtcctctctgaatagctaacactgagctgagacctacgaagaggagggggcaaacgtgcagaagtctgggggaaggaagtcccaggtagcagaaggggcaaagcagaggctctgaaacgggacaagcttgttttgtgtgaaggccagttggggagagtggaacgaggaagacagaaccagatcatctaggggccaaagaactgttttgttttgtgttgtttctttctattcatgttgtggagcgtttggagggtttgggtaggagagtgatgtgatgtgattttttaaatcattgcaggccttggggtagagacagagaaatcattgatttgaccattgcagacctcaggtgagaggtactggtggcttagaccaggaggcaccgtctgtttctatggggctcacaacttgagtggttattacatttttaaatagttgggggaaaaaattaaagaagaatgtttcatccagcctgggcaacatagtgagaccttgtctctacaaataatttttttaaaaattggctgggtacaatggtgcatgcctgtgggtccagctgcttgggaggttgaggtgggagaatcgctggagtccaggcagttgctgtggagagctgtgaccatgccactgcactccagcctgggtgacagcatgagacactgtcaaaaaaaaaaaaaatcaataatgtttcatgacccatgagaagtatgatgtcacattcagatcttattgatgataagcagttaactagaacatagccacattcattcatttttgtctgccatgtatagctgcttttgcagtttttgtcgtatgaagctgaatgcacagactttcttgccacgcagcagttcagtgggttattgtgatttttttttttttaatctcaggaccaagattaaagttttttgtgcagagttgcaggtagccaaattactttttgtattcctgtgccttagattcctcatctgtagagcaaaattgagatcgtctttcaggtctgtttgctctccacatcctaaggtcctaggtctgaatcagacttagttcttctgttgtggctgcttagcacatcaggctcctaactgaatgattgtagtggtgttttactcggtctcctagcctcgtccttccccattctatgtatcttcagcatgacctcagaccaccgtctttctaaaacatgagcatgtcacactccagttcttaactgtaagaactttgtcaggtatgagctctctttgtacaagatctgacctgggtttataattccttcctggtttcctttcttgccacttccaccttcatccaaccctatttctggccacgctgaactgcttaacattccctaaacttgccatgccatcgtgccatcccttaatctgaaatttttgttaactgtctcatcagcccacaatttttttttttttttttgagacggtgtctcgctctgtctcccaggctgaagtgcagtggtggtgcaatcttggctcactgcaacctccacctcccaggttcaagtgattctcctgcctcagcctcttgagtagctcggattacaggtgccaccaccacgcccggctaatttttatatttttagaagagacgggatttcaccatgttggccaggctggttttgaacaacctttttttttttttttttttttttttttttgagacggagtctcgccctgtcacccaggctggagtgcagtgatgcaatcttggctcactgcaagctctgcctcccgggttcacgccattctcctgcctcagcctcccgagtagctgggactacaggtgcccgccaccatgcccagctaatttttgtatttttagtagagatggagtttcaccatgttagccaggatggtctcaatctcctgacctggtgatccgcccaccttggcctcccaaagtgctgggattacaggcgtgagccactgcacccggtggttttgaacttctgacctcaagcaatctgcccgcctcggtctcccaaagtgctgggattataggtgtgagccaccgttcccagctgtttttcagttttcttttggaaaattcctgctcatttttaaaatttgtaattggtttttaattgataaattaaagttgcatatatttgtcatcctgtcttagtagtgtcttttgtgttgctacaaaggaatacccgagactggataatttataaagagaaaaagtttatttggctcgtgattctgatgtctggaaaagttgaggattaggcatctgatgaggacctcaggctgcttttattcatggtagaaggcaaaggggagctggtgtgtgtggaggtcacagagtgagagagaagggagggaggtgccaggctcttttaaacaaccagctttctcaggaactaagagcttgaactcgccctcaaagagggcattaatctattcatgagggatccttcccaatgatccacacacccccattatgccccacctccaacactggggatcacatttcaacatgaggtttggaggagataaactttcaaactttcacacatgtacaacatgttttgaagtacacacttcaaacagtggatacactgtggaatggctacattgagctaattaacatatatgtattacctcatatacttattctgtatgtgaggtacacttaaatatactcagaaaatttcaagaatatattaataatacgtcgtcattaactgtggtttctatattgtataatagctttctcgtacctatttctcctttataactgaaattttgtgggttttgattaatatttcctcaacaccccctccccaaccaccattctattttctactctatgagtttgacgtttccagattcttcatgtaagtgaggtcatatggtatgtctttctgtatgtacctggcttattttacttaatgtaatgtcttccgggttcatccatgttgttgcaaatggtaggattttcttttttaagtctaaataatattccattttgcatattataccacattctctgtatccgttggtccatggatggacacttaggctgattccctgtcttggccatcatgaatagtgctgcaagaaacatggggatgccagtatctccttgacataactgatttctttcctttggatatatatgcagtagtgggattgttggatcatatggtagttctatttttaatgttttgagaaacctccgtactgttttccataatggctgaatcttgttcatgttttttttctttcttttcttttctttgtttttttgaaacagagtcacgctgtggtgcccaggctggagtgctttggcacagtcggctcactgcaacctccaactcccaggttcaagtgattctcctgcctcaggctcctgagtagctgggactgcaggcacctgccaccacgcccggctactttttatatttttagtagagccaccgtgttgggcaggctggtctcaaactcctgacctcaaatgatccacccaccttagcctcccaaagtgctgggattacaggcatgagccaccgcaccctgcccctgtttgtttttaaatatccagctttaatgtctgtcttaacctatctaatgtcttccttattaacctttctgctcatttagtcggtctgtcctcttatcccataatactttgtacattttgtactatgcatttatcgtattgaattatacttatttttccaataattctgctgtcttttccttagtctcttggaaggtgggtcttaattcagccagcagtgcccaacacagttgagaggtagatggatgattagatggatgaccaacgtagaaatgccagtgtcaaaacctaggaatcaaccctccgttcttaactgagtctccctaagacacaggaaaggagtctattttattccattttgttttctgtctttttttgcctttattaagttcaacatgtgtgtataaaagaataggaaaaacagataagtgaaaacgagagtcaactaatatttttgcctagaaataagttttatgtgcactaattctagaatttttctgtaacataattttttacaaggcttattctgaacatattgttttgttcttcttgcccttagaaataaactgtaagcgtttttcatatcttgaaactttttaaatggcaggctggatatataccacaatttacttagctagtgtctttccccgtcatttacatttcttgccattgttcagttctataaactacactgtgatatttgttcagctttatttttctgcctatccttacattttttcctcaggataaattcttagaagtaaaatgggttggctgggcgcagtggctcacacctgtaatcccagcgctttgggaggttgagggagcgggttatgaggtcaggagttcgagaccagcctggccaacatggcaaaaccccatctctactaaaaatacaaaaaattagccgggcatggtgggagatgcctatagtcccagctacttgggaggctgaggccggagaatcgcttgaacccaggaggcagaggttgcagtgagccgagattgtgccactgcactccagcctgggtaacagagtgaaactttgtctcaaaaaaaaagatgtgaaatgggttggttgggcatggtggctcatacctgtaatcccagcacttttgggagctgaggccaggagttcgagaccagcctggccaacatggtgaaaccccgtctctactaaaaatacaaaaattaggcagatgtggtggcaggtgcctgtaatcccagctactcaggaagctgaggcaggagaaacacttgaacctgggaggcagaggttgctgtgagccgagatggtgccattgcgctccagcctgggtgacaagaatgaaactctgtctcaaaaaaaaaaaaagaaagaagtgacatgggtcaaaatgctcccatactgattttttttctactctataccacactgccttaagtatgctatctagattaccattgtgtcaatttacttggcaatatttgcaggtaggggaaaacattttgcattaaaccactgtctttcttattgatctaacctccctccgtcaaggaaccgaggactcagcttgatttctagaggttcactctgggttctattacttctgtgatcatagagatcagagttggtaaacctccacttctgtaaaaaggaatgaaattaggatacatctgtatcgtaatgctcatggcatgtagttgagtgaaagccactaatactctacatctgggaacttaaaaaaatgatgctggcttagttagaactgctttatttgtgtgtgtagtctttgaagtcactgagccctctctgattagccagaagaggaagaattctgaggaatacgttaggattaagtagagcaagttttttttgtttttgtttttgttttttgagacggagtctcactgtcatccaggctggagtgcagtggcaggatcttggcccaccacaacctcacctccgcctcctgggtccaagcaattcttctgccttggcctcccgagtagctgggactacaggtgtgcaccaccacgcctggctaatttttgtatttttagtaaagacggggtttcaccatattggccaggctggtcttgaattcctcacctcgtgatccgcctgcctcaacctcccagagtgctggaattacaggcatgagccaccgcgcctggcccaacagaccagttttgtaggtgagaattatctcacagtgtagtcagcttccagtgtactacttattcacccatttttagtagcagtagtagttacttttaactaaaattttaatagtcatagtatttacttttaattaaaattcaaacaagatatatgcaagtgatatatttgctgtaaacaaattttatttataaataaatgaataataaagaggttatttctttcactactctctggacatagaattgcattgttgttttaaacaaatgctaattcattttctataactattttattgagatataattcacacaccatacaattcacccatttaaagttacagtttagtggtttgtagtcaattcacaggggtgttccaccaccaccacagtcaattttagaccatgtttatacccttgagaaaccccacaccaattagcagtcatctccatgtcctcccagacctcctcttggaggcatctaccaatctaccttccatctccatggattttactattctggacatctcttattaagtggaatcatataatgcatgatccttggtgaccaacttctattgtagcatgtatcactacttcattcctttttatggccaaataatattccactgtatggctatactatattttgtttacccatccatcagttgatggacatttgggttttttggctatcgtgaacattacatacaagctgtgcagatatgagttcattttatatctcttgtttgttttttagtgtctttctcgagaagcaggtggaaacatgagcattcagtttcttggtacagtggtaagtatgaaatcattctttattctcttaatttacagagaaaaaatgttcaactagttgtagctcatgtgtttgaacttggcttcattactgctagatatttaaattacctctacttttttgcctttacaaatgatattctagggaacaacttcatatatttcactttattttagtgtttggaattattatcttttttgagacagagtctcactgtgttgcccatgctggagtataggggcacaatctcagctcactgcaacctctgcctcccgggttcaagcgattctcgtgcctcagccacccaaatagctgggattacaggtgcctgccaccaagctcggctaatttttgtgtgtttttttctaaagatgaggtttcaccatgttggccaggctggcctcaaactcctggcctcaagtgatccatccacctcggcttcccaaagtgcgggattacatgtgtgagccatgtccggcctggaattattttcaaatgtggataagatatttttaaacatgtatgatatattttctcccaaatagaatcaaagtcataaatagttttatggcttattatacatgttgcccattattttatgtccctttagaacaccacccatcatatattagaacacaactttgcattgtcacctagtgtgagttgtaattttcaagattagtaaacttgatctgctgaagagtttcaatttattattactattttacttataagtttataattagtattagttactataattttcaaactaatttgtttaaaaaggtaccttatttggcttggtgcggcagctcacgcctgtaatcccagcactttgggaggctgaggcaggtggattccaaggtcaggagtttgagaccagcctgaccaacatggtgaaaccctgtctctgctaaaaatacaaaaattagccgggttgtggtggtgggcgcctataatcccagctactcaggaggctgagggaggctgaggcaggagaatcgcctgaactgaggaggtggaggttgcagtgagccacgattgtgccactgccctctagcttgtgtgacagagcgagaccccgtctcaaaaaaaaaaaaagtaccttattttaattttcatttttctgtttattgctattgtatttgaatatttctccatgtattcattcaccagatatcatttctaatctgtgaaatgtctgttcatgtcctttgggtacctcattcaggatatggattcatattgggcatttcagataactctggagtttattaagaatatcagaggtattctgcaagaatatcaagaggtatttcaggcgagagagcttgcgtgaaaaagggttttgcagccattgagataggaaggatgttaataaaatgtgtgtttactgaatgctttatcgattatagagatgtatatataatttatgtatataaagtatatgtataggtacttggtcaatgtaacctaaattttaagtattggaactaagttttgtgattattcttgtttttctgattagtaaggtaatacatgcttattgtaaaacatttgaaatacaattcaaatgtatgtcataatatgttgcattagtcaagattctccagagaaatggaatcaacaagatgtgtgcgtatgtgtagagagaaagagaaagatagatctaaggaattggctcaagcaattgtggaggcttggcaagactaaaatctgcagggtagatgagcaggctggagacccaggggagcgttgcagttcaagtccaaagacagtccactggctgaagccctccttgcttggggaggtctgtctttttctcttaaggcctttaacgggttggatgaggcccacccactgtggagggtgatctgctaaactctaagtctactgatttcagtgttcgtctcatctaaaaatatcttcgatgatacatctcagtgtttgacctaacatctgggtaccatggcctcgtcaggttgacacataaaattaaccatcacagaagtatatatcctatccctagaggtttttaagttattagcaatagataattcttccagaaaattatgcatcttttcatgcaataatagatcttggacacctttctgtgtcagtccgtaagatggacctcagtcgccttaagggccacacagagctgcattacgtggatggagaggactgctttcactcctcagtgttcgtgctgggaagtccactcatgctgtctctgctacttagcatctctactgggtttctaatcggtttctcaacttcatgtatcggaaactgagctcgaaaagtttctccctcagtttttcctctctctgaaaatggcaacttgaactaatccttgattactttctctcctcttcctctctctcctcttcccctcctctcctctctcctctctctctctctctctctctcttctctccttcctctccctctctgtcctcttcctctcctctctgtcctcttcctctcctctctgtcctcttcctctcctctctctcctcttcctctcctctctctcctctctctcctcttcctctcctctctctcctcttcctctcctctctctcctcttcctctcctctctcctctccctctctctcctctccctctctctcctctccctctctctcctctccctctctctcctctccctctctctcttttctccctctctctctcctctccctctctccctcctctccctctctcctttcctcctcttcctctctcctcttcctcctctccctctctcctcttcctcctcttcctcctcttcctttctctctctcctcttcttcctctccctctctctcctcttcttcctctccctctctccttctcttttttctttctcctctttctcgctcctctttttcttctctctctctccttttctcttttccccatctgtctctccctgtctccctctcccctgtctctgtctctgtgtccccacgccccccactcctggccctgcctttagccatctcttgtttggaggatggcagtagctggcgtccacctcactgccatgctactccctagtccatcactaatagagcaggaaaaggagtcctttgaaaacatcccttggttggccttgttgctcttcttcagacctgctgggcacatgccttagggtctctgcccttgtttttcttctactaagaacatctgcccctacatgtctgctcaggggtttcctcactttcttccggtctttactcagtaggctccttctgaaggaaggcttccctggtcacgccgcttacagttctggtcactctttccaacatcttattccccctcgcccactttatttatttatttttttcattagcagttaccactgcttgacatactgcaattttccttttttgatgtatttgttgtctatcttcctcacctggaagtgataagctccttgagtgcagggtgatttgtctgttctgctcagcgtgctctgcccagtgccctgaacaaggcctggcttggaggaggtattcagtcagggttgggcaaatgaatgactgaaattggccaatgtaggacctgagtgttagacttgaaaagaaaactaaagaaaggaaatacaggcctggctcggtggctcgtgcctataaactcagccctttgggaggctgaggtaggaggatcacttgagcccaggagttcaagaccagccagggaaacaaagggagaccccatccttacaaaaaattagctgggtgtggtggtgcatgtctgtggtcccagctacccaggaacatcacttgagcccagggaggtcgaggctacagcgagccgtgatcacaccactgcactccagcctgggtgagagtgagaccctgtaccctgtctcaaagaaaaaagcaaatatgaaaacaaatggaggccgggcatggtggctcacacctgtaatcccagcgctttgggaggctgaggtgggaggatcacctgggtcaggagttcaagactagcctggccaacatggtgaaaccctgtttctactaaaaatacaaaaattagccaggcatggtggcaggagcctgcgatcccagctactacaggaggctgaggcaggagaatcgcttgaaccttggaggtggaggttgtagtgagctgacattgcaaccactacactctagtttaaaaaaaaaaaaagaagaagaagaaacaaatggagaaaaagaaagtgcagggagctttttgggactgtggagctgaactaagctgtcttccatggataaggaaactgtatcttagaaaaggtcacttgacttccccaaggtttcacgtctggctggtgtgtagagcactaaagggtatacagatttcctggctctcagttcagggcctgttccatcagcaggtgcccttcaatttcactcccttttatccacttcaggcacccaaaacatgctagcataaaaaaacacaagaaacaaaaacacaccacatgtacacacccctacttaaatggacaacaaaagtcaccggaaaaaagggaaaaaaagaatgtctttttgatttgttttgttttgtttttgtttttggagacagagtctcactcagttgcccaggctggagtgcagtggcgcgatctcgatatccgctcactgcaagctccgcctcctgggttcaggccattctcctgcctcagcctcctgagtagctgggactactggtgccggccactacacccggctaatttttttgtatttttagtagaggcagggtttcactgtgttagccaggatggtctcgatctcctgacctcatcatgatccacccgcctcagcttcccaaagtgctgggattacaggcgtgagccaccgcacctggccaaaaaaaaaaagaatttcatgtagctgacactttcctctgcccctaataaatcatagattccttgccaatgagttctaaaggggctgtgtccactctgtttatacagtttatacctagcaggaatgtcagtttcaggtacaatttctagagtaatttctaattactgtaaaattcacagtacagcatagcagtttggatggccaatgtgctttgttttactgaatttttctgtgtgtgttattagcaatagtagatcagtctgaaagggggaaagaaatagtttgaagatagtagtggtcctgttacaacaaatacagattgattcctagctagcatatgttgcttcagtcaaagatgtctaaagcaagtatagtttccaagacacacaggtcaggaatagcagcatgtcccatggcaaaggtgatgctttccaggtatagatttgtctttgtgagaatccttgtagaattttctatataagtttgtttttgtcaatattgataaacatgatcttcaatgttcaaaggagagttcaattttagactaagagaagtacttctgttgtgtaaataaggttcaaaaataaggttactgttcaacttagagaaaatacaaacttaaaaataattcatttcattttttattcactctgaacttttaaaaaaagctggtttgtgattttcattttcagtaaaacaaatctcattactttaaaaaaaatgcttgtattagatattatatatatgaaatattatactttacattcttataaaacatttataaagaatgatgatacaacagatttgcatacctaagtgtaagacttgaacaaaagactaaagacaggaaatacaggcctggcttggtgactcatgcctataaagccagcactttgggaggctgaggtgggaggatcaaatacatcaaaaaagtaaaatatgtagtatgtcaagcagtggtaactgctaatgaaaaaaagtaaataaagtgggcaaagggtggaataaaatgttggaaagagtgaccagaattgtaagtggtgtgaccagggaagccttccttgagaaggaggctactagcctgaagagtttttaaaaacgtaaccattagtttggaaggtctctgtgttactcccattctgtcactcattctctccctgcacaaggaactaacatcttcccgacttgtatctattattctttgcttttctttataattttcccacatttatatccctaagtgatatacatttttgttttacgcgtttttaaacttgatatacatagaattatattctggaatcatctgtgacttggtgattttgctttgtgtttgtgagactcgtatgttgcatggaggtataattcatttatgctcagcaatgcaggatgctgtggtgttgataaactagcctgctactcatggataattgggtagtttccagtgttttgtgctgtaattctcactactacccgaagcattttggtacgtgggtatatgtgtactgatggcacatatgcaatcgtttctttcttttttttttgagacagagtctccctctgtcacccaggctggtgtgcagtagtgcagtcttggctcactccaacctccacctcctgggttcaagcaattcttctgtctcagcctcccaagtagctgggactacaggtgcatgccaccacactcagctactttttctatttttagtagagatggggtttcactgtgttggccaggctggtctcaaactcctgacctcaaatgatccacccacctcagcctcccaaagtgctgggattacagatgtgagccaccatgcccggccatatgcaatagtttctttagggttttgtgcattgagtatgcagtgaatgagttcactttgttccacatcttcacttggatcttcttaatttttgccagtgtgaatagtgccctcattgttgtttcaatttgctttatcctgatattaatgaagtagaacatcttttcttatttattggctatttctcttcatcagccatttggtttccacctctgagaagtacctcttatagctttttgtgtgtttctctatgacatgggactgcaaaaatacatgaatttagtatgtgaatgatacaaattaagtatatgtcatttggcttttcaataaggcaagagggttaggtgtggacttttatgactcattcttgtagggcccaggcctttggggcttagcgggtgttctcccggtgtgcggagacgagagattgtaataaataaagacacaagacaaagagataaagagaaagcagctgggcctgggggaccactgccatcaagatgcggagaccggtagtggccccgaacggctgggcgcgctgagtacaagaccagggggcagggtaaggagggtgaatcttctaagtgattgacaaggtgaagcaagtcacgtgatcgtagaacaggggggcccttccctcttaggtagccgaagctgagagagagaaggcagcatacgtcagcgttttcttctatgcacttataagaaagatcaaagactttaagacttttactatttcttctaccgctatctactacgagcttcaaagaggaaccaggagttacgggaggaacatgaaagtggacaaggagcgtgaccgttgaagcacagcatcacagggaggggtttaggactccagatgactgcgggcagactgggataatatccagcctcccacaagaagctggtggagcagagtgttccctgactcctccaaggaaaagagactccgtttcgcggtctgctaagtaatgggtgtcttcgcagacactggcattaccgcttgaccaaggtgccctcatgcgggcgtgacagagggctcacctcttgccttctaggtcacttctcacaatgtcccttcagcacctgaccctatgcccgccggttattcctaggttatattagtaatgcaacaaagagtaatattaaaagctaatgattcataatgtttataatgattgataatgtccatgatcatctctatatctaatttgtattatgactattcttattctaactattttctttaatatactgaaacagtttgtgccttcagtctcttgcctcggcacctagataatctttcacgcacacgttctgactatgagctatgaatggaagtgactgtcaatgactctgaaggttctgagatttatgctacttgctggctgacaaatcagcctgcgacatttcatagatgctgatagaaaacatgagactccaggatcagagatgaaggacagtttattacagcagcagcagtggtcaggataccattgtctttgtaccatttccctgaacccagattcctctagggcaatgcaaagagacatgatacctgcacacataatgggttgcattataggagaggagctctgagtttagagaacctgagtctttttatactgtgcagtaatcgcacctgccctttgatctggagggagacactctaccaaggccatttactgtacaagcatctttgaaaaggtagttcagagcaaagaacaatcagtgtcttgctcacaagaagtggaaaaatgcaagagacctgggggtgaattgtctcctggtagtgatgtgtgtcacttttggtcagagatagctaagagcaagtgtgagccctctagtccctgccatgccccccttggaggttgtgtgtgacgctgatgctcctgtcagcatgagttccttctgaagagtggcagtgagcactgctacttgcaagctgtagtagactgggatctcagtgttgacttattgctaatgcgtagcccagcttatcctgatacatagtctgggaacatgaaggaccaccttctgtttatagaaccccatgtctgcttatagatttcagattttatagagattcattaggtttattctgtctactttcagtcctttcgcttataaactttcaatccaagcataaggtctttttcctgttacgctgtttgaactttgtttaaaaattgtggccaagcatggtggctcatgcctgtaatcccagctactcaggaggattgcttgagcccaggagttcaagaccagcctgggcaacagtgggaccccatctctacacacacacacacacacacacacacacacacacacacacacacacacacagtgggaccccatctctacacacacacacacacacacacacacgcacatatacacacagtgggaccccatctctgcgcgcacacacacacacacatacacacacacacacacacacacacacacacacacacacacacacactagcggagtatggtgacgcccacctatagacccaggtactcagaaggctaaggagtaaagatggcttgagcccaagagttcaaggctatagtgaggtatgattactccacttcactccagcctggggaacagagtgagaccccacctcaaaaaaatcaaaaaagcgaagatttaaaaattaaaataagattgttagccagttttttgtttaatgaaggaaaagttttccaaattaacagaatgggacattcagataaaatttgtgcctttatgacccaggaggatggcctgggtgtacatacaagtactcaggacaccacattctcacctttggtatctatccgttttattactctgccactcccaaacagtaatacataggattccgtgttagtttcctagggctgatgcaacagattagcacaaaccgggtggcttaaaataacagaaatgtgttccttcacagttctgggagccaggaatctaaaatcaaggtgtgggcagggttggcgcctccctagaggctcttagggagggtctgttctgtgcctctctcctggcttctagtagctcctggcagtccttgccttccttggcttgtggctatgtaattccagggtcttctgctgctgtcacatggccttcttccctatgactgtgtgtgttcattcacataaatccagcaccaccagtcatcagatttaaggctcaccctaatccagtgaaacctcatttaactcattatgtctgcaaagaccctatttccaaataaggtcacattctgaggttctgagtagatatgaattttgggatgacactattcaacccagtatgctatatagatctgaaagcctacttgacacacatgtaaagctaaaaagtgactgaggcaacttacctgaaaatatattttacaaacagagcattacttcttaggtctcatttgagtactaccatttatttccctagtattttcatacatcacctgtatgactgcagttcgtaccccatactcaaaaatgcaggaacactgatgatggctatgcctaattttcagaagacaaaagtgagcatagaaaggttaaaataactatcctatggtaataactggtagaaacaggatgcaaaaccagccctcaccaactttgaagtcaggctgttgaacatcagaggaccttgagaacaaattgcttgactgtggaatccagggagctctctgcagtaactgctaagtacaactgctcaggctgccataatgaaacaccattgaccgggtggcttaaacaacagatgtttatttctcacagttctagagcctgggaagtctaagtaaggtgccagcagattcagttcctggtgagggccctcttcctaggctgcaggcaaatgcctattctcccgtagcagagagagagtgcaaactctgatcttccttcctgttaagggcgctaatcccatcatggggccccaccctcatgacctcctctaatgaactctgaaaggctgcgtctccaaatactgtcacattgagggttaggcattcagcatatgaatttggacgttcagtccctaacatacatttggttggtaagctgcagatcccagaatttttccaggatatctgtgcccatttcaaattgcaaattgtctgggttttgtttgttttgtttgcatgttttggtgaagctgtgagtctgtgtacatcagatagtgtaagctcacaaagaaatcgaagagagctggtgttttacttaaccagaattccttacttgaactgtgcttcacaataagaataaatattttgttattaaagaatgcagaagttaccattttattgcaaatttttattataattaggttttaaagtactataataaggcaaacatatctcagtgagactgactttttttcccttataaaaacaatgtttgtatgaaagagaaaataagcttagactccattgaacagcttcttcatggctgcagtattggcattcacccaaggactcttgagaaacgatcaaattttcagtatctttgaagcttagccagagatctaatgaaaccaaatgatgctaaagttcttaaagctaatttaaatctcaaattatacattttaaattaagtttttattgataataaatatactttatttcatattacccttgaaagcttgagtgataatattagtagaataaacatgttttacaaagatttaccattaagaatgctattaatatgacccttgatacaccagcacaattagatttcaaagtaagcacttatgaagtaacagcgattaatgacaaccatcgaaaacaattttgaactccatcagtttaactcaggagggtaaacttaatatgataattcatctagttgaattgtatcagcttagcaggaaggtatgtaaatatgtgacccttacctagcttctaaatggatgctgtgctgatagatttatcagttccattaaagaactttggggaactttggagtttcagcaattgttcccttggaggctgaaaacccaacctgatctcatactgggaccattctggtctgcatatttccataatttgcctttgctactaatatgacagcaagacacaaataactgtttctaataatatcagatggagttgtggaggacagcattttaatgtagtaaaagacctccccgtggggttgttattgctactatagaacagcagctacacagttgcaactgtagtctcttaattgattcgtttaattagcaagagctgaagcttgggctgtatcttgtcatctgatatcataggactcgaaatttgcatcattcatatttatagatatgtaaacatcatcaaaaaggtcttctgcttctgaaaattcacttacagatatcaaattttaatagagcagactcccatttgtttgaaatttaactaattaaaaaatgaaaagaattaagtttgttactgtttttctttatctgtactcttgagaaataagtgatgtcatacatttttggttgtggatcatctcctaaacataaacttccagagaacttcttcagtcttccgtatctcataattccataagcagtccctcaactgacatgtctgacttaagttgatctctcctctctgtcccatccctttctctgtgtcagtgtgatttcaggaatgacatgatggcttactggggtttcttgcacacgtgtgctgtaactttccacctgtccctgcctgcctttgcagctgctccaagtcctgctagggtaggctgtctgcttgtgctgtggtttggtgggtcatctggctgagttggctcttggcagttacctgcctacccaagctgcattggtccccactttctctggaggggaaaagagaaacggatagaaagtatctggcatagaaaccagagcctttctagtctgtttaccctcaactccacagggcttcctccctgctcggtcacactctttgtattcctgacccttttctagtccaacaataggaagcaggtggcggtcacagagcagacactttgtggaggggtgatgaagttttctgatgttcagatatattttacagtgctaagaaaatctatagcattccttcctgcatttgcccctaaatatacaaaatttcaggcaaaatatgggtagaataagattttatgaaatggaatataaatgtagtcttaatcttgaacattgtttctgtggtaatgtgtgttctgtgtgccatgtaaccaagctaagaatgaacttttggaatataactacgtttttattcttttgaaattggcatgctctatataatataaaagtttggttattagtattgcagtgtgatgcattctgaacaaaaatttaaaagaaatcattgcctgcctgctatactatgtgctaggaagtgggttagttgaacatgacttggtccctacccttaagtagcacactggctggtgaagacagacaaactgataccatgcaaacatggtatcagtgctgagatgggtaatgcataggcttatatagtagcagagcgaattgtagatctgttagctttattatttgtttcttttattgataaacagtacagtccatagggcgtaggtctctggttaagaatttgcattttatttgtcaagtacacctcaataaacacagggaaaagaagaactgtatttcatatcttattagacattactttttgaaaatgagcacaaaacctagcatttaatggtagtcatgagagtcagtcagtcatcttacactggtgacagacactgaattctggcaattcaaaggaaacaaatatccctgcagtcattgggcccattgtcacctaaggatagagaaatgtaaatgactgattaccgtgataagaacgctaacagaggtgtatacgaagtagagggattctggggctgaggtgaagaaagtggagaaattgtgaacagtttttcagtgtttatagctcatgctgtgactttaaggatgaattgagtttgcaggagaaggcatttcagatagagggaacagtgagcctggagatagcaggttgtagaaactgcactctgtactgatgatggagaaagaggacggaatgaaattaataaaggcgcagaggtattaagatgtcccaagtgtttaaggaagagcagattggcttatgagggtgatgggcagggcaacaaagatccctttggaagatgaaattagtctgttgggggcaagatgacacaagaccattccaaggaggttgggtggcattccctagattctgaggttcattgaaggagttgaaagaagaatcataatctcatcagaggtggttggttttattggtgtggtttttttttttttttttttttttgacaacttatgggagtaggcaaagaaagaagagggtacatttgagagccacttctttagaatccagtgtacaattctatgtattgggcagaattgaagataattctgagatttctagaggtgataactgatgcagttagggaggaaaaacaggaagaagagaagaattgtaccagagaaaaggtggactctattaaaaagatggatttaaccaatttaagtttgaaatgccaagagacatctatgatataagggaaatttctggtctggagagcaagaagaagattaagagtgagcacgtaagttgatgccccagcagaggtgaggtcctaagccatgcagtagatgaacctgccaaagggacaatggcaaagcagaggccaggcccagaatggagctccaggaaatgcccacagctaaggtggaggcttgtcctctctaatggagtcacttacaaaatgatgacatgtttattattgaaatcatttatatatactattagaagccagttcattgtaacctcagttatgatttcacagtatcctagggtatcactaagttatttcaaagtatctcaggatctgttgccacctgccaaagatcttcaaagtaaaattaatatttataaataatgccttacgcgtgtatggtgctttagggctttagaatgattctacatatgtcagcttacttgattccattcaattgctaagatgaataagccatagcacaccttagagtgagtggtaaaaattagacatggaatacttcttgcagtgttttccatttaaaatatttgagattacaagttatgtgttcacaggaaattaccacgaaccactgccagattgctagtgaacaggatcgggcaggggtgggggaggaataagtagagtttgtcttcctgcatttgaatcgcagatcacctgtctcttagctttgtgaatttgaacaggttgcctaacctccctggtcctcaattttttcatcaacagaatagatattatctgcttttatggagatggcaagggctgaaaaagaaaacgtttgtaaaatgcctgaaaatagcaggcacttggcaaagaatagctcggtttttattgtagctccccactctccctttgcttcattttccctttcatttgtcttgcttggagacatgctatcatctgaagtgatagtctccaccgagtcttcaatttggtgcttggcctacagaaaaatccagagggaaaatattgttcccttttatttgaaaaaccaaatttgtgttaatcccctggttatgaccccttaacatagttaatgttttgtaagtgaatatggaatagaaagcacatacttaaatgtgtaccttgtggtggcagggtgcttaaaaacatctgtttccttgaagaatcttgcgaatcaccaacaccaaacttgaccagggaagaatttggtgccttgtgtttaaactgtgctgcttaaaatatattcagatggaaagaatggcaaaaccattctgatataggacattttatgacagtgcctatgagatgttctttcttctactggcctcacttttaaagggatatcattttaggtaggctgtttcagggcactgtcatatgttactgtggactatcgatctcttgtacctatgaattatttgattgtcactctttaatttatagtgagaaggaagtgggaatggcagctcttctcttatagaagaaaaatctgagtcagtggttctcaagttttatcatgcctgaggatgaccaggaaatcctggtgaaaatacagattcccagatctgttcctagaaaagctgaccccccatgtctgatgtcgaaatcggcttaaaatgcaccaggactagaatttgcaatatattttgaacattaatgtagaattactatctagtttggaaagtcaataccaaaagacacatgatattcctggccccatgagccaagcttaggagcagtgttctggatccttttcagaatgagaagataggacaaacatttgattatttgtgctaattaacatgtactttcataatacatacttttttaaaatcagggagtgacatgataggatctaaagtataattaggtccatagtgtcatcaactgtatcttttaagtttacttatcatctgtataattctttagattcagtctgagttatttcaagtcttatagacagtgataatttttatttttgccctagagcagggcagtgttatctgtttgggcagtattaacattttggacaattctctgttgtgggagactgccctatgcgtaataggatgtttagcagcatccttggcgtccaccaactagatgtcagaacatgtctccagatataacaactaaaattgtctccaaatattgccaaatggctgcacacagcttggttggggagagactccagaacagatgtgaaacttagtggctggaagcttacaaagtacacatgtcatgacctacttgaataccttatgcgaagaaaataaactttacccgtcctgatactggatttgctttaggaacatgtttagcgaatagctgtttggaagtgtgtaaggggtactttttctttatcttcctcatattggatcatgaaccaggtctaccatggacagccattcatggaatttagggcaaagtctagtttgtgtgattgcattgtgttcatttgggttctttttaccatttgagtagatgtactgttactgcttaccaaagacacattttgggtatacagtgcgtgtgcagctcaataccttattctagaagctgctgctcttcattttgtcttcagttttgtaaaagccccgtaatcctgctggtgagacatattagagtgtgataagcatcacttcacagtgacatctgtgaagttcttctgttctttttgcagctactatttaattgtttggctatttaatattttgtggcgcttccccccttgtgcaaggaagtatatggcaggatgcctgacaagacacgtaggaagccacacagtagtcagcatctcaagtgtgtgttcctgagaaatagccttcccaagccggcatatgttttgtatggtgtaaattctcaagattgtgaggggaacagctaaggtaattcctaaggtatccgtgttaattacctaaggtaattaccaagcatcagggaacatagcaacactgcaaagtcaaagtaccctcgtttgaaatagaatctctacctgatttaggggttagggaaagaattagtggataggttctaacaattacccttctgaggtcacgagtttgagaccagcctggccaacatggtgaaaccccatctctactaaaaatacaaaaattagctgggtgtggtggtttgtgcctgtagttccagctacttgggaggctgaggcaggagaattgcatgaacccaggaggcgggggttgcagtgagctgagattgcgccactgcactccagcctgggcgatagagggacagtccgtctcaaaaaacaaaacaaaacaaaacaaacacagttacctttacagttcaccatggccaaaagattgtaccactcctttcctgtctcagccactttttgagtgactgtaaagtaggttggccgggggacgatcgttgcttgctgagtgcctgtaggtacctagcaccgtatgtttgtcattctcattgaagtctcccctttgagatcaccagtagaatccccatgtttcagatgcagtaacacggacaggaagtaagggatttgctcagagtggtttatatcagaagagcagctgtaggaccaaacccagatctagtaacaaatgtggcttccttcacatgagcatctgggtggttgggagttagttattcctgactgttgggtggagagcaatttgatgggacaaaaccagttcttctgtgttgaggcttagacaccagccacttaacgggccagacagctgaggtccggatttctctgcttcctgagccagttactcttgtatagcgggggaggagtgggcacattctttttttgagatggagtcttgctctgttgcccaggctggagtgcagtggcacagtctcccctcactgcaagctctgcctcccgggttcaagctattcttctgcccagcctcttgagtagctgggactacaggtgcccgccaccattccagactaattttttgtatttttagtagacacggggtttcaccctgttagccaggatcgtcttgatctcctgacctcatgatccacccgccttggcctcccaaagtgctgggattacaggcgtgagccaccgcgcctggcatcaagtttgattgtgagagtgcagcaattcagtcacatgtccaagctccactcctagttcttttgctgttttccctacatctgcagttacttcttgaacccctcaaagtcacccatgagggttagaatccagttcttcaaactcttgttcatgttgataatttggcctcttcccatgtgaattcaacacaaatgttcttaatagcatctagagtggtgaagaaggttttcaatttactttgcccagatccatcagaggaaacactgtggcagctgtagtcttccaaatgtatttctgaaataataagacttaaaagctgaaacgactgcttgatccatgggctgcggaatggatgtcgtgttagcaggcacaaaaaccacattcatctccttgtatatctccgtcagagctcccaggtaacaaggtgcattgtcaatgagtagtaatatttttaaggaaatatttttttctgagcagtaggtctccacagcaggttttaaatattcagtaaaccatgccctaaacagatgtgctgtcatccaggctttgtttttgcgtcctagagtacaggtagggtagacttagcatcattcctaagggccctgggattttcagaatggtaagtgagcactggcttcaactaaaagtcagcagttgcattagcccttagcaagagagttggcctgtcctttgaagccagaggtttacttctcctctctagttgtgaaagttagatgacatcttcttccaacagaaggctgttttgtctacactgaaaatctgtagtttagtgtggccaccttcatcggtgatcttaactagaccttctgcgtgacttactgcagcttcttcatcagcacttggtactttgccttgcacttttatattatggagatagtttctttaaacctcatgaatcaacttctgctagcttcacacttttcttttgcagcttcctcgcctctctcatcctgtgtagaattgaagagagctagggccttgctctggagtaggctttggcttaagtgaatgttgtggctggtttgattgtctatggagaccactaaaacttaggctgggcacagtggttcacacctataatcccagcactttgggaggccgagaggggcggatcacttgaggtcaggagttcgagaccagcctggccaacatggtgaaactccatctctactaaaaatacaaaaattgagctgcaacaatagaaagatggtggagcaagaacaaagaaacaatccctttgactgggcgcggtggttcatgcctgtaatctcagcactttgggaggctgaggcgggtggatcacctgaggtcgggagttcgagagcagcctgaccaacatggagaaaccccgtctctactaaaaatacaaaactagccggacgtggtggcacattcctgtaatcccagctactagggaggctgaggcaggagaatcgcttgaacccaggagacggaggttgtggtgagcaaagattgcgccattgcactccagcctgggcaacaagagtgaaactccgtctcaaaaaaaaaaaaaaaagaatccctttggttccagaaaatctcctgaaaaagaggaaggcttattaagccttcagagctacccaggcaaagcaggtacttttggcaaagaggaacaaaggaaaggaaaagggctcaggtttaagggactggaatcctacatgattcctggcggcagaaacatgacaaggtgggtctcagacgactagaagtgaaacctcatgctttggaattgccagataaacattccttggcctttcttgtacgtatcaaaaggattgatggtgtggccgggcacggtggctcatgcttctaatatcagcactttgggaggccgaggcgggcggatcacaaggtgaagagttcaagaccagcctggccaacacagtgaaaccccatctctactaaaaatacagtattagctgggcgtggtggcaggcgcctgtagtctcagctactcactcgggaggttgaggcaggagaatcgcttgaaacccggaggctgaggttgcagtaagccgagatctcaccactgcactccagcctgggcgacagagttaggctctgtctcaaaaaaaaacaaacaaaacaaaacaaaacaaaaaaagtttgatggcgtgtgagtttactggtgcagaaaaccattgcaagattttgcctaaagaaagtttttagtggtgtctttgtaaaagtcaccccctgctgcatgtaatgggatcttatgtgacctggggatttccaaatctgaattttctctgggaactgattttgaaacgtggtcaaggtcaagaataagaccatccctctgacagacaacacagtggttgcggagcacctggggaagtatttccaggagacttcatggttcttgcgtcgtttccacctctcagtggcccatcatgctaccaaaaatagagtgggcttcctcgagatgggcacacctggctatcggggtgaacacgtcaatcagctcatccgccagctgaactagacccaggtgccaaactgcagtacatttttatcagtgaagtggaagcgtgtgttttgggtttttttggggaatttttatcaagtatcttcagagaagattatttcctgcttaatcttcaaaaactggaaaggaagggtcaaagaaaagacagtagcttatgtttatggcgggcacctctcatcacagtcattcccaaggaaaaattccagagttttctacattggcagctgcctcgtctaaatcaacacattccatgtgcatcttctatccttgggtttaatgttgctaaatgagtaactctagcatttgtacaagaccccctaagactctggcagcagtcgaccaagcccagggacataattgaatctggagattcctgaggccttgttttgaaaaagacttgaaatacacataggaagaaaggcccaaaaataaatgttcacttgtctctgcaaaaaaataaaaataaaaaataaaattaaattaaaaaataaaaatatgaaaactagctgggcatggtggcttacgcttgtagtcccagccactctactcgggaggctgaggcgggagaatcgcttgaacccgggaggcggaggttgcagtgagccaaggtcacaacactgcactccagcctgggcgacagagtgagactctgtctcaaaaaataaaaataaaaaaacttttcatatcagcaacaaggctatttcactttcctatcatccatgtgttcactggagcagcacttttaattttcttcaagacatttttcctttgcatttacaacttgagtaactgcacaagagacctagcttttggcctgtttcagctttccacatgctttctcagtaagcttaatcatttctagcttttgatttaaagtgagagacatgtgactcttcctttcacttgaacacttagaggccactgtagggttattaattggcttaatttcaatactgttgtgtcttggggaatagggaggcccaaggagagggagagagatgggggattggccagatagtggagcagtcagaacacacacaacgtttattatagtttaccatcgtacatgggcacagtttgtggttccccaaaacaatttcaatggtaacatcaaagatcagcgatgacagatcaccacaacagataacgacgaaaatgggtttcctaataatgcagaggtttgaaatactgcaagaattaccaaaatgagacacacagatgtgaagtaagcacatgctgttggaaaaaatggtggcaatagataaagggttgccacaaacctttaaattgtaaaaagtgcattatccttgaaacacaatagagtgaagcctaataaaatgaggtaggcctggattttttggatacttgatagtatctaagtttcttctcaaacacagcaaacatttcacagttcaaatttgcccatcggtagagttttctctgtggatcttctctgttaatgccacatctgtctagagtaaaagttcaattcaatattgtgctatcaacttagcaacttgttgaagatgaactaacataagtacatgctgtgtgtgtgttctgtgtgcagacacaacacaggtgagctttccgtaagcctggatcttcccaatggcggtgcttctcgtgtgcaggccaactagggagaaggggacactggggcccacccggagctctgtgggccttgtctcttgtgacaaggatattttgctccttagctcagcagagtccaggttcttgtctcaggactgggaagaagtaggcaggcggacacttggagagtgagtggagtagaatgcactaagggaaaggaaaacttaaaggaagggtcttgaaagcagattgtggttctcccttcacagtggaatacaagggcttttatatacctgctgatggggctgcgttccctatttctgtaagcgcgaattcctggcggctccacccgtccttccaatgcagacgtgggcccttagtctgagccactctacattgatttatttcccttactgcgcatgtgttaagggacagaacttttccaccgcaagcatgtttgggcaaggtccctgggcacgacgaccttggtgggtcagaggttctccggggaccctcccctgtctaccggggagagttctctgcttcctgcctccatctactccccagtctgcagtctggccctcggtggtcctgcagatctggtgttgattttgcagggtgtttggaaaggtacctgcgtattttcatttatggaagtgactgagtgccgacgaggagaggttaatgcccttgagaggagaatttattacttcatcacctaagagaagggggcacacccctccatgcagggcacaggggaaccaccagtgtgggtcaggaggcagaaaggagccagagaaaagtgtgggtgggaaccttagtggggcttcctcgggaaaggcagtgcgtggctggtttgaataatgatggtgggctttggggtggtctctatttgcctggtatctggccctgggatgttttaaggcagggaaaatactggcttggtgtgtgttagagaaaatgggcagctggcttacttccaagttctttactaaattgaggaattagctggtcttgggagaggcagtgtctttctgggtctgtaagtccctggaaaatgttaaagtatcataagataaaaaaaaaaaaaatttaaacctgattaatacactgtgaacctagaagtaaccagattttaggaaactgacctatagtgagcaaactcacagggattgatagctaagccagaatatgcatttattagcttgaggggaggaatgtttcttccagtgaccaaatctttaagtctgccctccagaatattgactaaatattctgccatctagaatggaataattaggaaactcattagtcaccttaatttcaaactagtttggtttatgtggtaatcagagcaaacggtgacgtggtgtacctgtgccgcgcagggacttggtgaattaatctcttctcccagaacgccccacaagggccaccgccgtgccttcccttttctttgcctctgcgctgctgttatcttcccacagaaaggccccctgcagtcgattaggcttcagctacctaaacaataggcacagacccaaacgatgtcaaactacagttttctcctgcccttagggtggcactcaggccactttgattggaattttgagtgtccccaaactctggttgtactctttcacagatgggcaattacagtactgctctgtggagttttaccagtatagctctcagaaattcctaagaattttctatttcttaggttacactctctatagtacatacactcagacagaaaaatatatttcacgaagagagccttgaaaaatctcatctctagtcccagtgatgccttaaactggttgtgtgaccttcgtaaacctcagttttctttgttgtaaaatgaaaggtcggggtcggtgacctctagagtctatcccacccctagcctgctccgagagtgattgcatttggcacaatatgcagtttgcttcgcagcagtagcaaaatgacacatgcaacttattatcatcattgtctatcttttgatttccttgagttttccagtctcattaggggagacatctctggcttatcgcacaatgacatcgtgtcttgtaacttaatttctggggacaacacattgtgctgccacaggcacagtgctaataatcaaggttgtctgttctgcttactgtgacttttttgtggtttctggagaaaaaatgcagatgcttttcaattattctaagggaattttgatgaaccccctgggtagagttccctgtgccacctgccatgagaagtgagttttatcgaacagaaggtagggaattgaattgctcatatttgttttctttctggtacctatagtattatttcaagctcaagcattttaataaatatttaataaatacctgtctaaaataggccaaaactgtcataaactaaacctcttttcttcttcaattttaaatgcaaatgagttaatttgacttttagtggaatttccaagataaaggcccatgtttttcctttatgtatccgaaagttatttttgatggtatagtgaacgtcctgcttactacacattttatgtattagcctttggaagcaaattccttaagtttattgcaacgttgctgcttttgttgccattcttataattttatgtatttactgtttctctctctctctctctctctctctctctgtctctgtctctgtctctgtctctctctcatattgagacaggatctcactctgtggcccaggctggagtgcagtggtacagtcatggctcactgcagcctcgacctcctgggctcaagtgatgctcccacctcagcttcccaggtagctgggactacaggaatgcgccaccatgcctggttaattttttaggtattttttgtagagaagggattttaccacgttgcccaggctggtctcgaactcctagtctcaagcgatcctcccaccttggcctcccaaagtgctaggtgtgagccactgtgcctggccgtatatgtccattttgcaggccagaattctttgactgtttgatttacagagaattttcaaatatctgcctctaaggacttttgtagcaattttattgagatacaattaacgtataattcacccacttaaaatgtaggatccagtgggttttgtttcttgtttttgttgtttcttttgttaagagataagcagcaaatacatttttagtataattatgtttcattcaatatttgggacatatgctaacacttgttattattagcattattattagcattattattcaagctgaggtctcattctgttgcccaggctggagtgcagtggcttggtcacagctcattgcagccttgaactcttgggctcaagtggtcctcctgcttcagcctcccaagtaagtgggattataggtgcaagccacagcacccagcgattcactggtttttagactgtccacagagctgtgctgccatcactgtaatattttaaaacattttcatcaccccaaaaagaagccccctacccattagcattcactcctcaccccttccacccctcccgcctgtggtagccactgatctactttctgtctgtgtatagcttattctggacatttcttaggaaaggaatcatacagtatgtcgtcttttgtggctttcacttacatactggtatccacattgtagcacatgccagtacatcattcctgtgtatgggcaaataacatcccattgtatggatataccttaacattttatttacctgtcagttggtgggtgttggttcctgtcttttcggctactgtgaataatgctgttatgaacattcatgtacgagtttttggggcgacaaggttttaatttttcttgggtgtatacctagaagtggaatttccaggtggtgtagtaactctatgtttaactttatgaggaattctcacactgttttccaaagtggctgcaccattttaccctcccaccagcaatgggagcgatccagttcttcccacatcctcactgacactcgttattgtcttttttattatggtcatcatagtggctatgaagacaggcttgtttttaaatattctctatgtagtattctgctttcttccctagaaatcataattaatgcagaagtagcccaaattgtgtatgttaatttgttttatttttttaaaacaaacttgaccccccaaaagcaacaaagcacatacatttcagttaatatatattttctaggacgttattgtctcttctcaaatgagatgatttcgatatgaagcacagagttcctttcattttcctatgctcattctctctctttttaatggtatcacatactgtgcaggaaggtcattatataaggagaggaaaaaagaataatcagcatagaagagaaaattaatgctgtttgtgtaatttttaataggaatgttgtaaaattttgagatttaaaccaactactaatattttttatacattactgggcagtttcctcttgttgcctgtgaactgatactttgccttggaaactcagatagtaaaaatatttgtcaaagcttcaaataccagtgttttaattccttagtcatttagatattaatcctgttctggagaccacctacatgtgtttgtaagggatgtgataactgacactgtatttaattagcactaatattgtgaaaaaagcaaaacatattaagtatctttccaagtcactagtttgaaattagcagaagtgaggaagagaaagtcctgtccaccccccacccttagtttgcatacccatggaagtttgtgatccatttactcattcatttatccaagtatttgataggtacatattttgtggtggacaacattccaggtattgtggaaatggaccaatttcaataggacagaaatctgaatcacaaataagcatccagtggcaaccagctggtgtacacactgcacctaaatacaaattcataggtatcaaaatcaccttcatgtgtcacacagtcacctttcttagttcctcatagcaaaactgggggactctgaggtcagtccccagagtacctggttgaggggtggggcagggcagttgaataagggagtagaatgaatgaaaactttagactctgaagctcgtcactttattctgccatattttagttttgtggtattaaatctctacagaaattaattatcttgcttcctttcttgaattccttttcaaatgttatagttactacttcagtaattctatcccatctgtttatatacaaaaggtaatttaccgggtaatgaccgagggcacctgctttaaagtcaagtgcatactaatttactggctatttgcttggcctcatttacgctctctcggcacagtttctgggtctgtaaaatgagagtgattgtaccatctacctcattggcgacagtgagaattaaatgagttggtgcatgcataacacttagtacagttcctggcacaatgttaccactcaataactagcagtgtggaaatatttcacacctaagagtaaagttttatttacctttaggagacaggatcctgggaactttctggttgccatagctgcttcctcaaggcaactaagttagatgtggagtttctaattcctgttggaaattcagtgaataagaaaatactactgaaagttatactattttctgcatgttaatgatttgatattatacagctttaagttctcagtgctcattcgggtagtgcaggtgagagacggcggctttaggggcaaggcagtgaccctgtggatgatgggaagagagttgttaagaaataattgtttaaatcatccagagagtactgtagcaaggattgttcctaaaaagaactgtggtaatccttgttgaatagcaagtttggacagtatacggtagggaaatctcaggaatactataaacaaataaaatgatggggtgagccctatgaagcgtgtgttctcctgtgggcagtggcagagttacccttcacccctgagtcctgatttctcagcctcttcatgtgactgtctccttggctcctgggaaagaaagaagcctctaccttccctggattgaatgcagcccttcttgtcccgtctgcagagcatgaggaacagctggccacctgcacctgacaaggcctgtggccgcgggcagtacccagccctgcgctgacggccgctccaggttgttgctggatgtggcgagctcgagctaatcgggccttttaggcttttgtttcttagcaaatgatcagctgtgaactgcccttggcctaacttggccttgttagctcagaagcccgcaattcattgcattttaccctgaagaggaatggtaggtctgaggacatatttatttttctgtggattttttttccccttgatccaggaaattgtctgtcttcaacaacctagtcttgtctcctccagagaaaagttttgaatcctctgaggagcggtctgtcgccattgtggcctgtggtcagtgggtcagaccagagccctgacaactgtctcccttcctgggcccaagtggacaccagaggagtttggggctctgggatcagcctgctctggcgagtgtcctttccctcccactctggaactgtagcttctcagccctcttcttgatgctgggcgggtgcctgggaggccccaccccttccctgggtacctggggaggtccccgactgagaggtgggaagacctgtgtcccctcccccagcacactctcagcctctgacttagttctcataggaggaggcaacagcttccaggagctgctgctgttaccctcgacgccatgatgaggaggaaattgcctggtcaggagggctcgcctgcctcttcacagccaggcgtactgtagcggcctcaggagcggtcaccctgggagtgactcctcacctcctaagcagccctggggcatgaacactcgtcctggaaatcctgctaggctggcttaagggagttgcttctagcatgcctttctggataagcctagtagaattgctttttctactataaaaaggaaagaatggggctcctcatattatagtaacagaattcttggtactagaactggtaagccaagagaaatggaagctgaccaacttttctctctgcacagggttcagagggatagaaacacacaatttgactctgcatgcaccagaaccttctcactcagggtaagggacagccacagtttctgggacgttacctaaaaacacaataatcccacttattctctgacagataatcatcagtcatagccccactactcacttttattaaagaaatagctgggcccttttaggtaaagccctttatatactgggaaaaaaggtcatgttatccattcctcaaatcccaggtaaactcctgctggttactcaaaaataaaaaccaaaatgaaagcccattcatcacagggatgcctaatcttgtaatgagggaatcactgagtgtggcacagggaagactcctgagagattctgatggggtacaagtgtgctgaccaacgtcctagatacagtgggcccttgaacaatatgggggctagggatatcaaccctgtgcagtcagaaatctacggataccttctgactctcccagaatgtaactgctagtagcctactgctgaccagaagtcctaccaataacatacagtcatttagcacgtatttggtatgttacatgattatatactgtattcctgcaataaagtaagctagagaaagtgttaggaaaatcataacgacaaaatatatttattattcattaagtggaagtggatcatcttaaagatcttgatcttcattgtcttcacgttgagttggctgaggaggagggggcttgatcttgctgtctcaagagcagcggagtcataagaaaatgcacatttaagtggccccatgcagttcaaatccatgttgctcaaggctcaactgtacaccgaactgaaaaatgattccatttttagtaggaaatggcctactctaagtcctactgcttccctttgcacttgatggcaagggtctttaactgtgtcagtggagctggtttggctccactgatagagactccctgaccatctgataggccacttttgttagaggagaaggtacccccttgcctacctgttcttttcttacttcatgggtcttgattcctgactcaggagcacccattacagaaaagccctgggactagatctaattttatttaatgaaaaacctatggagcatttactcttgcttctaataaattaacaagtcagggctttcttctgaataggagggtctcttgactctttgatatttgacttttgaaccagactagatgaggcagagcttcagcacatattttaccagtgtcttcagcaaatgcctttctctttgcaaagctccatattactaccaaaaattaacccaactaaattgtaatttctactcacccacatttattgagtactgtgtttccttgaaagatctcaaacaaggcaccttcttgcaagatcttcaccaccagaccttcatgatagtcacctcctcattaggctgagacgcatacacagtgattacgttcagacacagggactcctgtgtcttaagaccttgtgtgacccttgtaattaaagcattacactttgcaaaggctgacagtggtataggggctgtctgaaactattcagccatagcctggtctctgctttctttttacaaatgggaggttggctaaggcagacacagggatggctaagagggataaaggacgtgacttccatagaaccttttgttcctagaggaacctctccatgaaacacacagtgaaactagattaaaccaaaaaacgccctcagctccagcagatcctgagctacaaagcacctcttccctaccgagccttctcacccatgcgcactgagtttctgagtatcagaaagtcaggtttctgaatccctagagaaagtaaaaatttccttggacacaatgggttttctttgcttcctgcatgacagtcacgaaggggaatctgaaatagagaacttgaatatgcggcttgctgaagggaagtgtactgtacagtagccccccttctccacgggggatccatgtcaaaatccccaggggatgcctaagactgcggatgggaccgaaccctgtatacgcttgcctttaatgccttttccatttcagctcggcacttagcccacactgtggctgtaacttttgtagttttaggtacagcagcaaaactagcacaaatttctttgtcctttttcacaatttcatggatagaagattgattcttactgtagatcttagcaatctcagcatacttttttttttcttgagaactttcaccttttaactaaaggaaggacttcatggctggtttttggcatatccagattgccagcatcatactcttggaactttgaggccattgtgaagtcaaataatagttcctgccaggcacagtggctcacacctgtaatcccagcattttgggagtccaaggcaggtggatcacttgagctcgggagtttgagactagcctgggcaacatggcaaaactctgcctctacaaaaaacacaaaaattcaccggtcacggtggcacatacctgtagtcccagctactcggcaggctgaggtgggagcatggcttaagcccaggaggtggaggttacagcgagccaagatcatgccactgcactccagcctgggcgacagagccagcctctgtctcaaaaataaaaaaggaacctaagcactgagaccccctgacagtagatctggtaactgagatggccactaagtgactggttggtggtgggggtgtctacagcgtggagatgctggaccccgagagagagggtttatgacccaggcaggatggagcaggacagcacaagatctcctcacactactcagaatgactcacaatttaaaacttatacattgtttatttctggaattttccatataatgtttctggaccatggttgaccacaggtaaatgaaaccttggaaagctaaaaccttggataaggggggactactgtaatataaagtttacagttcctggggtgaaagctcaggcagaccctatctatgcattattacaacgtaccatcaattcaaaaccataaatttgcagaaacatcgttgctttaattcctaaaatattgaatatgaataataaaaataatatatgctttgtcttagaagcacctttttaatatgattgatgtgtattgatctgtttcttcattctaacatgaacatttctgtaacagtcatttcccctgaaatatctaacctgtgggtacctgagacagcttgtcagttaggaagaacagtggtggcgatagccacgtagggctggtttggtcgtgagtgcaagtgtggttgcagcagctagagcagaggactgtgtggagaacatgggtcaggtcagaaggcagtagccaggagggatgcagagtcgagagagaatttgttgattggaatgactcaggttgactttcaggatgaagagaaggggccaatagagagggaagagaggacagttgatgaggcaggctccaagagaggagggcaaagcgagatcaggggctccagtgaaatgcctgagtgtgatgagaagagcgctgtcttgtgaggctagagagggaaccaaggatgggtgggcctgggaaggctggagaggtagcctgtcagggagctgctaacccacttagaaatactcttattgacataacaaggttttttgttttggttttttgtttgtttgttttgagagagcgttcgctcgttccccaagctgaaatgcaatggtgcagtctcagctcactgaaacctccacctcctgggttcaagcgattctcctgcctcagcctcccgagttgctgggattacaggtgcatgccacgggtgcagtggctcacgcctgtaatcccagcactttgggaggtcggggcgggcggatcatttgaggtcaggagttcaagaccagcctggctaacatggatataacaaaattttctatttcaaaagttcagtcgtgggcacaagttgattttgccttacagtcttgatagtgaaggtgcatactatttttaaagctgtattccttagatactaccatattatctaatgtttctaataatggaattagcaaaaaatgactacatcatccaaatttgactttgtactaacatacttggcgtactccatatccctgaaggttaacaagagataaatttggcctagactggtcttttcctgaattcatcacttaaaaaaggaaaaaaagaatggggaggaaaagccacgttttacttttataatttttattccatcattaaaagtacaacttgctttatgatctgaagaaataccatctaagtctttctattaggaacaaaagtgagcctttcagggaaaaaaaaaaaaggagctgggcttaatctgcattagccctttgatgtattcccagattttaaaaagcttcccactgttctcagccacgttgaaacagacccagccatgtgtccggcgctgtccttttctcctctcagcacacacttagccggagacaccttttggccaatgggccaggattcttccattgcatcttcagcatgtgaccgtttgtgctggctcattgggagttctgctgctcagtactccttccccaggcaaagactcttaagttaataattggttcagaagaataaactataccgccctcttggtcttcttttggacatttctttaagatgaggctcttactggtatatctggggtactttattgagaaatagaaagtgctagctgaaataaggcgtatcagtctagagttaggaagtgagaaatgcaatcggtaaattttgcttttaaataaaaatggaagccccattttaattgttgccatttctagtcattttatcatttttaacagcctggttttctattttagagaagttgctgaccaatatttagagagcacctccctaatctgcacatcctcttgtgtgtgatggtgaagtgatgggttggaatcgtttttaatgctgtttccattgatgggacattattaccagaaggagtgctttgtgccagctggtttcatggatggaggaaaacaatctgggtttcagtttcacaaatagaaaaacaaaacctgagaggaaaaggaagtaattcgttagcagtggccactgtgcagagtaggataacctgccttcaaagatttttgtttcatgcactataatataatgtttaataaatactttacttcaaagaacctcactacaagaaaactggccgctttcctgctattcttgttctccggctcagtatgactataagtagctcatatccggtcctctgtggtctcaggtggtcgtttgtgtttatgatccttaagctgaaactgtaaggactgtgtccctattttaagtctttagcagatccaccgtgttctgcaggaattgacagaggctctcgtgaaacccttgacactttgacccatcttgaggaaaatgcttagatgctaaaagcagtgtgcatagggattacgtcctccaaaaatagaaaactctaaatttactaagcagggagtagagaaactcatcagactgcacctcaagtttttgatgtgttctggtcgcctctgcactcccattctagacttctaaacaacacgttcaggatctctgagataaaagctggactgaagttacagaaagagcattagagatgtttgaatttttcttttttcccccctgtagatatatttggcatatgtagaatttgagagtccactattgataccagtttcttccagatattaacacatatcaaatagacagctagaactcagaagaaactaatggagctctgaaagaaaccattgttttttccactataaatcttaactcaacagcatttagggtctgggtggagccagtcacctgggcagctgcttcacacccattttgaattagctgcccagtgcttctggtgagcacctcggtaggagccactgctgtgaactcttttgcaagttctggtggtgactggtttggtttttattgctccctgtttgatgcactgataggacctagggctgttcttagaaatataggcctgagacgacttaaatttcacactggttttgtcttccgtttccacattcctctcactgactctccctcccttcctgccctctctctctctctcatatgaaatgagtttaaaatcagaggggaaggattgctttaatatttagcagtctaaacagagggggacagggctgaagaggaggaagggagtgaatgggtgtagaagagaaaagctgttcccaccccattgctttaatgacagtggaaagggtgcatggattgggcctgtgtttctctatcagctactttgttctttaaagcactggctagctaagccatctctttctctcccatattttgcctctttgagtgtttgcctagaaccacttagctgtggcagccctgctgatggggcaaggtgctctgcaagtttctaggcaaggtttctggatccatgttgaaattgaacgcagatagcacaaccatattataacagctacttacaaaccagtcagcacatgtgtggtgagcatttctagagttgagttattgcttaggtcaattgtaagaggagtttctctgaaagagttctgctctttgaactggcaaccccaactctagaacttacagaattgtttttgttaatttttctggcaagagattcatccaagtttcctaaacgtactacaagggtatatgtatacagagaccttaaggaatggccagccatgcaaaccctagggaacatcttatctgacagttcttgggatccacagtggcttgggtcataatgataatactgtaactgggagagctgatgtatatggagcactcagtatgtgtgaggcaccatagattctctcttcatttaatcttctcatgagaaatacagacgttaaataattttcccagggtcacataagctggtactaggaatgaggcttaaagcagggctctctaagaacaaaagctgtgatgccttagcatcattgacagcagctcccaggtcttactcatcctagtgcagtcccgttagtctacctgagctccccctaacacaggagttggcctctgcccactggggctttcattcccactaccacccacagtttctgcatatggcaggtcggagcccatcgtagtgtcatgagccattctctaaaccaccgtctgcctgaaaactgcctcattctctgtcattcctgaaggaaggactctggctggcccatctcatctttactcacctaggtgttcaatggatcactgggtaatctgagggttgatgttcttctttagtctatcaaccaatcccagagatgggaggcagggcttacataacactgtaaatactgccacctgggatgacttctgcgggagaagtactgagacccaagtccaccatgggaactaactggataagtttccgaagatttatgtcagtaacattcaccaccgtgtcctttgtattcacaaaataattagaaactacctgactgtccatcaataggagtttagttaaagaagttttgttgttccatatggcagaatattcatatgcagccattaaaatagtgatcaggtaaatgtttacaaacatggaaagatgcaatatgaactatattgtaacatgaaaaaataaagttaaaatggcccgtgtaggatattgctttgttttacaaacacaaagttgaggctgggtgcagtggcttatgcctataatcccagcactttgggaggccaaggcaggatgatcacttgagcccaggagtttgcgactagactgggcaacctagtgagacctcatctctgcaaaaaattcaaaaagtacaataagccaggtgtgatgatacatgcccatgaccccagctactcaagaggccgtggtggcaggatcgcttgagcccaggaagtcaaggctgcagtgagctgtgatcgtaccactgcactccagcttgggtgacagagcagagagactctgtttcaaaaacaaaaagcccccacaaacatgaaaggcttaatccaggactagtaatagttgccgaacttgagcggaattgtcttcatgctcttatgttagcatctgatattttataatgagcatatcccttatagattcagcaatatatttgaaaaatacaccaaggtaaaggagttgtgctaattaaaagtagctgaaatgaaaaatattgattattgaggaagaaaaacaatgaaagtaagacatagaggcctcagcagtattactgataactcaatcattgttacctgtataatagaacaaattaagggcagaggttctgaactgaagcagtgttattactaaggtgcttgaaggggggaacccacatttctttaatagcaacactccaggtttctaacatctggaagtatcacaccatgaattttttttaacccagaaaaactgggaaaaacttcaaatcactgaatgacgtgttaaccaagtttctgactttaagactttaagattattgactctgaatttacatagaattctaagaatttcagttagttgattgtgtgtgtggtgtgatgtttaaaataagtttgggaaatgctgggttaaattaatattttttatttcaggatgtctcaaaatctttactaagtggatgtctgttttgaatctccaagatggaatatagaatgcagcatttctcaaatggaatttgaccactgagtccttgttttctttgggcatgtactaagtagcctttcccagagctcattttgtgggataccataggaaatgctgcgatgggaccttttaattaatttattttttgagacagggtctccctctgtcacccaggctggagtgcagtggcaggatcatagctcactacagcctcaaaactcctgggctcaagcgatcctcctatctcagttcactaagcagctgggactaccgaagcacaccaccacagcctgctaattaaaataaaaaaaaaatgtagaaacaaggtgccactatgttgcctgggctggtgttgaactcctaggctcaagtgatcctcctgcctctgtctcccaaagtgctgggattacaggtatggccactgtgcccagccatatatgtatatatatatattttttaatgaagccacaagcattctgcctctgtgctttttatttatttatttatttatttttgagacggaggttcgctctggttgcccaggcaggagtgcaatggcacaatctcggctcaccgcaacctctgccccccaggttcaagtgattctcatgtctcagcctcccgagtagctgggattacaggcatgcgccaccatgcacggctaattttgcatttttagtagagacagggtttctccatgttggttgggctggtcttgaagtcccgacctcaggtgatccacccgcctcggcttcccaaagtgctaggatttacaggtgtgagccggccgaccctatatattttttaaaagcttttaagaaacacagtaatctttgagttgagattttgaaaaaaattgcaaaaatattgcacattagcattttaaagttagtggaggctgggcatagtggctcacacctgtaatcccaataccttggaggctgaggctggagggtcgcatgagctcaggagtttgagaccagcctgggcaacaacatagtggtatcctgtatctacaagttttgtttttttgttttgttttttttttgttttttttttttaattagctggtgtggtggtgcatacctataatccagctactcaggaggctaaggcaggaggatcacttgagcccaggagtttgagcctgcagtgagctaggatcgcatcactgcactgcaatctgggcagcagagcgagaccctccctcacaaataaagttagtggaaagtgctatagtaaacttttcccagttttcccctaatctgttttaccatgggccactcccttacccccacttttattttttttcacattagctattaacatgccctgaaagtaatgttccttagaattccatcaggcaacactactctagatcagatctgcaaactacaccccaccaactgtttttgaaaataaagttttggctgggtgcggtggctcacgcctgtaatcccagcactttgggaggccgaggcaggcggatcaccaggtcaggagatcgagaccatcctggctaacatggtgaaaccccgtctctactaaaaatacaaaaaaaaattagccaggcgtggtggcgagcacctgtagtcccagctactcgggaggctgaggcaggagaatggcgtgaacccgggaggcggagcttgcagtgagccgagattgcaccactgcactccagcctgggcgacagagcgagactccgtctcaaaaaaaaaaaagttttatcggaacacagccatgctcattcctgtatgtactgtcagtggctgctttcacgtgactgaagcggaactgacagtgtaacatgcaaaacaggtaagaaaagattgaccatctagcccattgtagaagaaagtttgcccacctctgacctagatgattagtcataggtagttgcatttgcaaattgactaattttctttttacactccagcatgaatacatgcaattgaacagctaatataggtgtgtgtatgtgtgtgcacatatgtatactaaaatattgtaaaatgtcaagtgttgcaaataacattgttaactgaaagtgacggaatggccggccaaatttatatttattgtgtcaaaaacaaaatgtaccagacaattaagataattttacccaggccactgcagtaggggtaacgtttattaatgagaaatgtctcagagagaggaagaactagggttttataaatgcaggtgaacaagggaggggtccaagaattacggggttcatgaagaagagtggaagtctatggggaaggttgctttgcctccagccatttcctgggttaagaaagaggaggaagattctgtaactgtttctgtgttctaggagcacggggctcagggaaagttcagcattgtcagttgtcaacaaaatcagtaagtgttattaaataccccatggtgtgtggttctggcactgaaatggggctgtttcctaaggctctgtccatggccacctctgtctatttctgcattctgtcttgcattgcttctgttgcctatatcctggtcagcacagtttatggtgaatcattgcttattgaaatagagacggcaataatgaagccagctattataaattagagcaaatatacacatccaatacgttttaaacgcatgtgatctctggagtagtatcactaggtagcttccatttcagttcgcctttggtatattactgtactccaaagaatatcatttttccctctgtaaaattttcctcatgaaaatggtcaccataggtctgatttactttttggatcagtaacaggtcacagcataaatcccattcctgcatcaaggcggaacaagaccctcacactttggagggagctgagttcctgtttagaagaacatgcacagttagataaatctgttcacacggcttagatgatcagagccaacatctgatgactatgagcaaggcacttttctaaacatttttagtattttctgaacagttttgttgaggtatactttacagataacattcacctcttgagctgcagttcaatgagttctcgtaaactgagttgtgcagccatcaccacgttccagttttagcacatttccatcaccccaaaagttcctttctgcctgtttgcagccaatccctgctccctggccagccacaggcaagcgctgtcaatgtttggacagtgttggattacctaatggactcttcaagacagtcctttggggtgttactgtcattctctgttttacacggtgaagaagtgaggcactgagggcactcagggtggtttcaaatgaccgaggccaggtgctcagggcccagaaccctcttaccccctccaacttcagtgagcttcaaaatcacctgctgagcttgtttgaccacagacttgtgggctccacccttgaattcctgacgccctaggtctgggatggggcttgacaatttgcatttgtaaaaagttcctgaatgctgctgctgctgctggtcagggaaccctgctttaagacctcctggtttatgcaatttcaaacattgtaagaaatagtcactcatgtgattggtttgtgtgcttggtgtagactgtacgaggatttttcaaaagtaagtattgttcattctaaaggaaggaaatgtatgttatgagatagaattatataataaacagaaccattaaatgccatctgaaaagtggtgttttcaatggcaggaagtagcattgctgcgtattttgtgtgtgtgcgcaactcagctttgtgtcattgtgtaactttaatttgaaagaacatcacgtgactgctgttttcatttctgccttttaaaaagcagacagctattcagaacagcaagaagcagacccaaactttgtttgtatgcccctagtcataggcaaaaatggaaagggtaatttaccaaaaaagaagaaaatagataaaaaggaaaagaatggaaagaaagtactgactcactgcaaacagctgcaaaatgttgcccttgggatagaggttaactcggttgtgaaataatggccaaagcggtgcactcttaataacttttttgtagccctggagaaagcttctggattgactgtgagaagcttggcagaaggtgctgcggcctggtggctggctcagcaggaggcctgggattgaaagctctcggtttgtacaagctcttttggatttgtaacacttttattttaaatctccaataaatgtaaatattttggtccctttttttctctattttttaaaataaaaatattttagtgaatatgagttaaatgagaatcaagtggcttctgggcctccctgaaagatcaagtggaagcactggatgactctaatgatgccgaattgtaatccataaagcacctgggcagagttcaatcagaggtcccatttcagaagttttttggaatgtagggaaagaattacttagaaaaggttcatctacttggagaggagatggttcaatatgacttttagaagaagccgcagtccctgccccacaggggctgcttagattgcttagatggattgtcatctctctctctttttttttttgggacggagtctcgctttgtcgtccaggctggagtgcagtggcatgatctcggctcactgcaagctccacctcccaggttcacgccattctcctgcccctgcctcccgagtagctgggactacaggtgcccgccaccatgcctggctaattttttgtatttttagtagagacagggtttcactgtgttagccaggatggtttcgatctcctgaccttgtgatccacctgcctcagcctcccaaagtgctaggattacaggcgtgagccgccgagcccggtggactgtcttctctctaagcagtaagagacagtgggaactgcagaagggtgtttgcagcctcatgcagttgactgaatgaattggccccagagtcacccctagcaccatcttgatatggacaggaggcagggaaatactgggtagaagagggtggttccccagcaaaggccccaccctcaagcctggaaatccggagccctaaatgggaacaggcattcccgtttttgtgcccaaatgttgccttttggctcaccacgcccccctctcctgtatccatataaaccccaaaccccaggctccacaagcagaagagtggcagagcagtgcagcagagaaggagaaaagaaaaggtgcttctgaacattgagaggagttcggctggggaaggtagcagagatcagctatgggatgaccaaactccaggggaaagatcatcttcccactctgtcccctttccagctccgcatctctcaccgagagccatctccatcactcagtaaaatcctcacattcaccatccttcaagtctgggtgacctgattcttcctgaatgctggacaaagacttgggtaccaagagggcagggcttacagggctgtcacccttattctccgctgagctgttttaacacgtagccatccgcagatggcagcttctaaaagagcattaattgtaacagacccccagacactaccatggggccagagcccaaaagtgctcaccccagctcctacacctgcccctgcccatctgcgtgctctccctcccataaggggtttgagcacgtgtcggccaagcaaacgagcttcacccctgtcacaagtcctgagaggagtcagggaactctcccatttcattctgacacaggtgggactcagcattctcagaccttcaaaggcctgttgggtggatgtggaggtgtgcgctgccccaccaagctgatgcctgatcaggggaggccactagaatagtctcttgtacagcaacagagcctcttactacagtgagcttctcctggggctttcagagtacgtccgagctccacaccaagaagagagccaacccacgtggatgcagctcggttcttagggctgacttgaaacttgataagactgcctcaagcatgtgccacaaccccagttcttgcaaacccccacagagtcttgagaaatccctcttgtggtccaaattggggaaatatagaattagtcaaaagaaaaggctgaagtcttggtcatctacatgcttgcaaattccagccttcctggcctgtgagtgttgcatgaatatagcaggaagtcagcactctccatctttcacaaaacgtgatgtgtttcagtccgtgcccggtgaacactattctccacctccctccctcccaacttgcttgctttcagcttctctttaaagtacaccttaaaattcaatctatcattcagacatagagagcagtggcatatgagaagcaaacatttggctgggcgcggtggctcacgcctgtaatctcagcactttgggaggccgaggtgggcagattacgaggtcaggagctggtgaccatcctggccaacatggtgaaaccccatctctactaaaaatacaaaaatcagctgggtgtggtggtgcacgcctgtaatcccagctactcaggaggctgaggcgggagaagggcttgaaaccaggaggtggagattacagtgagctgagatcatgccactgtactccagcctggtgacagaggagactctgtctcaaaaaataaataaataaataaataaataaagggcaaacttttaccaagttctcatctcttaagccattgtttgtttaatggagtagtagatgatgtgggttgttatctaacaagaacattgtcccttgtgggactgcacttagcattcaccttcggatgccatggctaggtcaggatgccagcctaagcagtcttgactttagatttgaaattccggccgggtacggtggctcacgcctgtaatcccagcactttgggaggccgaggcaggtggatcacctgaggtcgggagtttgagaccagcctgaccaacatggagaaaccctgcctctactgaaaatacaaaattagccaggcgtggtggtgcacgcctgtaatcccagctactcgggaggctgaggcaggagaatgggtttaacccgggaggcggagtttgcggtgagccgagatcgcgctattgcactctagcctgggcaacaagagcaaaactcaaaaaaaaaaaaaaattttgtaattccttcaacacattataacatgacaagtgcttcttgccttatctactagtgaagactctgcccggcccgctggcttcctaacagtcctgtggcggtctgttctttcctgtgtacactccttaaattgtgacatccctacttctggaaagctcaccatttcctatacccctatttgatttattttatcccaagacttatctcaaatcctccctgctcccaaaatcctcctctcactgccttagttctccctctgaaattccatagcatttcattttctcaacacagactcagagaaatttgctggtaggagggaccttagaggtgcgattctcaaccggggcagtattgcccccgggcatattcggcaatgtctggagacatacttggttgtcacagctgggagggagtgctatggcatctagtgtgtggaagcccgagaccccgctaaccgtcccacccaacacaggacaactccaaaacaaagattaatccaggctttcggctgctgttgggaaacttgtccacattaccaccacatacctggttccacaatttacctctacatgtgcatgttcctgagtaattgcacactttgtaatgtctcgtagcccctatagctagtctagttaatttctggtcatcatggaaaatgccacctctctgaaatggccagcactggagagacgctactgctgctgatggtgaatgtcaggggactactaggtgtcccttctatttttgttaacttgtagttatttgtaggatgattgcctttagtgcagaaaattttttttaagtttataaagcttgtgagaaaaatccttatttgtaaagaagctcagtattattttgaatgttcttgcttctcatttatgactactcaataaagaaaataccttttcctgctctgctgtccagtttgttgggttaatttgggagatagtgtcagcaccctggaattgtgccaacttccaattatcactctgtgtaaccactgacttcaatttcaaagtaattactgcagatttttctcactaccctgaacatagcctacacgcttttaatcctacacttatttttttccccatctaaaaggaaaacttattttgattttgatactttttaattttttaaaacttattttgaaataacttagacttgggaaaagttgcaaaacaataatacaaagaatgtccagataatttcacccagagtccgcaaatgttaacattttatcagggttgatttattgtgtattcctctctttctctctctctctctctcttcccacctccaccatctatatatgtaaataattggtatcttctgaaccatttcagcaaattgctaacagttcttaagtgtgtatttcatcgacacaggacaacattcccttatggaactgcaatgcagtactgttaccacaattaggaaactgacattgaaacagcaccattgtcttatctacaaacctttcaaattttgccagttttcctactctttaaaatgttttcaaattgttgccagtttactcactacaaaaaatactgtctttaaagcaaaagaaaaagaagtgttattttctggcccaggatccgctcagagtcacaccttgcattgacttttcctgtcctgttggtctcctgaatctcgaatcgttcctccgttgttctttggcttccgtgatcttgacatttttgaagacaggccatttattttgtcaaatggctctcaatttggattcatttggtgtttcctcacagtcaggttgttactcatttttggcaggaacgtaacggtggtgctgctgcgttgtcctcgttgtcccctctcgggaggcgcatgttcacgtttctctttgtcccactgttaatggcatcactttgatcatttggttcaggtggtgtttgtccctttctccactctgaagttactactttcctttttccatttatctggtaaaggaaatagacagttaagctggtaatttcagcataatatggtgagtgttaaacagacagccagggtgccttgggagccagtaagtagatgtcacccaacctggtagctcagggaaggcttctggagttgatgacacctcaactgtgacttaaggtaatgattatgagtcagccaagccaaggaaaatggggaggatactgtagaaggacatgataccatgaacacagccatggagccacgaaacttcatggtgtgttcaggtcgctacagtggctggcagcttgagttctaggatggagttcggaagatgtcacggaatcccagtatggcagtacaagtgcacttgttctcacgggaggctggaagcaaaggctgtgctccttgttcctcaaaagctctagggtctcttttgtctcttaattccatagttctctctcccctaattaacacagagctaaaaatagcagagaaatggggaattggggggaagattatagtcaaagaagtttcatcacaggatgcacagttaatttggttgcactggaaattggtttccttctcttagaaaataaaaatcatctttgcaaaaaattgtcacttctttttctttcacttttttgagggtgaaaattagtgaaaaatgaaaatatgaacaagttgtgcaaataaaactaaaaagtcaccgaatttggctttgaagtatgcatctgagaagcctactattctttggcttgaatgagaagtgtaagttgtggaatggtaaagcagtgtagcctctttgacacccagccaatttaatttttttttttttttttaattttagtggcagtaagtactgacttaccaaggcttggggtagcagatactatcacagctgccaggacttttccaggctcctgtcaagaaactgctgcaattctgcaagagtcttcagattaaattcatgccaagtcatttcctctgttcttctaccagtgaggtcacctttgcagctgaccattagtgatgctgtcagcaagaaaaggattatgaactgaggtctaaatttcagtgatgtctaggcaaaaataaatgttcaaaagaatttagcgaggtttccaagacctggtaaatttctccctaagagaaattgccagatttgtgggctcttgattttagcctgaagaatcacattcttcagcactggaagtttttccttctttttttacttttctttttttttagacacagggtctcactctgtcacccaggctggagtgcagtggcaggatcataacttactgtaaacttcgaactaccgggctcagttgatcctcctgcctcagcctcatgagtagctaggattacagatatgtgccactacacctggctaacctgtttttttgtagagacaaggtcttgctatattgcccaggctggtctcaaacttctggcctcaaagtaatcctctcacctcagcctcccaaagtgctgagattacaggcgtgagccaccacacccagcccaacattggaagttgtcatagttatcgccagttgcctctctttttgtctggagatgtgtaggttagccaaaaaaaaaaaaaaaaattaccgatttttttttattttttcattcacaaatattgaatgtcttctctatgtaccagatactattatgctctctcatggaggttagtactgtctactggagaagacataccaaaaacaagagagagagaaagaggaaagccacaaatcagttggaaacacgcccgtattagtgactgaagagcctgcaaatgaaagctttacaaattcatatggccaaatagatttccttgctccttgagttaaaattcacataacacaattaaccattagctaagttaaaacatacaattcagtgcatttattaacgttcacaacgctgtacaaccatcatctctctccagttccaagacgattcatcaccccaaaaggaaaccccatttccattaagtgatcactccctattcccccacctcccccagcaacccctagcctactgtttgcgtgtgacttcttccactcagtataacacttctgaggttcatccacactggagcatgtgtctggtctttgtaggtttattccactaccaaccatgttctttatgcttaaaataactcctccctattgaactgttttggagtgatatttcctggggtggaggtagtttaatgattcatctctgtcttgttagcatgcttgtttatggtagagagaaattttgtattctgccaccataccttgtcaaaaccttttaacaaggcattgatttggttctctggttctgagaacttggcagtggaagacaagacttccacccgcattgcaagcaaaatcattgatgtcaattcacgttattgtggaaaaccgtgagttgtgacaagtgaaagcttttcaccaagccacaaaactatgggcgtgtgcagtcaacacacggaacacaaggggtttgcttccgtggctcagcatagcactctctcactagttctaaaatattcatagcctttgctgttcccaaaagacgtttgaaaaataagacttctcctttgtcagcatccgcgctcacataactggtgaaactaggagatagttttgtatcccggaagataatcattgttccattcaggtgttgggcagagagaaatggcttatctgcacatctgcaggatgtaagagattagtgaaatatttgtgattctgatgttgatgacttttaatgtttgacagagaaacttttgcaattattttcttctggtccaggcctcactccttctagcccacatggctctagtcaacctcctttaatcagcagagtaataggcaagactgtagtaggatgcctcaagacagacttttatgttgggacaagtagtgtcttattaaggcggttccagcctttcatatcctgcctccttgggataaagagtgtttgtttacagagcttctgggatagactgctgcatgctgcatccgtacctctgttgcagaagcacatctgtcccattatgtctagtgacaaaaataagacctacgcctcagtgaactttgcatacatctgaatgtaagcaagacaagtatatttgacattttaaaaaggttttttctttcacagttttcaaaataacataggagaagcaaaggaaaaaatatttcttgtgtttctaattcacaggttgcttgagactttttttggaggtgctagcattttattggccacagttttgaaggaaaatacaatgaaatcatgcttctgtcgtttggggaaaaggaataacagattcattttttctttttttaaagatgagagagatagtatttggaatctatctttagactattctacctctgaatctaattgaagtaagaaattgggcaagaatggaatcttacttaccacccaggaaaaaagctaaacaattgtggctcagtccattttcccctgagactgtcttcagattgaggcgatcagtgttaaaatggatggaatcaccaggctctccacattctagtaagattgtagtacggttgaaagtcaaatgaaagtccagctcttcagtgtgtcatttcctcttgcagacaccagaccaagggcagtggtggtctggcgcttatattttgttattatttgttgagaccagaactctccttaaggatatatttatatatgttttaatattaaagtttcttttcaaggaatttatactaattagttcatgtaataataacatgtgcattccatttaaagttaccttgctaaattttctaagacttgttagcttccccatagtttttaataaaccaaaagatcaaacgaacagtccccagttgcccaaatattgagcagttaaggctggtttcagctcatctgaaatctgtaaacatttaaagagaacctctctcccagaagatagtgagcacggtggtattctccagtctcagaatattaaggttacttacagactagagaggccttcagtctatattaacgagttcctttcctaatctcacccttctaagaatatatttgatccaatttagggacagcaacattgaggccagagaaaaattaatggggtagtaactgtagacaccaaaacactccccaaatcttgagacatcaaataagcaagactgaatttatgcaaaagatactttaaagatgtttctttagctgggcgcagtggctcacgcctgtaatcccagcactttgggaggccgaggcgggtagatcacaaggtcacgagtttgagaccagcctggccaatatggtgaaaccccgtttctactaaaaatacaaaaattagccgggtgtggtggtgggtgcctgtagtcccagctactcgggaggctgaggcaggacaattgcttgaacctgggaggcggaggttgcagtgagccaagatcgccaagatcatgccactgcattccaacctgagcaacagagtgagactcttaaaaaaaagaaaaaatgtgtcactcagagatttttctacctagaacaagagtcatacatactttttgaaattattttatctatgtaaacttacgaggtacaagtgtaaatttgtgacatgcatagattgaatagagaggaagtcaaggcttttagatattcatcacctgactaatgtacatggtacccattaagtaatttctcatcatccaccctcctcccaccccgtcacccttctgagtctccattgtctactatcagaaaagccttctccagcagcgcattgtcagctgagtctaggagaagaaagccttctcatggacatgagctaaattccctgggaaaggccattccataatggagaaggccttctgttcacccacagtgtggtcctcagaccagcagcttcagcgtctcctgggaactcactagaaatgcagaccccaggcccagtgtggcagctcacgcctgtaatcccagcactttgggaggccgaggcgggtggctcacgaggtcaggagtttgaggccagcctggccaacatagtgaaaccccgtctctactaaaaatacaaaaaaattagccgggcatggtggcgcatacctgtaatcccagctacttgggaggctgaggcaggaaaatcacttgaacccgggtggcggaggttgggctgagctgagatcgtgccgctgcactccagcctgggcaacagagggacactccttctcaataaataaataaataaataaataaataaaatgcacccaaacctgaattggaaactcaggtggggggcctagcggtctgtggttttactagccctccaggcaagttttgatgctttggtgattgagaactgctgcttatgctgtcttggtggagagcacttcagccagtgcctcttctgctgattctgtatttatcaaagaaccactgactataatttagtgctcacactacagttaggaggtgtgtgagttccctttacaaacctatttctgattgtaaattcctaagatgttttacacatcagtatcttgtgagcttgataaaagtgaatccatctcgttcagagtgatgcattatgagtgtatagtggaagtctagcttctaagcctgtgaaacagaggcccagccccctgatccaggcagatttcactaaggtagaggccagggtagatgtccctgctgaacgggcaccctctcatcccacctcaccctggctgtgtgtactgtatatttttaaccaagaggagagcagagcggcacagaatggctggtactcagtattcctggtttctggattatacagatgcaagggaaatgtctcctagtcttatttcatgagttactgtgtagcattattgaattgcagtggtaagagggttaggtaggcctttctcatttttgattagacagctatcatttacaaattagaccacagggaatcgaccttaacttctgtgactaaagcttttggcagttacttttggcatttctggccctctagacttgaaaatgactgagtggttacaatttacaaagttaagagagctttctgttgattggtgtgaatggtaggatatgagacagactcttaggagtaaaggacagggatttagggaaaatcctagtggagtcactgcagccaggcagagttgtctgttacatgcagataacaagtcacgctgttggggttaattagaaaaagaggaaacaaagttgagaaaagaagagggaggcagagcagacggcagaggacaggaattttcagtgcagcgttgggaaaggttgtggaagctgaggctgacgcagacctagggcgttaaagctgtatttacagctggaccttctgattcctggggaggaggggaggctggatcgtgggtaagagagactggcagggccagtggaggatactctcccactggagttgtccagtgggagttgtctggagttgtcctgggcagaggctgcctgttgacagaggctcagcacagccatgcttaagataagctagctaagcaggtacgaggaaaaataatttacctgaagttctttctggccgggcgcagtggctcacgcctgtaatcccaacactttgggaggccgaggtgggtggatcacctgaggtcgggagttcaagaccagcctgaccaacatggagaaaccctgtctctactaaaaatacaaaattagttgggtgtggtggcgcgtgcctgtaatcccagctactcgggaggctgaggcaggagaatcacttgaacccaggaggtggaggttgtggtgagccgaggttgcgccattgcactccagcctgggcaacaagagcgaaactccatccccccccaaaaaagaaattataataaaataaagttttttctgtattaaacatcttgtgtttaaaagtctacagtgagtcaaggatgttgaatggccaaagatcataaatctctccctctttaaatgagctgtgggctgggcacagtggcttatgcctgtaatcccaacactttgggaggctgaggggcatggatcgcttgagcctagtagttcgagaccagcctgggcaacatggcaaaactctgtctttacaaaaaatttaaaaaaaaattagccgggcatggtggcatgtgcctatggtctcagctacttgggagactgaggtgggaggatcacatgggctgaggaggttgaggctgcagtgagctgtgatcacactactgcactccagcctgagtgacagagtgagatcctcaataataagcagtcttcagtgtttcattttacccaggctaaatgtatttgtagtatacatatatgtttatattttgatagattcatgtgagtaaaagatatacaataaaaattgacattaccgaaggggagtgggattagatgtgagagggtggattagtaaattgttttacacacctctttaccattggacttgttacaataagcctataactatttttaactccataaaatacattgttttataagagctgtcaaatttcacttgctcagtcccctgattctcattttcttataaaatctcaggttcctcaaatatgaattcttctgccatgagaaattagcaacatagtcttaaagtctggggaaagattatagtcagatccacatagataggacaacgttccaagtcgggagaatgttcatatgagaattgaatagaaggccaaatttttaggctaagaatatgatcagaggacacttccagtggagagagtcagcgtgaagagttgaggtgcatggctgttgtgcatctgagagcgtgtacgcgggcgtgagagcgatttagatccctgtgtgttgaattcgagacccacccagacagcctccagtgtcttctcagtgactgtgcccaagatttctgtccatctgtggacatgttttaatgacagcaattagtggtaatgatggctattaaatacttaatgacatttctgtgttctgaggcttcttcatacaagaattcacttactggccgggcaccgtggctcacacctgtaatcccagcactttgggaggctgaggtgggcagatcaagaggtcaagagattgagatcaccctggctaacatggtgaaaccccatctctactaaaaatacaaaatagctgggtgtggtggaacgtgcctgtagtcccaactactcgggaggctgaggcaggagaatcacttgaacctgggaggcggaggctgcagtgagccaagatcatgccactgcactccagcctgggtgacacagagagagactctgtctcaaaaaaaaaagaattcacttactttccacagaagcaggcactgttatgatccacagttcataaagaaggaatctgagacatggaaagtcgacctttcccaagcttgtaagtggaacagtattctgactccagatcctaaatggtaaaccactactctctgctgcctcgcagcctggagattttctgtaagagaggggctaaaataaaaaagcccacctcatattgatcacattcttagtaatccttgaatacgtttatattgtgtcattcatgaatgtcttttccctctggccagattatggtatttaggtcaggagccattttttcttgtttattttgtattcttacattgcccagatatgctcgataaatggtttttgaatgaattaaccaaactgtttctctaattcactatgcttttaactgtctaaggaaaagacaaccgtggggtccctcgctgcatgcctgggaacctctctgaacacggaatcaacttcctttctttgattttagagccagatgtgatgtttgaagaatgtaatctatttgctctcaaacatggagagcatagagctagaactccaacaattagaagttaatctgagatgtcctacaatacatgattttaaaataaaatccaccagtgtcagtctggtgcagtgactcatgcctgtaatcccagcactctgggaacctggggcgggcggatcccttgagcccaggagttcaagaccagcctgggcaatgtggcaaaaccccatctctacaaaacatactcaaacactaagcaggcatggtggcgtctgcctgtagtcccaggtacttgggagtctgacgtgggaggatcacttgtgcccaggaggtcgaggctgcagtgagccatgcctgggtgccagagtggtaccctgtttctctgcccaccctcccccatcccccccaaaaaaatccaccactctttcattctgaacaaccagagatgtttggaaaggacacaggaaataatacctggtgaatagttactctcgagcacttgctaggtgcgctgcagatcttcgtaaatttaatcctcaaaacagttactcaagacctgtattagcttgattttagagttgacatctgtctgagaaggaggtaacttggtcagaaggtgccatctcgttgggatgtcacagtcgggcctgttggcttcagagacttgggctttcatgctctgctgctgccaggacgggggccacatcgccctgtctcccgatttctcccatggctctccaggacttggccaccttcagcatcgtgtgttctgtacacagcacagcatgagggtgccagcagtcctccttggctcagcgtctaggatgtgtcagaactgtaaaccccaagattcttaggcaacccccctaccagcgctcatttctgctacttcagaccagaaaccttcgcgggcgggggtgggggcgggggcggcgggggtttcagttgctttctgcttcagttttcttggccgacggtctacctcacagtatcacagtcatctttactttcgtttactctgcctttctgtattttagtttctgaatttctgtcccataaagccagcatttaggcattttgaattttgagtttcttcagtgaattcataatagtaaaaatatttaagaaaacctgtaaaggcaagattgttgttgaagcccctcacattagaacacttcccaggtgctccaacctgggggggactgaggacttacatgggaagtcagagctccccatcttttttccccaaaggtcattcattctgacagcatgacttcaacttgatatgagcaaagagcatttcagataggaggagaaaaaggaagagggttgggcaccgtcgtgaaatggtacacttcctcaccgcggtgcttatctacataattgtgtttttataacatttcctttacttttctgtaagctgatgctgccctaattatagatttttaagagaacacttcattgtaccccaaattatacagtgctttaaaaaggtactttcttaccggtttaccaaataccttataaattcgtaattacataaaacaattcgagatacagaatagaaacagcctgtactgttaacaggtgttggtattgttatataattgagtacatggctttcaaagatctataatatttttcttgagtaaaaagaaaaaaatgactcattatagtcgtaatgtgtcacagagactcctgatcaaacagaatgcacatgttctattttgtgcattctgtacagttcattgtaaatggacttgcctttgtggaagtgaaagtgccacttattccagcaaattgcctttgtggcatatgcacctacttgttagacagcttgggggcacttgggccaggcagaggctgggccccctttatcatgggcacacctgcacacatggcactatggcgccacactccaggtaggctgctgtcattaacagacttgctccttgggaaacccactgaggacttctcagtgccctcctgcccatcagagaccacctcggaattcttagaagactaggaatggggcagcttcctagacgctagctcttttcccgccacatcagttttaggcctctcttatgatacaagtgattcagattacaaggtaacctcagtgcaacacaagggaagaaataaatcctctctgttattgagtgctgggtctagtgtttaattttctttcttttcttttctttttcttgagacagagtctcgcactgtggcctgggctggagtgcagtggcgcgatctcggctccctgcaacctccacctcccaggttcaagcgattcttctgcctcagcctcccgagcagctaggattacaagcgcccaccaccacgcctggctaattttttggatttttagtagagacggggtttcactatgtaggccaggctgttcttgaactcctgacctcatgatcctccagccttggcctcccaaagtgctgggattataggtgtgagccaccgcacccagcctagtgtttaattttcaatttaatttttggcactatttttttttaagttgctcatcttaggacagtataactggaatgagccttgtgtttccagttacaaaaacaagacagaacaaaggatgaggctagatttttgtattattgacaaccccatattcttccctccagaggagagatcatctttcggaagcaagcccgagatacacacagtcttacccattccttcaatgctgttgatgattagccttaagatggttcttttctctaaggaaaccctccccatttttgcaggatgtttgaaaaatgagttgctgaatgggcttcagatattcttattcttctgttttgttgggattttcttcccactcctatttgtgttaatttttccctcgaaaaatgagattgctgctcactgccgttgagcctccttgtggcacattcattggtccagtaaacgacttaactccaagaaccacctaccagtaacacaacaaaaccttgagtacagattgattcataaatggcagcggacgagtgttgaaagtgacgcattatgtcgctgcaatgtattgacattatcaattgtgtgtcactaaacagccaggctaactggatgatttactttgtgtttaactgcctttttcagttggagcaaatgttgaggaactgggatgcaatgtcagaaaccatatattttcttctgttaacaccagcttcactgaggcgtgttggttttggctgcaggctgtaaggctctagtgtaaaaaggtctaaacaagtgattaatgcccaggaggcagggctttacactgtctccacatcttttctcctttctatttgtgttgccttaatgcttggggtggggggttcaggctatttattgtgctgacgttggtttccatcctgagagtccttgatgtttctttgtggattttgtttgtttttaatattatttagcataataacctaaaccgtaaacgcttgcagttgcgatccaggtgtccttagttcagcagtcagacgtataataagggccactctgtacagtgaaaggtgacagctgtggcccccaaaaaagcagctctggactttcccctcccaagtttcagtcctggtaacttgaactagacttgctagtttcttgaaacattgttttattttcttgcaagttagtgtggtgttcatatttcacaacgctgaaagatacagtgtttctcaaatgtgcacttgccagtagacggatatgttaactgttaccgtgacgctgagaactggagctgctaactgaccctatgcgtttgttctctgcgtaaaatgttgtaacagtgctaattactaagcagctgaatttgtgagaaggtccacagcactaatctgcgcctcagtgttgccttgctagtgagaaaacgtgagcatgtactcaggacacatgtacttgatgatgaacttccaggggcacgtttatctgtggatcacggacggtttgacttgtgggacgtaacatttgatttctatatgtgcgcttttgagacactcgtttttaccctattaagagttgttgagtgcagaacaagacattttaaaagggaagagtaacattcagagattttaaaacggaagcttttaaattactacttgcttctgtttattttttattttttgctagttttagaaaaacaaggaagaatatctcaagttggaatagtcagatttcagtgtttgggtgatggtgttaaaatcgttgttttaatggtagatgaaaatgattctgttctgttggattcacatcctgaataaatgtttctacacaattagagtctataacagactaagccagcatagtggtggtgtgggttttttgttttgtgttttttttgttttgttttgttttgttttgttttgtttttgtctaaaagaacaacttcaagccttgggaaagaatttgtttttgccctgtggatgggtcagaaacatctgcttcaggtatagtttacaagcgttatttattaacccatgagccgaaaacccagatgaggagctctgactattgaaaactacacattccatgtttttataaatgtatattaagatgaattccacatacctattatttggatttctggcagccggaacttctacaaggaatttgtgtttttaaaaaggaatgtaaaattaatttttcttgtatcagagttttgctgtatatgaagaaatcctgctcatgggcagaaagcaaaggtttcaaaggaacctcatctccatatggttttactcgataatcctttatccaccatcttcagctctcattcctttgctttctcgcctgtggctacatttctatctctgcatcaattagcacagtgatttatacaacaagcaagcagtttagaggtaatggtacacaattaacatctcattccaccataaagggtatgctaaataccccagtcattgctttctctgcctggaattgaaataagtgtttgtcctaattcatatgctatctgatgtgaagtgggcctgctttgtaccgcactacaccattaatctaattatagatagctgcaaatgaagtgctgtctgagctgggagattgaagaaaatagccttttgtcatttagcatgactctgtgaagcaagatcacactttacagggcaatactacaaaatggaaatctcaataatattgctgcctgttgcatcttttctaattacaacaatattgtaaacacaactgggcgctgatataaatagagctgtagatatgctgtcatgtgggttgtaggagaaagtcctccgagtgctgttggattaaatgatgcatcctgattgacagctaccttgagactgcactgatggagttgtcacagcattatgctaacaggctgctccagcgactgcagctgtaggaggctgtggttcgccctgcgccttagctgctgcctgtccatgtccgctcctttgcctgggctgcacctccaaaggaaggacggccgtaggcttcaattctgtgtattgtcactgttgtgtcttggagatttgtggtggtggtggtgtagctcagatatcaggcgattgggccctgtgcagaagtagagggaaattattttgtatggctcctaaccttgctctgcttttcctcaagtgataattgtgtaccctacaaagaatttaggagagtagaacgtggttgaatttcaagtctcattccactgaactgttttaactcatatctagtttttctctgcttttcagccacgccagtgtttttaaagatgcatcatttttgcatttcgcgctttccatcactttaaaaacactgacactgtttctccagctctgagttaggacagtagacctttaggggaatatttgagtgttgctctcactgccacgctgcggaaatgaagacagagcttaatgttggagacctttggggccagaaggtgtaaaaccttgactaggaagagagcctaatctttgaagaagtgtctgcctccttacttagtgaggggtgcatggacagtatttggccagtgcttcaagatagctgatgcacagtgatttacagtcaaagatagcacctgcccttgagttggtattgactgagatggccaacagttgaggacatgaaagaacattaacagtcagtcaactgtacgtgtcctaattgttactggaagaatgacttataaatggaaactggaagtgagcccacttgaagaggaacggaggttgacagtggcactggaggctttgaaatcacagctgaaaactgtacagcaaactgcaagcgctcacctcgggagcagccgcagacctcgggatcattgcaacatttagcgcatggggtctgcagaattacattactgctacttctacaggctgtggaaaaaagtgggtggatttaatgctgtaaggaggtgcatgtactgtacaaatacagaagcctccagggtggtattctgtgtatccgtgaaagtggagtgtgtctcaaagtgggtcattctttgctgtctttggggtgctgatttctggggtgcaggcatacatgcccagttgcaggatgcttttcttaatgaggtccagtgataacatccctctctcacccagactgtgactagccgccgcctcctgctgcagcaaccactctcagcccccaggctttcaataggtccacggaagagctgcgtgtcagttttaaaaacaatcccactggtgtttcttgtcattgtcctgctcttgtggccttcctcctgaccctttcatgtcagctgtgattccttttctttctttcttttaatcttttgggagaaattttcttgttagacatgatttcacactgtagaggccataaaattaatttgcttagagacccgggttcgggtcacctttccgtcattcagtccttagataacacctcattccctcccattactgtcgtgtgtgggttgaggagtcccaccaggccaagccagagagcaactgttctgttctcacttacgtggtgagctgtttttcaagaacattttttttcatttggctgtgtggtctggagaacaccttcctaagccagcggagtgaagttccacgcactgaccagccccgagctcactggagcgagtcatcttccggctccatggcagcccagccccacccacaggcagctgcctgtcacccacgctggcatgttccctcatcctacccaggcagcgggaaaacctggctgcttctgggatcctactactctgtcctgtccacaagccttcagagtcttggattcctaccctcaaacatcaactttgtgatttatcttcttgaaaacaaccacaaaaacttaaaatcaaaactctctaagggagtttcgcacaacccttgaggaatagttaaatgcccacggtgaaaccgagcttgtaccccacggtccaggtaggggcacattcctgaagtctcacaaagcattggctctctgtgcccccaaagaatccagagatgctagtaaatagcagttttgatcagaagcttggaaggccctggtgtacattcttaaatgacttcttttctggggcatcaaaaagcttttacggttctcaccaggcagttcattctgatgggcccctacgctgcaccctgcttgggccccatcccggcacgcgccccgtgcagcacagcacaggccagctgagaggctgttttaagaaggcgtgtttgtgtggtacactcacgggctcaggacaacatcaaaggtaatcttaaaaagagaatctctctctgtcttctctttttatattcagaaaggtcatttctaaaccaactatttgcaccaaggcctctctggaggagtttaccccgttgttattttttacttgctattacaataagtcacttatcccccaaacagatttaagaacaataaacaaatacaaaaggaaaaggaacatctcatcagtaacaaagactgcatctaaaggcattgagtttgtgattcttttacatctctttccaagcaaagcaggagtcctacagagaaaggaatctgaaagatgaaaattataaaaatagtaaaaggatccagtgttcgtcagaatcttgtaatttctggggagaaatgaagctaaatacagtcttagcgcttcgttcatatgcaggctgatctgtgatataactaaacttagtttttggagtatatccactgtggggaaatgtggtaaatcatattctcagcgaatgaagatacttttcctgaatttaggcttcatattttgaagtcgaattctgcaaaacaagaaaaaaatagatctgtgtgctacactgaaaactgaacaaggcacgtcgtaagtcagtcacacagaaggcgcagctcagggcgataccaactagaaaagtaacttttttgttgactctgatgcctctagtgatgttggattttttcccccattgcagacagcacagataggaaaactgtgcaatttggtccaattatagtcctctctgtccctccacaccttcccccattgatttaatgaaggacttggaggtacaattcactgataaatagtccctctgcccagaatgtttattagactgacagcagcgtgcactctcctcgctttttccctcaccacttatgactcagatgaattttaataggagcaaaaagcttttatttgcactgtaatttcacttaaggaacatatccttcagaaactggcagacgcttctatgtcttgattgcaaaacacacactcaggagtaaagaaacatgcaaaagatgttattattcaacctgtcacagtgtcgcaaatccacttggaacttaggccatcaaagctctgcccccacccttttcagtaggccctgtgaagaggcacttagagattcccgccgtccccatgcagaattaaagggggaattatattttgtttttgcatccctgccatcatgatgcccacaggaggctttgagttacagcaggttttttgaatgaaatggagctgtctcactgctgcttctttcttacccaagagaaatcagacctggtagggatccagaaccttcgggtggtggttccaatttcaccaagagacacttcctcaaaccattttatcttttttctgtttggatagaccaaattgtggctcatagatttattcacggagaggataggaattctcttttttgaaatgttctgcttcactgaactgccctaaatatgcccgattgtttgagagccacctacagaaggtgccatgaatatacttgtctgtgcgtattttccatcagtgtttataacatcttgatgttattgtctctcagtgcagaaggctttctcattatcttgcatcttttcctaaccatcttgttacatcagaaagactacatagtgcctttaagaaaagccaacgttttcagtcatgaatataacattttctgtcactgaaaaaatggaattttaaatactattttgcccaaaatgaacactgaaccccattgtcttaacttactgatacgtagtgcagccgctcttggagggctgtgggaagctgcaacagccatctgctgccatctactggcgcctgtccacatgtcacctcctccatcccctgggtctgcccagctcatgggattttccttgatagggataagtttgtaggtggtgaagggaatacaagtaaaattctcagttttctttataacgttttgagatgtttttcttaaagatacaggatgatacttatcaatgattaattttaataactggaatagcccttatttcaagaactttctgaaatagctcaatatatgacagaaacaaatatattttgatgtgtgcagcaattgagaaccatttgaatttaaggctcttactgtaatttgaatttaaaagctaaaaattgatttagaatgaatgctacttttgaggaaaatttcatttaaactcatttatggtttggttttgtttttcccttaagtacaaggtgaatatcttaaccagacttgccgcagaattgaacaaatttatgctggaaaaagtgactgaggacacaagcagtgttctgcgttccccgatgcccggagtggtggtggccgtctctgtcaagcctggagacgcggtaagggctgtgtgtgtctctctgcaggacatgctggtctccaacttccccttccaaagcgacggctaacggcacagcacgattcggctctttgcagttcttacttaaccgacgccccctaaacagcaaaatcgattgcgtgtgttgtcgacctgtttcacgtttgcattacgttggtgccaggaccctcagcgcttcccctcccaaatgatctgggagtggagcagaaagaaggccagatgcattccatcattttgcaaatgcagtgttttgggaagtactttccttaaaagtgctgcttactctctagtatgctgtgctcaaagcatccattgaagtcatgccagggaataatactccgatgaggaactttttgcatgattcctggaacaaatgtctaattgggaagaagagttgaggaaaggttaattctgcaatctgtacagtaccagagcacttccattacttggtaaataaaatgtagcatcacagtttgaagtttttcatcttgatcttgtgacattaaagcacaaatcaaagctatattatttcctcgagataacttacatggatgaattgataggatgcacacattttcttagaacatggatagaaatctctactgatgagcagcaaaagtgaaaagaaaacaatttaggaggcaaccagatttccaggtacacttaaatacttgcatttttattcatgtgcaggaaaatagcatccggacatgactgtctctcatggatgaggtggtgattccgttttgtatctcaggtcactgggacttacattttagtgcctcctgatttctcaatagtacagataaaatatctgcttaacattgaggaaaaaatcaggtagttggcattggcttctagaaaagtatttgcaataaatgtgaatattaagaaaacatgatcagttttagttgtttgaatgaccagccctgaaactaatatgcgaagttagaaaaccgacttaacagctgctttacctggtgatacagaaatagaactgtccactttttcagaaaggcataaaagaggctacgtggctgtgaattgttgtttgctgtgaaagcattgatactcctggaagaaagccctctttaagactgtctaatgcccacgtgttaaggatttgggagaggccataagaaaaattacgtgtgtgtgtgtgtgtgtgtgtgtaatgtgtgtaaaattcaggggaggacatcttccttctccagagttagggtcgtaagaggatagtctcgtggccttgacattaagaatcgttcacttgcacgtgacattatcagagctgtcagtggaatcttctagtgactagatatgtaggttcgtaaacaatataagggttttgttttgtttttttcatttttcttaagttttttttctggaaggcatctatctagtctgtatactgccagcctgagctttccactcctaattgtgtggctttaattataaaatcgtgtgtgtgtgtgtgtgtgtgtgtgtgtgtgtgtgtgtgtgtgtttcaagtaagtgttttccttaaatccttttctaacacctgaatccaaaccggagtggagggagggcgggcagggatgagggagaccactcctgcctcaagcctggagggcaagagggtgagactgcagccctggcccctcacacggccctcaaggaggttgctcagaggcagtaaacggggcgctcccaaggccagatcagcgcagccttctggtttctttaacagctgctggctcctgatctgactttcccacataccgaaagggtttggcctttgtacgttccatttcctggttaataattgaatgtagaaaagcaaggcatttcgtaaatgggaacaatgtgatatcagtccttggttcattgatgtagctcagatattaaaaacacccaccaataattaaatgtgtgtactcattaagaatggtttgagaactgttaaaaatatgttacggcagagcaacggggcctatattttatgcattcctttaaattcagagtacctggggggcacgcgtagtgaacaggctcaggacctcgggatctgtcagctccctcctaagttctgtttgcgggggctgctcaggtggggcgtatacttgcttttatttgtcttttttggtacttgcagaacttcctttcatattctgtgccattgtgttttgatgaaacagccttttctcttgaattactgcttgtgaaaaatgtcccaaaccactaataccgaaacccaatgcagcctgagaagtttcatcgtcggctcttagcgcaacttctatagttaaattctgcttagtgtaattaaaacacaagaagcttccttggaccagaggcacgtcacttacttgaggccattgtgaggaaacactacctgtcacgttgaaattttgcggttttaagtgattttaacaccgcggggcgtgttgtgttttcctccgcactaacaatagccgggcgaggttccccttttatgggtgggaagataatggagtcagtctccttggtgtattttcaaggaaaataaggaccctaaaacaactaagggccttacaagtattctgtttttctttgaaatgttactttttatcgtttaaattccagtaatctatcatgtttctgtttagcttagctgaagtaaaacttgaccaatcgtagaatggtgggcctggcaataagttctaaaaaaagtgtcacataaatcgtaatgaacaaatctgttttgtgaagtaaacaatttgaacacagtttaaaaacctcaggaagaagagatgtggggtggccgttgagaagtagtgaatccgctcggggcgcttggtgtggcagggccttgtgcactgattcatttgaaacactcagcctgccctaaacacagaagctgtgttttatttgaagggcttctgtagggttcacacagcaaaagttcctaataactttttcagtgtctgttatatactatttaacattaaatgtggcaggtcacattttaaatgattgtgtaatagtttttccgaacacgtggagagaggatgttaatacacagtaaaatgcaggtaagcaaacaaatcaataagaaagtacagtggattattaaggtccagaatcagtaatataatttaggaaacaactgatagaataaattttagtgcctttttatatgccttctgaaaatgtttctgcagtaactcatttcagtttgaaaactcgttttcttagactcgtaacactattgtaaactgggagcacttctgtaatcaaagttagcatgactcagctgtttcaaacttctacctttatgatactcttgaacagaaatgttagaaatatatatattttcagaataacggtagaatacatttttccacatgtcaaattagacttatagctgctgaatttattgcataattttcactttgactttgaagtcaaataaagtcatgatgagcacattcgctttgttagccttttgatatcagaaacaaaaccaccccataagatagtcacccaaggaggcattttaatattgcatttagttaagattctttcaagtaatgttcgtattctgcagtcatcacagatttgcatcagaaatactcatttaatacaccaaacaaatgagaaacaaaccataagctgctatatactcatctgcatttctttctttcttaacaattagtgaaaccaggtgaaagaatagattgaaattaagtacctgttgctgctttttcttgcgaattagcccattcgatattagacttcgggatattttggtggggctaagatgaaaagatccacctcgtgatggaattgaccttcagcaggggacagtgaggtgtctgcggttgttcctcttgtgaacaacgccttaaaggcgagaaacagcctactgtacagtgtgccagggaaagcatcacatcggtgggcgtcggtggcaacaccacttacacttcaccctgattttgtttcctccttgcacgtgctcctttgacagggcaggctcccaagcaggtgtgcagtcagggccacaagacacaggcaccccatcccatctcagagtctgacgtcccctcctcccctttgtctctaagcctcatgtaactgagcttatagccgaccatacagaactggcaaacttggtgagatacctttattttttatttcttaaacaagattttaaaatttcataagctctcacgtatcctaacgagaaggcagggctgggccctcccgacgggtgtttgcctggcatcgcgcttgtgtgcctcatgcagcccaggctcgctcactgcatctttccctggcagaggggctagcctggctgcttcatagactttccagtttctggataccttgatttacaatcacaaaataattgcagtaattaaatttatatgttttatagcaatagttattcaagcagtttatttgacaagatgccagttttcacccaaacctcagattgtatctcacagcatgtacacagagatccatgcatttgttaacattttaagactttaaaattatgaaatactacaaacatgcagaaagttacagagaagaatccaacaagcactcctgtgccctttgttcaccatttccatatgtgtttcaaattttatttaacaatgagacattacatataacatgaacttcccctgtggcaagctcctccatctcattcctgtcctgtcttcttcagaggtaacgactacccctggatttggccttttaatcttttccagataacatttatttttaaatgttaagagttggtttttggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactccagcctgggcgacagagcgagactccgtctcaaaaaaaaaaaaaaaaaaaaaaagagttggtttttgttggaggtaacaaatatctattagtagataagaggaggcagaaaaagatgaggaggtaaaaaaatatctattagtactgggaatttttacagttgaatatactcaatgataattataaaataaaaaatatttatgtggatcagtatattaaatattataggagagtcttctccaagcttggcgtttgatttttcaggagtgatctgcttgggagtagaaggtgttttctttgttttcaacatttttataagtgaccattctcagccttaccaagatgtaaactatctttttctcttttaataaaaataaaagtttacaaaaaatcatcctttcacggagcgctttcaggcagcatgctttacgaaggtagagggtccaggctaatttccaaaggtattgtgaatgacatcagtttccactagttctctttgtaactgcaggctttggctctgattttgagctaacttagagggcagcagggagtcatatttttcttcattttaaggaattttaaaagaaactggacttgttttatatcggccacaagtctgtactcttacccttagccccttgggtgctgcccagttctggggagccccacttgagagacaaggggagcaccaggcagacggcacgtgtgcctgaagtcccgagccggcagcggggctggacgggtggcccctgggttcccgcgccctccagagtgaggccgctcgtgcatgggccattaaaggagtcttcagccggagaaagggctgggcggcgtctcctgcccgcctggtctgtctttgtaatttgatgatggttccatccttgctcaaatactgcagtctcccgtggcctcctccccgtctcgctttacatgaagatgttgggatgtgaatacacgtttcttcttcaggaaatatcaggggatatttaccagcctatcttaccggctcagaggaagttgctattaatataatcagatgcgagcaggcagtgccttttcactcaatctgagatgcctttttttgtgactgttaactgaacctttcttcagatctaagggccttaaaatgtgtggcattcaggcacctgtgttccaagcagaccagcctttaacaatgaaatggtgggattttcacttttgtggcgtagacaccagggctgatattgatccgtgtttttccggtggtccggcgttgcagaagtggaaactgcagcgggctggtaagccctccgagccttctgtctaatttggcagaaaaacacagaatgtaggacaacaaaagaagcctcctttttccataaaaattcttcctcccacccacccttcttccccaaaaaggggacttaatttttcagctgcacgcagtgatttggtgctcactcttgcatcgaaacagttgcggtctgaacaggcaggaaacagttttcttttaattgccgaaatcattcggaagtgcttcatgccctgcttctgtacagcagatgctgtgcattaattggcctgcgtagaagtgacccagggttccttgcagcgggcccaattttaggcagagggtttaaatagcttatttattattttgtataatctggcgtacattgtgtgctcctgcacgtgtcgtatttcatggtctgcagtttctaatgtcatgtgggtttcaaaacctgtgtttctctggtaatgtactagcagcaggtaagctcaaaataccatccatcaggagctaattttttatccagatactccaatgactgatgaacctgtcttttgtatgaatgtttagcacagtggaaagccatatgccactggcaccgtttcctctgcattccttacagttgctagagagtgggcttcctggggggcggggcggctcgatgctgtgaacgtcccctggcctctatttcaacgataacacctttaaaacagccctgggtttgggcaacaaaaagaggatgggctgtcttaaaggagacctgactccctcgtcattttctttatcagaaatacgactgcacactcttaatagggaaccttgttttgttactccccgtctgttccaaacagacctcagcccattagaagggcctcccttgtgtgggagaccacagctgttactgtaaatctcatccactcactgtatcacccccattttgtggctctgaaggatgaaattgagaaatggaatactgtgcagtcatcctttacatctccaattttaggcctttgccatcattttcatgcttttattccaaatcaaataacattagtgagctacaccaccttctgatgaatatctggtcttgagcaccgctttcaagcctgtgcttgtgggggcttccttttatgtttggtggtcttttttcccccgttctcttctttttcttcctgcactttctttgagcgttcttcgtggtcatggcagtctgcagtttgaatgatcggcattgccaaatgtgtccctgtcttagcatgttttctgagagggggcatgtgcgggagaaggttctctgtcttttaatctttgtggaaggagtgaagagaacttggtagaaggatattgggggctttaatcagaaataagaagtggtttaaatcattagcacaacaaagcatactataagcttgaagataaaagtctctggggaaagagtcctctgaaaataaatggaacttgatagatttccatatcatttataacttcccttaattacacttggaagacttgccagtaaaactggaaaattggcagcctatatccattagagtcattttgccgaccatggcaagcagctggctttacgggatttgattcccatcactcacaattcatcatcagctggaggtgtctgcagctcttcagcacagagcaatgctgggtgacactcgggcccccacgacatgcgaaaatctgctgagtaaatgggccgaggtttctctcaagccttgtttggggcaaggccgactcctgcttaatgagtgccgctctgataatcggatgcgaacgtgaaccttgacctcgtgtcaaaggagaggacgcaataagctggatgaaagatacaggattcaggccttcaaactttacaccaattagacagggagcggggagatacatcaggcccactaggttcatcaaaaagacttgtgaggcttgtgaccattttgtaagcccaacattggagacatcctgtcacaatcattaagtctttatcagatgattcacaaaagtgttggagaaacgtgcgcacacatcctgcaggaacgggccccgcacatgggggcgtctgatggagacggaatggtggagggccctctctgtgcacccaattaatgcttggcttcccagccaccctgggcaatccggaaggtgttgcttccattgggcccactgcccagctccctggtgtaccctacatgtactctacggtgtgcgacacattctgcaggagtcagcgctgctgggagcaaggctccaaagtcctaaggtgagagcccctgctcccaagggccgagtgctggcattttgctgttgttggaaggagcccagctcaatgcccagccatccctggagcacgccctcgagtgtcagcctcttcccacagactggggcaggtgtagtttgtgtttccattgcattctttgacatttggtttgtacatttggttctccagctcaattttttccaaaggatgaaacatgttgaaattcaattaagctcgtgtgtgtgtgtgtgtgtgtgtgtgtgtgtgtgtgtgttggggtagaacatgtttctgttgagcaagatgtatctcactattttgtaaggcatgaaggaagtttttaaacaccatctcttagggatgaattagggaaaacggtctacaaaacagatggtgcaaaattaatagagaagtgtgctacttagtttttcatttacagctaaataatctaggctgggcacagtggcacacatctgtaaccccagcactttgggaggccaaggtgggcggatcacttgaggtcaggagtttgagaccagcctggccaatgtggtaataccctatctgtactaaaaatacaaaaattagctgggcgtggtggtgcacacctgtattcccagctactcaggaggctgaggcagaagaatcgcttgaacttgggaggtagaggttgcagtgagctgagattgtgccgctgcactccagcctgggcaacagaccgagattctgtctctaagatagatagatagattagatagattagattagattacataagatagatagatagataaaatagattagataggatagataggatagaccgagattctgtctctaagatggatagatagatagatagatagatagatagatagatagatagatagacagacagacaggcagataagatagataggatagagctaaataagtagactagtagacaccacgagaggaactagggaggggaaacaggaatgaaaggcggatggagcagggaggatctaattctatgattcagtgctgtgcttggatggggcagaagatgggatcgcttcagtggggacacgccttctttaaagtcctttgaattgaattgccggactctcacaatcagacagaaggactatttgaatttcaggcctccccacttttcctgattgtctcgggctaaatccgaggtttttttctgatgaacaactggggacccagcacttgcagttacctgtgcgttacctctttgcaaatcacccacattagaagcacagagccagccagaaagatggtcagtggcagccacagcagagccccttaagctcctgtccaccacccacttgctcccaggccctggcggggcccagagtagagctgtagccaggtcaggctggcctttgcccctagcgtgaccttgggaaatccccaggccgcatttcttcatatttgcagttgagttgctaacgcactcacttgaagatcctgtaaaacagaagcaggagctgcctgcctgtctggcccgcagattctgagcaaggggatgggaggggacgtgtggtggaagggcacacctactggcagagagggtaggggctgtgccacccatgtgaagccaatgtacttggcggggggacggggctctggccagtcctgggccctcagatgcctgcagaggaagggctgggtgggtgtttgggaggccggcatgcagtccccaggaagctcctccacctggagagagaacagtgcccagagcgggagagtggattcctcatttttggatggcatttctactatgttctgttgagtctcagatccacttcccagagagtccccggtcctgttgcctgagtgctcagtcctaggtcagagtcagtcgcagtgagtccagcttctaagaggacacggccaggcttccagggtcccctgtgtggagctggctggcaggtgtgctgcagtgaactggacctgctcctggattccctggtctttgcctgcctttgaagagagaaaaaaggctgtaaaatgccaactggagggagtgactgttctgacacccctgatgggggcctctgcattgtctctgcgctgcccctcccatccccctgcaaacagccctcgaggctgattcttcgctctccctggaatgcagatgccacgtgaaaatgaatcaaaaagggcagcgcgggcagcgcttccaggcccagctcctcagcgcggtgtctctcctccgtgccagcgccaaagccttggcatcgtctctcttcctatatttctatgccaggaagaagcagcccaccacctgaacagcagaggaaaagagtacatcggctcaggcgctccagagtgccagcaagacagcttgcgccacacgggggggccagagggggacttggagatcatctggggatttcaggaaagaacattctctaggcgcttctgaggcattggacgaatatggccacagtggtgtgaggggccaggagccccatgccaggacacccacccacaccacatagccattgccctaggaacctggacttgcccgtttcaaagactgggaggccaaagaaaaacctggccggctcaggacgctgacccatcggggcagagcgaagtgagtgcgcagcatggttttcagctgcagctcactcctgcagggaagcctcacgcttaacgccagtgggcttaacccagctcagcctggctgcccctcaggatgaaaggcaagttctgaacgcagtctgagcaaaggcccgtgggcgctcccagtctcctagcatggaatgcatgtagctctggaagtcattcctgtgtctggagggttttccggaagctgccttgtgccttgttgtgggtactcgctgtgtcttgcagaggatgggacagtggtcctcgtggcgccagggccgagctgttcccagttccccgggactatagacagaaatatgtatatttggtggtggttttttttttttggtaacagctatactgagatgtaattcacatacaatttagccctttaacgtgtacgattcggtggtttcagtcaattcagagttgtgtagttgtcaccacaatcaattttggaacatttttatcactctcaaaagaaaccctgtacccttcagcagtgactccccttccctcttcaaccccaggcaacctcgagtctgtctgtagagatctgcctattctggacatttcaggtaagtggaaaacattccaatttccgaacacctctgttagtggcagagccagactcagagatccccagggtaggccccgccgccagggtccccacttctccagggtcagggattttttttttttccaacgaggactttatgagagagagaatggcttttctctactgttcctaaagatgagcttggaataggaaacattagagattgttgctgctgttcatagacacatattttggggcatttgacaaagaatttcttaatggcttcattcctaagtgttaatgcaaaattagaatgcttttaaaacttctgcccatttttgttttccaggtagcagaaggtcaagaaatttgtgtgattgaagccatgaaaatgcagaatagtatgacagctgggaaaactggcacggtgagtccctaagtccccatcagcccaggccggccctgtgatggaggaacgcccacctttgaatcgtgggtggtttggctggaaagggccacagaggcgccctctccccctcgcttctacagaggaggacgttaggattgggagcttttgccattctgccctgatgcatccctgcctcgtagagagcgtggcttccaaaaagtctgtgctttatgttcaggtagtcaaagaacaattgttcttcaccttaatgtctttctttcaaattaaggggtctttaatttttaatgtttacatctgtcttgaaggcagttagttatctgagacttaggtgacacagcagcaaatggttttacaaattgcaaaaattaatgtaactcttcaagacaatttctctacaaagggaacaattcagttgcagatcaagagaagccaaaaccccatgtacatgtgggacttaattatttagggagaaaaaaatattagtactgaaattcattcatagtgaaacttaagtgtatttttttcttgaagatagaaaagtccttttaagcagtaacttcattattcttcctgtgactaaaaagactgaaaagatgccgttagtaggtaaatgatccttttgtgagggccgttgtggtttggaagtgtctgcatgggagagcatgatgggaagcgcaaggctggccgtgttctgcatgtggccatgccttggggacatcaggtgcaaagagagatccatcagttcataaccaggtttgcatcagagagacacacaacctctgtctcatgctctgtcactgcagaaggcaatgaaatggattctcagagaaggggcagcggggatgtcatgcctggtcccggctgggagaacagaggcccaggtgtatgccaggggctcctgagcccagcccgccggtctggaggggtgtggacagttgcactgtgctggtatggtgtgaagagtagaatgacatgatttgtggcgtttttaaggaattctttctaaattacttctttaaaaagtgaacaagaaaatgttggtttctgttcatgtaaaaattttatctgttctttgggatttaacatttgtgctgccctagtatcacgacatccatccatgatgagaacttggcctaggtgtgggggaccgagaacgtgtgtccgccgcatgccaagggccctgtgcggcaggtctgaggtgctaatgcagaaatgaccttggcctcatcagttccctgaaggggcatggtgccatgtggtagtaggtttcctgtcctcgtggcctgggtctccctcggccctcctagttggagtcttcctgtgcattctgttcacctcaccccatccccaggcctctcagttccaacccagccaagaagagcagaagtggcccgaagcccccgtgcaaagtagcaggccctggttcctacctgcgaggccacttttcctcccagagaaaaaaagttcacaaaggaaacagatcctctactctggtcatcgctgcatcactaacactgcgtcctctagtagggctgctaaatggaggcaggagcattgtggaaagcagccttttcagtccaagcagcatctgcagtggccgatgagttctaatccatttttcattttcaggcccaagcaagagcctccaagaagtcaaatgactgtctcttccccacctcaagcccctccttgctaattttaagtcagaacacaaatttcggaaagcaaaacttgataaagattgactgaaaccggtaggacaaaaaggcacagttccacccacccatggtgctggaaagggcgaccgcacagccccacctgccaaggactccatttcccttcagaaaatggaggtcaggccagggaggtcctcctcttactcagcagctgatctgactgtcgtgtgttttgttcctttttttcttttacactaagtattccattaattctcagagaacatttccacaacctcaaaaccacagagagggaggctaggggttagaactcacctggcagtgaagagcctgcctagacctgagggtgccagagcgcaggccacagcgcaaatgctccggagagtagccctcaggccagccactgtgagggtgccgaggacagaggagacgggaaaggggaggagtgagccacggccacggccaccatggcgcctccctgttcaccagggtcccttcgatgggctccggtggggtggggtggcttgtccctgtgctgctgagcttgcaggactgtgcatttttagaaatggattaggagcctgccgcctcttggttctggttactaattcttactctcccctccccctgcatttttcaaaattcaaggtgaaatctgtgcactgtcaagctggagacacagttggagaaggggatctgctcgtggagctggaatgaaggatttataacctttcagtcatcacccaatttaattagccatttgcatgatgctttcacacacaattgattcaagcattatacaggaacacccctgtgcagctacgtttacgtcgtcatttattccacagagtcaagaccaatattctgccaaaaaatcaccaatggaaattttcattgatataaatacttgtacatatgatttgtacttctgctgtgagattccctagtgtcaaaattaaatcaataaaactgagcatttgtctaaata

SEQ ID NO: 2668 - DNA, 441423 bp, Homo sapiens; identical to SEQ ID NO: 2667
  source 1..441423: mol_type = genomic DNA

SEQ ID NO: 2669 - DNA, 441423 bp, Homo sapiens; identical to SEQ ID NO: 2667
  source 1..441423: mol_type = genomic DNA

SEQ ID NO: 2670 - DNA, 79847 bp, Homo sapiens
  source 1..79847: mol_type = genomic DNA
agcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgagtgagtcctgaggggcctaagtgagtcccgcccctggcgtccgcgacctatcactgcgtgcccggcttgcggcgtccgaggcctccctgccaatccgcacggtgcctggaggggccggagcaagggtgttcaccttgaaaacctgtagcgtttctcgtggaggcgggtataaccagcagaagcacctgtgtgctttttcatactgtttaacccttgggatttagacggatctggctcgtctctagccagctcaacacttaacataagcttttgggcaacttattaaatctctgtgggtcattttaataataattcttccttcacaagtgtatcgttagaccatagatagcaaaatgataggcgctcagtaaaaaccatgtgcttattctcgtgccccatgaaagagtgatggtaggttctttctcctttgtggaagcaggaaaactgaacttgggcatactccactaacatgaaatgggggatgtgcgcgtgcaggaacttgtggaacttctgcccgcagaatgcctggtcgagctctttagggccttagcatgcctcgccttgatgggtagcaaaggcacgtgtcggaagcaggtggcctttctgggagtgcgcaggctactctcgatgtttggctggactgagcagttgaaacactgccacccaccgcctgggttttgaggcgagaatccagctggccttcagagataagctgggcggcccattttggagaggtgatccctgacttgaaaccaggcttgcccagtgtgtccgtgactggtgggtgagtctggaccgttgtgctgaacgaattaaccaacgggaaggtgcagaagtgaaactcttacagatgaagagtattcaggcacaactcacaaccatgagggaggcactgggggagggatggggtcttaaagtgaggagatttgaacagctctatatttgtctaatattgattcagatgtcataaattcgcatttgacaagggtccaaaggtaacagttccttttgacacttgagagtgaaatgtaaatttagtgatggtttgtggtgctaggagtgctttctctcccctggggctacttctaacctactctgttagggctgagggagatgttagatcatcctctggaaaggcctgtcagtgctcctgtacactctttctgttggggcctattgctcaattcttccctggaacatcgcctagccctttcccaggtagatcctactaggtttagatgaagcctccagaagctgtttttcttttgccaaagttaacttaggaggctgatttaatatgaaccccctcctgcacccctttttatttttatgttttgatacggagttttgctcttgttgcccaggctggagtgccatggtgcgatcttggctcattgcaacctctgcctcccaggttcaagctattctcctgcctcagcctcccaagtagctgggattacaggtgcccacgaccatgcctggcaactttttttttgtatttttagcagagacagggtttcaccatgttggccaggccggtcttgtacgcctgacctcaagtgattcacccaccttggcgtcccaaagtgttgggattatgggtgtgagccactgcacccggccctgcaccccttttaaaacaatttttgaccatttccgtagattttcccagaagaggaattagtgggtcaaagggtgtaagtttatttattttttttgagacagagttcactctgttgcccaggctagagtgcagcagctcactgcaacttctgcttcccagcttcaagcaattctcctgcctcagcctccagagtacctggggttacaggtatgtgtcaccacatctggctaatttttgtatttttagtagagatggagtttcaccatgttggccaggctggtcttgaactcctgacctcaggtgatccacccgcgtctgcctcccaaagtgctgggatgacagaatttttttttttttttccttgagacagggtcttactctgtcacccaggctggagggcagtggtgtaatcatggctcactgcatccttgaccttctgggctccagtgatccttccacttcagcctcctacccagctaatttttttttttttttttttttggtagagacagggtctcgctttgttgcccaggctggtctcaactcctgggctcaagcagtcctcccaccttggccttccaaagtgctgggattacaggtgtgagccgcagtgcctggtcagtataaatatattttaaaaatctgtatatatgttgccaaattggtttcctgaaaacttactctactttacatgacagtgtataggattgcctgttttttgttttgtttttttttttttaaatgcaacctcaccagctttggctactttcctaaggggaaaataatagccaatttgaggtattttttgtttgtttttgtttttttcggggagggggggataggacagtaggctagggtatttgcctcgggttgagagcttgggagtccaagcaatggaggtttttttttttttttttttttttttaagatagagtcttgctctgtcacccaggctggagtgcagtggcgcggtcttggctcactgcaagctccgcctcccgggttcatgccgttctcctgcctcagcctcctgagtagctgggactacgggtgcccaccaccacacctggctataattttggagttttagtatagacggggtttcaccatgttagccaggatggtctcgatctcctgacctcgtgatccgtctgcctcggcctcccaaagtgttgggattacaggcgtgagccactgcacatggcctctttttttttcttaagacagggtctcaccttgttgctcaggctggagtgcggtggagtgatcgtggctcactacaacctctgcttcccaggttcaagtgattctcctgcgttagcctcttgagtagctgggatttaaggcacgtgccaccacacctggctaatttttgtatttttagtagagacggggtttcaccatgttgagcaggctggtctctaacttttgacctcaggtgatcctcccatctcggcctcccaaagtgctgggatgacagaatttttttttttttttttttttcttgagacagggtcttactctgtcacccaggctggagggcagtggtgtaatcatggcttagtgcatcctcgacctctgggctccagtgatcctcccacttcagcctcctaccctgctagttattttattttattttattttttggtagagacagagtctcgctttgttgcccaggctggtctcaactcctgggctcaagcagtcctcccaccttggccttccaaagtgctgggattacaggtgtgagctgcagtgcctggtcagtataaatatattttaaaaatctgtatatatgttgccaagttggtttcctaaaaacttattctactttacgtgacagtgtataggattgcctgatttttgtttgttattttaaacacaacctcaccagctttggctactttcctaagggggaaataatagccaatttgaggtatgtggttttttttgttgttgttggggaaggggacggtaggctagggtatttgcttggggctgagagcttgggagcccaagcaatggcggcttttttttgtttgtttttgttttttgagacagtgtctcaccctgtcacccaggctggagtacagtggtgcgatcttggctcactgcaacccctgccccctgggttcaagcgattctcttgcctcagcctcccgagtagctgggactacaggtgggtgctaccaagcccagctaattttttttgtatttttagtagagatagggtttcgccgtgttagccaggatggtctcgatctcctgacctcatgatccgcctgccttggcctcccaaagtgctgggattacaggtgtgagccactgcggctagcttttttttttttttttttttttttttttttaaaagacaggttctcgctttgttgctcaggctggagcacggtggagtgatcacagctcaccacaacctccgcttcccaggttcaagtgattctcctgcctcagcctcttgagtagctgggattacaggcacgtgccaccactcccagctaatttttgtatttttcagtagagaccaggttttgccatgttgtccagctggtctcaaactcctgggctcaagcgatgctcgtctcagcctcccaaagtgctgggattacaggtgtgagccactgtgcccagccgaggctcctggtagattgagagctctgacctcatctcctcaaagaagcttttttttttttttgggacggagtttcactttgttgcccaggctggagtgcaatggtgcacaatctcggctcactgcaagctctgcctcctgggttcaagcgattcttctgcctcagcctcctgagtagctgggaagacaggcgcatgccaccacacccggcttattttgtatctttaatagagatggggtttctccatgttggtcaggctggtctcgatctcctgaccttgtgatccacccgcctctgcctctcaaagtgctgggattacaggcgtgaaccaccgtgcccggcccaaagaagcatttttaaactcttctcaagtgagctctttagcattttgtgtcccactccccttctactcagccactccctgctgtggggtcatctctgtgtcacagtgtcactgtcaggtgtggggtccctaaacaggggataggatagtaggagaaggagaagcccacagaggaggcaggagaagaaccaggaagtagcgtgtccttgaggtgggagctgggagcagtagggaccctcgtgaggtgaggtgtgcttctgtaggtctccctagaaaaaacctgtgtcagatccttcactaagcctgctttagtttccaccacctgcttctgcattctttttatggctccttaggtctccagtaagtatttgtggaactaattaattgtgttccagggtcaggttctccttatccccacttctctctaccttttcctcgtcctatttccttattcatcttccacagttgggtggcttctggcgcacactgtctgtcctgatttccatgtcatctaaagtctactaataacacctatctgccttgggcaggttggatagaatgaaagtacttgcattgagatcaacgggcaaatctgcccttcaagccctcccatgaacagcccttgctttgcttactaaattgtctgtgatgacatcactgagtgatctttgttccattgtagggaaagctaacagccagggagaggatcagtctcttgctggaccctggcagctttgttgagagcgacatgtttgtggaacacagatgtgcagattttggaatggctgctgataagaataaggtatttgttcaaatggtggtgtgaacactttttaggtgtggctcagctggcctacccactagaataataataaatctataaggcttttatctgaagtcctctgcagaggcactgcagacatcaagcccagataatttttgtatttttagtagagatgggctttcgccatgttggtcaggctggccttgaactcctggcttcaagcaatccacccacctcggactcccaaagtgttgggactacaggcgtgagcgaccgtaccctgccttgtgtttctttatacgtcctccttcatgtaagcatagagaagtggtggccctgggtcttgattgttttgcttttaggagggtacataaggcctaagatgacagtgccattcactcctattgatgaagtagtagccctgtgcttgctgttgtagagctgggaaagtggggtgggattccttcatgttccttgttcatattgacgttttaggaatttgggttttgtttttgtctttcattgaggcatagtggccaaactcattagaagaagtatttggattttttaacctttatttttgcatttttctggtagtttcctggagacagcgtggtcactggacgaggccgaatcaatggaagattggtttatgtcttcagtcaggtatttcataactccaatagtctgaacttttcttggagggcagagccaagaggaaaatatgtgaaagaagccaatcttggggaatgaaaacttgcttgtagtttggggaaaatgagggatttgctttgcttttcagtgcgtgtttccagaatattgtgtgttttttacttaggaagagtccttagtctgttttgggggggatcacagggcactagccttgtacaaaggtatcccaagaaccaggaatttattccaagtgaatgagattcctcttagctgggttgggtgtgtgcctgtagggcatctgtgtcctgggcagtgtatgtggactagagagagtgcagtgggtgcagcctcgcaaaggggacttgactctcagaaccagagtccccctgagctttgggctttcatgaatatgttcagaaaattttatcagggtgcatcaagacagatacagtttgttcacacacatagccaaagctatcaatatgttattttacacgcaaaagggaatgaaggttgttaatcagctggccttgcaatagggagagtagcctgatttatccaggtgggcccaatataatcacagggtccttaaaagtggaagagggaggtagaagaggagcttataaggatgtgatatgagaaggacatgatctgcagtacctggctttgaagatgggagaaggggaccatcagcaaaggagtgcccatggtctctaggagctggtaaaggcaagaaaacacattttcccctggagcctccagaagggagcacagtcctgccaaccttaattttagcccagtcaatcctgtgtagcgcttctaaattatagaactataagataatacatttgtgttgtttcaaggcactgaatttatattaatttgttatagcggtaatagaaaactaacacagaatatgttgtgtactattttggatttgacttttttctctccagaggtggaaatatgtatataatttaaaatgcttaggtctttttacagacctaaagtttgatattaaaattggctaggcgtggtggctcatgcctgtagtcccagtactttgggaggctgagatgggtggatcacctgaggtcaggagtttgagaccagctggccaacatggcgaaactccatctctactaaaaacacaaaaattagctgggtgttgtgggtgcctgtaatcccagctacttgggaggctgaggcaggagaatcgcttgaacctgggaggcggaggttgcagtgagccgagtttgcgccactgcactcgagcctgggtggcagagtgagactccatctcaaacaaaaaaataataaaatagttatacttggttaatttaaaatctgtcgtagttagtatgcatttaccaattaaattacctttgaaatgttttaaaactgttataaattggtctaccaaatgccgaaatagaaggaatcacatttgttttgtgcaatttatgagagctgagaaaaacttgtacagaaggaaccattgaaaagagagatagaacaaagatgttttctggacatgatgttcactcaccactattaagcagatggaagaattcactgaattgatacttttgaccacctcttatgctcatgtggtagggtgggagtgaggagaaggtggagatgactgagacaagagttcccaccctgaagaagcgaatcattttataggcagaatggcacagaacggatgtaactacagagcacatggagtgagaggttccaggcaaatgctgtagacccaagacaagggaaaatcacatccagggttgaggaaagctttaggaacaatggggcaattgagacaggccctgaaggatactgagggtagggagtgatgagctagtgttttttaatagtgatctccaagatgttaatatcttaggtgctttttctggggagcttctgttcttctggggagcctcctcagtcccttgcctgataattggctgttggtgtattctgagggggagagaaaaaaaggggccagcactcattcagtgtataggctcctaatcttgcatgttttcagcctcaccttttcctcttttaggctagcgattgtgagtttagaacccttctggttaatttcctttagagaacaaacattctctgtcctctcaaggtgaaggagaggccctgtggggtctgactgcttctaacagagacttctgttagtctctgttttcagcctccttctcacctccactttccatggttcctgggttgtcttctccttgattacccccactgcaggtgtgtaagcttccattctctccctctaaatcaggtattttcttgtgctttcagttccccccaaatttgtttaatccttcctatgctattgtctccttgttcttattctcacagctgattctgttcttaattcctaactgtctttttgagggggttttaggagaggttatgcccacaataagccctttacatctgaacataatgaagatccataagcagaagaagcagtgagagctctgattcttgttttttaacctttctttttaaaacagcaaataataggctgggcacagtggctcccgcttgtcatctcagcactttgggaggccgaggtgggtagatcacttgaggccaggagtttgaaactggcctagccaacatggcaaaactgtctctaataaaaatacaaaaattagctgggcctggtggcacgtgcctgtaatcccagctactcgggaggctgaggcaggagaatcacttgaacctgggaggcggaggatacagtgagccaagattacgccactgcactccagcctgggtgacagagcaagacttggtctcaaaatgataagtaaaataaaacagtaaatatttcttaaaaacagaagtgcttgactgtttgatatccatagaatctgatattagagttaattctgtgtgataggttttccttcagaactgcaaatcatttcttttttttcctttcaaatcatttttgtagagcaaagactagctcttttgctcttgacaattcatgaacttcctttaagatattttattctatggaataatctataaatcagacttcttttctaattttttaaacttctgaaaatgctttaaaaactatatgtatgtatttttttaaatacagagtctcgctctgtcgcccaggctggagtgcactggagcaatctctgcccactgcagcctccgcctcttggattcaagtgattctcctgcctcagcctcccgagtagctgggattacaggcacacaccaccacgcccagctaatttttatattttagtagagatggggtttcaccatgttggccagggtggtctggaactcttgacctcaagtgatcctcctgccttggcctctcaaagtcttgggattacaggtgcgagccaccatgcccgggcaactttttttgttttgttttgttttgttttgttttgttttgagacagggtcttgctctgttgcataggctggaatacagtggtgctgtctcaactcactgaagcctctgtctccagggctcaagcaatcctcctgcctcagcctcccgagtagctgggattccaggcatgtgccaccatgcgcagctaacttttttctatattttttgcagatacgggcttctgccatgtcgcccaggctggtctcagactcctggactcaagccatccacctgccttggcctcccaaagtgttgggattacaggcatgagccaccacgcctggcctaaaaacttttatctgtgaattttctatttcttcctcccactgggttttcatctctagccagtcactatatttgacttgctgatttgtattttctttttaggattttacagtttttggaggcagtctgtcaggagcacatgcccaaaagatctgcaaagtaagtgtttaatactcaaattcaatccattgctttcctcagttacatagtgcttattgagtatctttggggtacaagacactgagctaggtacttggggtagggcagaggtatgcaagatgtgctaccaacccgaaggggtgcataacaattttcgtaccatggatctcttccatgggctggcaaagcctgaaccctcctgtttttacatgcctaaaataaaatttgtaggattttaaaggattaaaaatgtttttaaaaaccacatttagaatatacgtgctcccttgttaatgcatttaataacaagatttagcagtagatctagtaactaccgtaatttcaaagtagtcaaaggtgaaatatttcagggtatctgcaacaactttaataggacgtaaaaatatctgtggcttctaataatggcaaatcacagatatttctaatactgaggctcattgcctatatcaataatgaagagaaatgttaacgatcagctagcgttagtaaagataaagatgtaaattttttcctgttcaagttcatggactcccgttcacagatctcttggggttctgaggatttcaagtgaagaacctcttgtctaggtggaagggccaggtgctagaaggtaaagaacagtgcgagcattgtatgctgatatttaaaaactactgctagagattagatgctctggagaggaataaaactataaataatagagaattttggaattaaagttggagctactagtaactggaacatctggattatagacatggtcctgtcatgtattactcctgagaccttgggccagtcacttaacttttaaaccttaatttttctcattttactccctctgttatgatgggtaaatgaggtaatggaagtgaaagtactttttaaactgtcaaggactgtaggaatattgcttattatgctgtcggaattactaacccatgaggaaaatctgtcacattagaagtaaaagcaggcccgggcctgccctcagattaacagatgggtcaacatctgctttcatgaaagtactactttgccattctgtctactgtaagttctgtcaaagcagtacctgggaacaaaactggctgctggaagacgttacaacgtgagcctgtggttctagaaatggttgccatgagttgttttatcccctgctaatgggaagtgctttggctcttgggtgtttgggggctttaatcagcctattaaatatctggtcctttgtcttccatgaaggtacccaatcgtgatggggagtgaaaccagtgttactgcctcctgttttgaaaagtgcactcagaacgttttccagaaaacactgtggtattttgtgaatgtcgttttttatatcaagaacatttgtctcaataaaagatttctctgctgtctcagatcatggaccaggccataacggtgggggctccagtgattgggctgaatgactctgggggagcacggatccaagaaggagtggagtctttggctggctatgcagacatctttctggtgagaaacctgttaatagagaataaaaaaatacagggcttaagttctctaagccatggcctggccagagcttctccaactctcctcattgttctctgccgcattgtgtctgttctgtgggtcctttctgtgtcactgggggtgggatgaagggtagatgaaaagcaagagagagtgggaagagagggttttcattttttctaacagagggccactcacaggggaaattacagttaaagatcgttcataagggaaaagcacttgaaaatgtttttctttttttgaaagcaagggagaggaaatatgaaaagttaaaatgaactgatgtgcttgaattagaagttttaaaaaatgtagcaccttttttattttttagttaaaacactacaggattattaaataaagtccaagccacagtgcaaagaagaatgaaatcaccccagatcctaccattcagaaacatttggcgaacctcattactgatatctctttgcttatttacagactgaaattatgagagaaagaaatgaaaagaaacataaaataatgtgttatgtgaagtataaagtatatttgtgagagatacagtaagaggctgggatgagggagagagatactgcagacagaaactggcaacatttccagggagaagaaaggaaggagacaggcagacattgtttttaatcaggccagccactcttatcatccctgctctgcaggcttacttctgtggatggcttggcctaagcagtttaggcctggaagtcattcctgtttagaaacaaaagagcggccctcagagacgtggtgataaaccaccacattttagagcttgactggattttagaatatcatctagttgaatacatctttatgggtctggaggaggttttttttttttttttttgagacagagtctggctctgtctcccaggttggagtgcagtggcccgatctcggctcacttcaacctctgcctcctgggctcaagtgattctcctgcctcagcctcccgagtggctgggactataggcgtctgccaccacgcccagctaatttttgtatttttagtagagacggggtttcaccatattagccaggttggtctcgaactcctgaccttgtgatccgcccacctcggcctcctaaagtgctgggattacaggtgtgagccaccgcgcccagctggtttttttttttttttttaatatttatttatttagagacagtgtcttggttggccaggctggaatgcagtggcatgatctctgctcactgcaacctcagcctcctgggctcaagcgatcatcccacctcagtctcctgaatagctggcaccacaggcatgcaccaccacatccggtgaatttttttttgtattttttttatagaggcggggttttgccatgctgcgcaggcttatcttgaacttctggactcaagcgattggcctgcgtttgcctcccaaagtgctgggattacaggagtgagtcaccacgcctggcttttaatttttgttttcaagggctagtctttactttcagatcttcattgcttaattaattgcttactaatgctgcttgtcatattgatacctccactcacttattcctgcctgtgttattttttggtaactttttattttgataaaatttcaaacttcagcctgggcacggtggctcacacctgcagtctcagcactttgggaggccaaggcaggtagatctcttgacgtcaggagttcaagaccagcctggccaacatggtgaaatcctgtctctattaaaaatacaaaaattagctgggcatggtggcacatgcctgtaatcccaactactcaggaggctgaggtgggacaactgcttgaacctgggagacagaggttacagtgagccaagattgtgccattgcactccaacctgggtgacagagcaagactctgtctcaaaaaaaaaaaaaaaattcaaacttcacagaaaaatgacaagaatagtatgggaactcctatatgtccttttcccagattcaccagttgtttacattttctccatttgttctgttattctctctccatatatacatatttgcatgttacatttttctgaaatatttgagaataaattggagatactatgtcttctttacctcctaagttcttcattgggtatttctaaagaataaagatattctcttaaataaccagaatacagtaataaaaatcaggaaatttaacatcgattcatcgatgttattctaattcattatccttattcaggacttaagtcctttatagtgtgtgctctgggcatgtgtgcactttctatgtgcgcgctctcgctctttctgtctctgtctctcatatatatgtgtgtgtgtatatatgtatatatatatatgttcctcctggccaggatccaatccagaataaagcattgactttagatgttatctctttttaatcttttttgatctggagcagttcctgtctttgttctccatgatcttgatattttaaaaaatagctttggccaggtgtggtggctcacacctatgatcccagcactttgggaggccgaggcaggtggatcacgaggtcaggagatcaagaccgtcctggctaacacggtgaaaccccatctctactaaaaaaaaacaaaaaattagccaggtgtggtggcgggcgcctgtagtcccagctacttgggaggctgaggcaggagaacggcatgaacccgggaggcagagcttgcagtcagccaagattgcgccaccgcgctctagcctgggcgacagagcaagactccgtctcaaaaaaaaaaaaaaaaaaaaagagcttaatgcttaatagggccgggcacggtggctcatgcctgtgatcccagcactttgggaggccgaggtgggtggatcactaggtcaggagttcaagaccagcctggccaagatggtgaaaccctgtctctactaaaaatacaaaaattaggcgggcgtgatggcgagcgcctgtaatcccagctactcgggaggctgaggcagggaattgctcgaacctgagaggtggaggttgcagtgaactgagatcatgccactgcactccagcctgggtgacagagcgagactccatctcaaaaaagaaaagtagctttattgagatataatttacaaaccataaaatccacccattgtgaaaatataattcagtaattttaaattaatttttagagttgtacagccataatctagttttcaaacctgccactcactccaaaaataccttcttgcctgtttgcagtcagttcccacctaaccacagtcaattcctcacccaactttcttattttacaaatttttccatctgactcctttcactaagcaccatgttttttgaggttcatttatattgtaatatgtatcagtttgttcctttttattggtgaataatatctattgaatattttatgtattttcatcatttaccagttgaaggatatttggattgtttctggttcctggctatcatgagtaaatgctactgtgaacatttgtgtattactttgtgtggatatatgttttcataacccttggatagataggtacctaagagtgggattgtaggttttatgataagcttgtttataactttttaagaaattgccagatggttttccaaaacaactaaaccatttacattaccatgagcaatgtgttcagggttgcaggttctccatatctttgttgatacttggtattgtcagtctttttttgtttttttttttttgagacagagtcttgccctgtcgcccaggctggagtgcagtggtgcgatctcggctcactgcaagctccacctcctgggttcacgccattctcctgcctgagcctcccgagtagctgggactacaggcacctgccatcacgcccggctaattttttgtatttttagtagagactgggtttcaccatgttagctaggatggtctcgatctcctgacctcgtgatctgcccacctcagcctcccaaagtgctgggattacaggtgtgagccaccaccatgcccagccttggtttttttttttttttgagatggagtctcactctgtggcccaggctggagtgctatggtgcagtctgggctcactgtaacctctgcctcccaggttcaagtgattgccctgcctctgcctcccgagcagctgggattacaggcatgtgccaccatggctggctaattttggtatttttagtggagacagggtttcaccatgttggccaggctggtcttgaactcctgacttcaaacgatccatctgccttggcctcccaaagtgctgggattacaggcgtgagccaccgcacccagccagtctttttttgagacagggtctcactctgttgttcaggctggagtacagtggcatgatcacagctcactgcagcctcgacctcctggggtcaagcgatcctcctgcctcaacctcccaaagtgttggaattacaggcgtgagccactgtgcctggtccagtctttttgactatagccattttagtggtgtgtaatggtatctcactgtagttctagtttgcatttctcagatgactaatcatgttgagcatctttatgtacatattagtcatttgtaaaccttctttgctgaaatgtctattcagatcttttgtccatctcgtaattgggtttttgagttgtaagagttcttcatatattctggatacaagtcctttatcatatatatgatttgtaagtattttctcccagtctgtggcttgtcttttctttcttagtggtagctttatttttatttttattttttattttttgagacagcctcaccctgtcctccaggctggagttcagtggtgtgatcttagctcactgcaacctccacttcctgggttcaagtgattctcgtgcctcagtcacccaagtagctgggattacaggtgcatgccaccacgtccagctaatttctttgtatttttagtagagatagggtttcaccatgttgcccaggctggtcttgaactcctgagctcaggtgatctgcctcccttggcctctaaaagtgctggggttacaggcgtgagccagcacactcagcctatttttattttattttttagagacagggtcttgctctgttgcctgggctagagtgcgttagtgcaatcacagctcactgcagccttgaactctgggctcaagcaatcctcctgccttagcctacggagtagctaggactataggcacacactagtacacccagctaatttttgaaaaatttcttttgtgtgtagagatggggtcttactacattgcccagcctggtcttgaactcctggtctcaagcgatctgcctcggcatcccgaagtgcagggattacaagccactgccccaagcctgtggtggctttttttttgagctagggtctcactctgtcacccaggctgaagtgtagtggtgtaatcatggctcactgcagcctggacttcccggggtcaggcagtcctcctgcctcatcctcctgagtagctgagaccacaggcacatgctaccacatctggcaattttttttcattatttgtagaggtgagggtcccactatgttgcccaggctgttctcaaacttctggacttaaactgtcctcctacctcggcttcctagagtgctggtgttactggcatgagccgatgtgcccagcctctggtggcttttgaggtggagaagtttttaattttgaagtccagtttatcaagttttcttttgtgggtcatgcttctattgtcatatgtaaaaacttgtaatacaaagtcatgaagattttgttttcttcatggagttttttttgtaggtttggctctttttttttttttttttttgagatggagtttcactcttgtcgcccaggatggagtgcaatggcgctatctcagggattatgggtgcctgccaccaaacctggctagtgtgtgtgtgtgtgcgtgtgtgtgtgtgtgtgtgtagatatatatatatatatatatatatatatatatatgtatatatatatatatatatctacatacacaagtacatataagagagcccagccagctttcttatagtaggtctgtgatccattttgagttaatttttgtatatggtgtgacagaagagtctaacatcactcttgtctcccaccattaattgacataactattctttccccattgaattgtcttgacacattgataaaaatatcagttgatcataaatgtaagggtttgtttctgaactctcagttcttccattgttctatgtctgtccttaaaatagaaccacactgtcttgattactgtagtttataggagttttgaagttgtgtaaaatcctccaacttggtttttttttttttttttagatgtagtctcgctttgtagcccaggctggagcacagtggcatgatctcagctcactgcaacctccacctcctgggttcaagcgattctcctgcctcagcctcccgagtagctgggattacagtcacgtgccagcacacctagctaatttttgtatttttagtggagatagggtttcaccatgttagtcaggctggtcttgaacacctgatctcaggtgatccacccgcctcggcctctgaaaatgctgggattacaagcgtgagccaccgcacccagcccgatcagctcttaactctacaaaaatgcctgctgagatttgataggaactgcattgagtctgtagatgaatttggtgagaatttacatcctaacatattgagtcttccactccacgtagatggaatgtttctctgtttatgtagctctatactttgtctcagcaatattttgtaatttgcagcatacctgtcttgcacttcttttgttaaacttatacctaaaatatttcactctggccaggtgcagtggctcacgcctgtaatcctagcacttggggaggccaaggcagggggatcacctgaggtcacaagttcgagactagcctggctaacatagtgaaaccctgtctctactaaaaatacaaaaattagccaggtgttgtggtgcatgcctgtaatcccagctactcagaaggctgaggcaggagaatcgcttgaatccaggaggcggaggttgcagactccagcctgggtgacagagcaagactccgtctcaaaacaaaacaaaatattttactctttgtgatgctatttagaatggaattatcttgttaatttcctatttggattctttgcaaatgtatagagatacaattgattttcatatgttgatcttgtatactgctttgctgaggttgtgtattagcttgaatagggggtgtgtgtgtatgtgtgtatttctttggattttctatatacacaatcatgtcttctgcaaatagaggcagttttacttattcctttctaatctggatgccttttatttctttttcttgctaattgctctgcttagaacctgtagtacagtgttaagtagaagtggtaagagtggacatccttggccgggtgcggtggctcacgcctgtgatcccagcactttgggaggccgaggtgggcatatcacgaggtcaggagatagagaccatcctggctaacacggtgaaaccctgtctttactaaaaatacaaaaaaattagccgggtgtggtggcgggtgcctgtagtcccagctactcgggaggctgaggcaggagaatgccgtgaacccgggaggcggagcctgtagtgagccgagatcgtgctactgcactccagcctgggtgacagagtgagactctgtctcaaaaaaaaaaaaaaaaaaaaaataagagtggacatccttgtcttgttcctaatcttaaggagaaagcattcattcttcaccattaagcatgatgttaactggtgtgtgttttttttttttttttggacattctcttgaaggttgaggaagttcctttctacttctaattttttgagtgtttttatcatgaagggtatttaatattgtcaaatgcttttttctgcatctgtgagataatcatgtgttttttgttctttattctaatgatatggtatgtaacattactggtttttagaatgttaaaccaaccttgtatttctgtgataaatcctacttggtcatggtatatcatccttttttggaaggtgctgggctctgccagtatttccttgagtacttttgaatcaatattagtaagaaacattgacctacagttaccttgtgattttttcttttggttttggtattacagtaattctcacctcatagaatgagttggaagggttgcctctgtgaggtaggttccctatgcactggttatgaacttttctgatttcagtaagacagaacactcacacaagttacatgaagtgcccggccacatctgttgttttttgacatttttttttttcccgctgtaggcagagtcttgctctgtttctcaggctggagtacaatggcgcgatctcggctcactgcagtctccaccttgtgggttaaagcagttctcctgtctcagcctcccgagtagctgggactacaggcacacgccactacacccatctaatttttgtatttgtagtagagacagggtttcaccatattggtcaggctggtctcaaactcctggcctcaggtgatccacctgccttggcctcccaaattactgggattacaggcatgagcccctgcgcccggctgttttttgactttttaattatggccgtttttgtaggagtaaggtggtatctcattgtggttttcatttgcattttcctgatagtgatgtgagcattttgtttcatgtttgttggccatttgtatatcttcttttgagaaatgtctattcatgtcctttgcctactttttgatgggattattttttcttgctgatttgagttccttgtagattctgcatactggtcctttgtcaggtgcatagtttgcaaatattttctccagctctgtgagttggctctttgctgattacttcttttgctgtgcagaagctttttagtttaattaggtcccatttatttttgtttttgttgcattagcttttggggtcttagtcatggattttttgcctgggccagtgttcagaagagtttttccaatgttgcagaatttttatggtttcaggtcttagatttaagtcttggaagtctggtaatgtgatgccttcagatttgttctttttgcttagtattgctttggctatctggactcttttttggttccatataaattttaggattgtattttctagttctgtgaaaaatgatgatggtaatggtagtgttttgatgggaattgcattgaatctgtagattgctttgggccatatgatcgttttcacaatattgattcttacctccatgagcatgagatgtgttttcatttgtttgtgtcatgtatagtttctttcagcagcgttttgtagtttcacttgtagagatcttcacctccttggttaggtatattcctaggtattttattttattttttgcagctgttgtaaaaggaattgagttcttgatttgattgtcactttggttattgttggtgtatagcagagctatttatttgtctatattaattttgtaacctaagactttactgaattcctttatcagatctaggagtcttttggatgagtcgctagagttttccaagtatatatgatcatatcactgataaacagtacttgtttgacttcctcttttccaatttggatgccctttatttctttctcttgcccaattgctctggataggacttccagtactatgttgaatagaagtggtgaaagtgggcatccttgtcttgttccagttttcagggggaatgctttcaacttttccccattcattacgatgttggctgtgggtttatcatatattgcttttactattttgaagtatatccctcctatgcctagtttgagagttttttgtcataaagagatgctggattttattgcatgctttttctgcatgcaattgagatgatcatatggtttttgttttaaattctgtttacgggatttatcacatttattgacttgcatatgttaaaccatccctgcatctctgggatgaaactcacttgatcatgttgtattatctttttgatgtgctgtgggatttggttagctagtattttgttgaggatttttgcatccatgtttatcagagacactggtctgtagttttctttttttaatgtcatttcctggctttggtattagggtgatactggcttcatagaatgatttaggaaggattccctctttctcaatcttttggaatagtttcagtaggattggtaccaattctttgaatatctagtggaattcaactgtgatccatctggtcctgggcttttttgttgttggcagtttaaaattactgattcagtctcactgcttgtttttggtctgttcagggtttctgtttcttcctgatttagaggattgtatgtttccacgagtttatccatttcctctagatttttcagtttgtgtgtgtaaagatgttcatgttagtcttgagtgatcttttgtatttctatgatattggttataatatttccagtttcatttttcattgagcttatttggatctattctcttcttggttagtctaatggtcgaccaattttgtttattttttcaaggaaccaagtttttgttttattttttgcttcaatttcctttagttctgctctgatctttgttatttcttctgctggcattgggtttagttcgtacctgtttctctggttcattgaggtgagacagtagattgtcagtttgtgttctttcagactttttgatgtatgtacttaaaactatgaactttcctcttagcactacttttgctgtatccccagaggtttttataactgtgtcactactatcattcatttcaaatttttaaatttttatcttgatttattgttaacccagaaattattcaggagcagattatttaatttccatgtatttgtatagttttgagcatttcttttggagttgtttctagttttgttccactgtagtctgagaagatacttgatatgatttcaattttcttaaatttgttgagacttgttttgtggcctgtcatacagtctatcttggagaatgttccatgtgttgaggagaagaatgtatattctgcagttgtttggtagaatgttctgtaaatatctgttaagtccatttgttctagggtatactttaagtccattgcttctttgttgagtttctgtctcaacaaaaagagtctagtgctgtcagtggagtatcgaggtcccccatttcactttgttgctatttcatttcctaggtctagtagtaattgttttataaatctgggagctccagtattaggtgaatatgaattcaggattataatatctttttgttggattgttccttttattatataatgaccttctttttctttctttttttttttcttttttcttttttttttttttttttttttactgttgttgctttaaaggtctattttgtctgatataagaatagctactttgcgaggccaagacgggcggatcgcgaggtcaggagatcgagaccatcctggctaacacggtgaaaccctgtctctactgaaaatacaaaaaattagccgggcgtggtggcgggtgcctgtagtcccagctacttgtgaggctgaggcaggagaatggcgtgaacccaggaggcggagtttgcagtgagccgaggttgcaccactgcactccagtctgggtgacagagggagactctgtctcaaaaaaaaaaaaaaaaaaaaaaaaagaatagctcattctgcttgcttttggttcccatttgcatgggatatctctttccccccctttaccttgaggttatatgaatccttatgtgttagatgactctcttgaagacagcagatatttggtttgtgattttttaaaaatccattctgccattctgtatctaagtggatcatttaggccatttacgttcaacattaatattgagatgtgagatactgatctgtttatcattttagttgttacttactttgtttttttttcattgtgttattgttttataggccttgtgggttttatctttcaagaggttttattttggtgcatattgagcttttgtttcaagatgtagaactcttctgaagagtaatgctggtttggtagtggcagattccctcggcatttgtttatctgaaaatggctttatctctccttcatttaggaaacttagttttgctggatgcaaaattcttgggtggcagttattctgtttaaggaggctaaagatagaaccccaatcccttctagcttgtaaggtttctgctgagaaatctgctgttagtctgattggttttcctttataggttacctgatgcttttgtctcatagctcttaggattctttccttcatgttgactttagatagcccgatgactatgtgccttggtgataatctttttgcaatgaatttcccaggagttctttgagcttcttgcatttggatattgaaatctcaggcaaggccagggaagttttcctcaatgattctctcaaataagttttctaaacttttagccttctcttctccctcaggaccaccaagtatttttaggtttggttgttttacataatcccatatttcttggaagctttgttcatttcttctttctttttttttttttctttcttgagatagggtcttactctgttgcccaggctgtagtacagtgttgtgacctttgtctcctgggctcaggcaatcctcacacctctgcctcctgagtatctgggactacaggcacatgccaccactcccggctaatttttatgttttttttgtagagatggaaatttgctatgttgctcaggctggtctcaaagtctgggctcaagcagtccacctgccttgccctcccaaagtgctaggattataggcatgagacactgaccccagcctatttatttcttttgattcttttttctttatttttgtctgattgggttaatttgaaagccttgtcttggagctctgaaattcattctttgacttgttctggtctattgttgaaactttccattgcattttgtatttccctaagtgtgtttcatttccggaaattctgattgttttttctttatgatatctatgtagaaaatttttccttcatattctgaattgttttttaagttttttttttatgttggttttcacctttctatggtgtctccttgagtagcttaataatcaacctactgaattatttatctgattatttcaaatatttcgttttagtttggatccattgctggggagctagtgtgatctttcgggggtatgatagaaccctgttttgtcttataccaaaattacttttctggttctttctcgtttgtgtagagtatttcttctaattgttcttgaatttatttttgatttggctgtggtttttttaagtttctttttcctcttcactaaggatgtgactttagtgtttatagtttattatagcctaatgtgattcttaatgcttttagggggaagactgtatgagttccttggctatagagagtctttgtatgatggcttctttagatgctggttgtatttatttatttatttatttatttttgttgagatggcgtctcgctctgtcactcaggctggagtgcagtggcacaatcttggctcactgcaacctccacttcccgggttcaagtgattctcctgcctcagcttcccgagtagctgggactacaggtgtgcaccactacgcctggctaatttttgtatttttagtagagacggggtttcaggatgttggccaggctggtcacaaactcctgacctcaggtgatccacctgccttggcctcccaaagtgttgggattacaggcgtgagccactgcccctggcctgtatttaatagatatgtacttgatgtgtgggcaagttcactgtctcctatggggttgagatggaaaggtctcttgaagctcatctcattcccctgtggtgtgtgcttttttatttatttaatttttcccctgtattttatttactaagttgatggttaaggcttcaggccagtaggggagctgtccctgggtaggaaccagttgtggctaaagcaaatgggtaaatgcaatactcagtaaggcagagaggttccacccttgatgaaagtggctgggggaactctcaattagatgcactgaggtcttatcaaggggaagggtgggagccacctcagctcctttgccaggccagtaggaaagctattcacctcccagactcgctcctgccctagtgttccagctattcggatcagacaggcatctcttttcatctgtaggactgttgttgttccacacagagaggaatttgtgactctgcctctcttgcaagcctgaacttgggccagggcgggggtgggggttgggggattcctcctgtggagatgcagtcactctgtagtgttccaggaaggctgtctataggttcacctttgccaagctcctgtggagaagccccaactgtgtctgtgtagtggtggacaaggtgggagagaagataccttctccaggacccttcatgagcagcaaagctgcctgattgttggggtagagctgcagactttcccttctgagcccagcactgcaattgtgtctctgctgaaaggaacttcccatcagtggaaagatctggaactcaaggcctgccatctgaattcttttgtcccatggggtattcccttggtgtggtggtctcctccttcccttaggagtaagaattcctgagagccaggataagttgattgctattcttctgggtctagccacccagtggggctgcccaactccaggctggtgctggggaatgtctgcaagggatccggtaatgggacctgtcctcaagtctcccagcaagggatataccaacactagtgctgatgggagtgtcaggtgagtgaggtagactctttgaggttccttggttacagaaagccttagtgtgctggctttctcgaatgctggttataatagtagtgaactggtcacgtggacagatgcaggacctcctggttagccagggttttgcaggcaatgatgatagcttaggtcatgcactggttttctcctttctgttcacagtgttattctacctagagatgctgtagtggactgtgttggttggcatccagcctggaggtagcgtttacaaaagggcaccagctgcagtagtagcagtgggattcgagcttgtcctgtgttgcccaggaggtattctggtttctcaggtgacaacggggtccataaagctgccaaaagtttctgtcctttgtattaagtaaccagggtgggtggaggggtacagccaggtgggggctgggtcaggtgggtctacactctgtctctccatgtgtggggaaagccgtggctcctatgagggttgggggggcggttctcaggtcattagggtaatgttccagagaggaatataactgcctctactgcacagaagagatcgcacagtgtgtggggagtaacaggtggcactaagcctcacccagatcccacacggtcggaaaggcagatctcactccctctgtgctctgctagctgcactgggctaagttccaggcagcctaggctcagaactcaaacctgccccaggccataagctttccctgtgggaaagcagctgtggctttcaggccatgctcctcccaggccacctgcagggccaggcacctggctcctgcacttgtggctgcagtgcacttccccctgcccctgggaggtatgggttctggacaaaggagttcatcctcactcagtgttatatcttgaaatggggagattctttcaacctgcgaccactacctgagcttgttggctgacttccccaaggtcccctgtgaggtacaataaagaatggcttaccttggtctgcactggagactgggaatgcctgcaaagcacttcccgccactgtttctacttttatatttcttactgctccctaaatcagtcccagccctgggtaaggttaaggccttcccccatggcctggattttcaggttccccagtgggaacctgaaagcagcttctctctatctcacactctggagacttacagtttttcccttgtcttatggtttaggctgcagactgccacttctttaaaaggtctgtggattctttcagttttcctgttaagttcctgcgtggcttcttggaaaaagagtcaccatgtgattctcaatacactattctgttcttctaagtgggagaggcatgctaacactgcttcttatctgccatcttggtgggggtggaaaaaccaaaacctctcaaagtattttctaacttctcttgtagattcttcttttgcctattgcttatttagaagtgttttgattaatttttacgtgtttgtgaatttttcagttttcctattgttattgaattatagttttattccattgtgatcagaaaagatgttttttatgattccaatcattttaaatttaagatttgttttgtggattaatgtatggtctctcctggagaatgttgcatatgcacttgacaagaatatatactctgttgttgggtggagtgttctctataggtcttttatatgtattagttcatagtgttgttcaagtgtactgttaacttaccgatcttctgtctagttgttctgtctgttattagaagtgaggtgttaagtctgcaactattattgtgcacctatttctccccacaattctgttaacttttgctttgtgtattttagggctcttgttgcttcatagattttggggctctgttaggtgtgtatatttttttaactggtatattttctagatgtgaaccttttatcaatatgtctctctagtaagtttttgatttaaagtctctttagtctgatagtaatatagccacctagggtctattttggttaccctttgcatggaatatttttttccatcctttagtttacctcttcatgtctttgtatctaaagtgaagctcctgtaaatagcatacagatagattctgtctgtatgcaatctgtcaatccctgtcttttaatagaagagtttaatccatttatacttagcatgattgctgaaaaagaaggatttacttctgccatttagttatttctgtatgtgttttggttttttatgcctcagttcctccattatggccttggggtggtgatatttagttgagttgtttgcctttttgattcacttctttcattttaatcatattttaaagtttgttttcttagtggttaccttggggattataattaatatcttgaactagttggaagaataccaggttagctttagtagtacatagacatactgcttctgtaactctccatccttccttttttatgttgttattgtcatagattatatctttatacatgttatactcattaacaacagatttattgtttcatgcatttgcattttatttttatttatttatttatttattttttgagacggagtttcgctctgtcgcccaggctggagtgcagtggcgtgatctcgactcactgcaagctccgcctcccaggttcacgccattctcctgcctcagcctcccgtgtagctgggactacaggcgcgcaccaccatgcctggctaatttttgtatttttagtagagacggggtttcaccgtgttagccaggatggtctcgatctcctgacctcgtgatctgcccgtctcggcctcccaaagtgctgggattacaggcgtgagccaccgcgcccggcctttttatttatttttgtaaattttattttttgtgcagactcctctgctggggccgcaactgctgagaggagcagcacatttgccttttaaatcacataggaaaaagacattacaaaccaaagtacaacactacttttatatttacctaggaagttacatttattagtgttctttattttttctcatgacctcatgttactgtctaatatccttttgtttcagactaaaggactccctgtagaatttcttgtatggcgtgtctattgcaaatgaatgctctcagcttttgttgacttggaaatgtcttaattttcccttctttcttgaaggatagttttgctggatataaagttattggttgaccagttattttgtttcaatacttctttttttctttttgagacagagttttgctctgttgcccaggatggagtgcagtggtgcgatcttggcgcacagcaactctgcctgccaggctcaaatgattctccctcctcagcctcctgagtagctggggccataggcatgcaccaccatgcctagctaatttttgtatattttgtaaaggcagggtttcaccatgttgcccaggtgggtctcaaactcgtagactcaagcagttcacctgccttggtctcccaaagagctgcaattacaggcatgagccattgtgcccagccttctttcaatattttgtttttatttttattttagacacagggtcttgctgtgtcacgcagaatagagtgcagtggcatgatcatggctcattgcagcattgaccttataggatcaagcagtcttcctaccttggccttctgagtagctagtagaacaccactatgcccgaccaaccaaaaaaactttctgtagagatcagggctcactatatcgtccaggctggtctcaaactcttggcctcaagtggtcctcctgcctcattctcccaaagtgctgggattacaggtgtgagccagcgcacctgacttttcagtactttaaatatgtcccactgccttccggcctccatggttaatcttgctgaggatcagttgcatgggatcagttgcttctatcttgctgctttcaagtttctcttattgtgttttgacagtttgactataatatgtctccgtgtagatctctttgagttcatactgcttggagtttgttgagcttcttgggtatgtatacttatgtctttcatcaaatgtgggaagttttcagtcattatttcttcaaatctttgaccctttctttctgttcttctgagattcctataatgtgtatattggtatgtttggtttcccacaggtccctcaggctctattaatttctccttttcttttttctggttccttatactagattattttgttttgtattccagtttcctgatccttttttctgcttgcttaagtctgctgttgaacccctgaaatgaatttttcatttcagttattgtcaactccaggctttctgcttggttccttttcataatttctgtctctttgtggtgttctcattttgttcagacattgatttcctgatttcctgtagttttttccccccacagctttctttagctcattgaacatatttaagacagttcatgtgccatctttgactattaagtccaatatctgggtttcttcagagatgatttttgttaaattatttttttcttgtgaatgggccatacttgcttatttctttgtatgatttgtgatttttgttgaggatgagaaattctgaatattatgtttggaagtttggaagtctagttctcctacttttcaggaatagccgatttttgcttgtcaactgctgggtccatctgtttgaacttttgcaagctgtttttgcaaagagtatgttccttttttaatatggacattgaaattttagttctcttatcactgtgtttaaccagcaatctgacagtaatttccttaaatgtctgtctcccagaagtgtggaggggtgtggaacaaactacctttttaaatcccttgtggctgggaagctgcttgagccaatcagggttgaaacaatgccagcctctatgcttagcccctcagccatcaaaagcagtggtcagtaatcagaacatacaaccttgatttttcaaggttgaaaaaccaagatgcaaaggttctaatttcccaatctggcaccaactagctacactaggaacatcctcgtggctacctgccatgggttgttggctgggggattatagcagccatgttattaataaatgtgaagtttactgaaatttacttgctgttttatcaaattctcctctgggccctgaagtgtttgagtagactccagagttcaaaaatagttgctttagacagctgaatagttgttttgatctcagatattcttggagcttcctgttctctcttctgtgatgtcactcagtttttttatggtaagcatatagttttagtgtaccattttaatttctagtgttttttagctgtattttttgagttatttttagtagttgctctaagggttactatatatctcttaatttatcacagtctgcttcaaattaatactgacttaattctggtaagacaggaactttgctccaatgtagctccattttctcccccttcatttgtgcttttattgttatgtaatactcaaaacagtgttaattattgctttatacagtcttgtttttcaaagtattaagaaaagagaactatacttatgcagtgtttataatcacatatttatcattttcagcactcttaattggttcttgtggatttgaattatagtctggtgttattttctttcatccagtaggacattttgagctggtatgggcaatggtggcagccttggttaagaatgccacaggctttcactgttcttatctcaagtttagtagtttttcatgaataaacacttctcaatttgttacatttggctcatttttagaaccccaaaatactcgtttttgacaatgctgtccagttgtttttggggagagaattttctgaactcttcactctgccacagctggaagtctcccctactaccttgatatctttgcagaaagcatagattacattttgcactgtccttagctgtgtatagattgggcttagagccaaggcaggctgaaaagtgaacctacttttcctaagctgatgggacttaggagaaggaaagaatttggaagtagggcaaagaataattgggccttttatcatcttgcctgggtcttttgagcccccacatcctatctttcctgaggcttagtccttcacaacacagtgtccttatggaggctttctggctccttctaccgccttctctcctgcattccttgtctggggatgggcagagtagacactgggtactcagtgtcaagaagcacctgcttgtacccttgcgtgccttctgtggagggtgtggagggactcaaaatagaggtcagggtgccaagataagtgttggctctgcaaactctgcatgaggttttcagtcttctttcaggcagctttgcacagatggggggctttgcatttggagctgtggtgaggatggtgggatacactctgtacctcatgcccttagtgaaggttttagggaactgctgcccaggaggggaggggagagaaaatacttgcctcagaaagtaatatgctgaccatcctaccagttacggggagaaaatgcacatataattcttaaagaacttcactgattaggtctgttgcctcctgtatagaatttctgtgggaaaaaagccaaatgttatcttattgttgtctttatctttccacagataatgcctcaaacatctctgtaaccagatgcttttgcttttctgttttggcagaggaatgttacggcatccggagtcatccctcagatttctctgatcatgggcccatgtgctggtggggccgtctactccccagccctaacagacttcacgttcatggtaaaggtaagaaagaagggcctgtttttggtgccgtttgagatttgtgcagttccttacctgcaataaaaataattcctgacccagatctaggttgttacctgcattctcattggctttcagcatagtgatgataaggtgttaatggagagagggttttggcatgaaatctgtagcttgtgggggttcagtggcaggggatgcttatgtacttcattggtgggtgattttacttgttgatctgaattgcaaatgattttcaggtaatcaaagaatcctgtcctttgaccagatagatgactgtttactgagtcctattcaagaagtttctcatggaaggcttttctgtaatctgtttattgggaagttgtttcttcctttatttcttcagctccttgccattttattacattgtgtccataatggtaaaggataaatctgatctcacacttcattttcagaggtacatatctttattacatgactttaatggacttatattttaaaaatatttttaaatgaagtctatttgaagttatacatgagtaattaccattcatctcaaaccttgctttaaaaaaatcagccttttcttcttaaaatattaataaaaatgaacattggatgccaagacagaatggttggggggaaaaagtagtgatagccatccaacttgaggagaggagttctagagggagtgtaaatgggaaaccctttgttctcaagggaagttaggcagtaggaattcaaaagtttcacaaagtgcttaccactttgacccaactattctgttcttagtgatataccgaaagtagtgtaagtgttcaacaataagagtgtcttttattaatcaaatttaagatgggccatacacagtgtctcacgcctgtaatcccagcacttgggaggctgattcaggtggatcacttgagctcaggagttttagaccagcctaggcaacgtagcgaaaccccatctctacaaaaaaatacaaaaattagctgggcgtggtggtgcatacctgtggtcccagctacttgggaggctgaggtgggaggatcactcgagcccagaaggtcaaggcagcagtgagccaagatcgtgccactgcactctagctctgggtgacagaggaagaccctgcctcaaaaaaaaaaaaaaaaaaaaggtaagatgaccacttctcttacttggtggacaatgcagaattttctgaactttgcttactaagtctatatatacacacctagctggtgctacccccattctctcctccttcctgcctgttacgaagggaggtgtgggatcaattcctctggctagagccatcctttcctcctgctacacacatccacattgctgaatataactctccacccttcttcaggacccttatactgttccttttctcctttctctttagtatcttcagtctgtccgttggtactagatcctcccatcaaaacttaatcacactcaggtctttcctatcatcaaaacaaaaactgtcctctagttggcatactcctgtagctcttgctgtgtttctctcttgccatcccattctttaacacgtgttaatttagctttgtcccctagaccactaaatcgttttttttttttaaggtcctcagtgacttgcatcactgtaaatgcagtttaactctcattttcctgtctttcaacagtattcccttggcttccattataccatactctggcatttcttctcacaactctgaccataccttcctggtttccattggcaatttacatgattccattcagactctagatgctggagttcatttcaactgctttctcttttaattctgtgttttattctaagcaatctcattttctgcttacaaaactttagttaataattgcatattagtgagacttcctctcttgtcctcagcaccattcttaagctgtcaccattctacatcttaaatattctgtgtatttaataagagtgcagtggaaaatactaagtcttttttaaaggactacacaaggtaattataaagttcttatgggaggaagaaacaccatgcaagaataaacattctatgaaagtagtgtaatgaggagttagccctaccaggtgccaggatataaaactacaataactaaaactgtctgaagaacttgtaggtaaatggacagaaagaccaagggacattacagaattgatacatagatctatatctatttggacattatgatgaaaaggatattattctaagcagagtcactgataataacaatttcttatgtcagagataccagtgattgctgcatcactaaatccagttgacatttctcaccctttgtcttacctgttgacaacatttgctctagctgatcactccagtctcatgactttaaatactgatccgtatgctgacaactctgaaatctgttcctccaggattatatttttaagagcctaccagaatttccatttggactttaatgggtatctcaaacttaacaggttttgatttctaccaagcttctcctgcattgctctcctgcagccttcgccattttaaatggcaggtctagtcttccagtggctcaggtaaaagctttgacactgccttgactcgtcttttgctatcacatcccaaatttagtcagaaggtcctgttggctttactttagaatataatccacaatataatcaaattgcttcttagcacgactacttacttcttactaacaaaactgctaccactttgattcaagcacatcatttcccacctgattattacagaatcctcctgactggtctccctgcttctgaacctgggagctgaaggttgcagtgagcgctttgggaggctgaggcgggtggatcacttgaggctagtagtttgagaccagcatggccaacatgatgaaaccctgtctctactaaaaatacaaaaattagccaagcgtggtggtacgtgcttgtaataccagctactcgggaggctgaggcaggagaatcgcttcaacctgagaggcggaggttgcagtgaaccaagatcgcgccactgcactccagcctgggtggcagagcaagactctgtctcggaaaaaaaaaaaaaaataataaaaataacccaggtcaggaaatagctcttcaagagccctgtcatcatgatcctttctaaggatcattgtagcctccatcctgcttagaatttgttattaataataattctttattgtctcagcttttatggtagtgtttttatttgctttgcttcatagttgaaaataaaaattgcctccctaaacaatgtggattagcgtttcctgttttgacctttacgttaagtgaaaccatataatatgctttcttgtgtgcatggcttctggctcattatgttgttaagatttatctatgttgttctttgaaaatgtagttcattcactttaatagctgtgtagtaagtgtgtgtgtgtgttttttcttttgtgtgtgtttggtgttttttgttttttttttgagacagagttttgctctgtcacccaggctggagtgcagtgacatggatctcacctcactggaacctttgcctcctcggtttaagtgattctcacacctcagcctcccatgtagctgggactacaggcgtgtgccaccacacacccggctaattttttgtatttttggtagagatggattttgctgtgttggccagggtggtctccaaactcttggcctcaagtaatctgccggcctcagcctcctaaagtgctgggagtataggcatgagccactgcgcccagttatagtaaatatttcttaacatattcattcattccactgcagatggacatttgaattatttcaagatttttgccattgcaaatgatgctgatgtaaacatttttctatatgtgtcttggtgcgcacattttattttctggtgctgatgtaaacatttcacattagaggcaatcttaggtcataggatatatatgtcttcagcttctctaggtaatgcccgtctgtttactaaacaggttgcagccagcaatttgagaatttcacttgtttcacatccttgccagcacttacattaacatagtttaattgtgccagtttgatgcttgtggtatagtctcttattgtgttgtcaatttgcattgactcaatttgcattagtccatgactgataaagctgagtgcctttttgtatgattcctgttcttctaaattaaggtatgtttatgactcagaatgtagtctatcttggtgaatgttccatgggagcttgagaagaaagcgtattttgttgttagatgaagtatgtccatcatatcctgtttattgatactgtttttcttttaattttaaaaatgatttctatttattttacttcttaaaatgttttttattatttttttttattttttgagacggagtctccccctctcacccaggctggagtgcagtggtgtgatctcagctcactgcaaccttcggctcccaggttcaagtgatcctcctgcctcagcctcctgtgtagctgggactacaggcacacactgccatgcctgcctaattttttttttttattttggtagagaactggtctcactgtgttgcttagactggtcttgaactcctgggctcaagcaatcgtcctccctcccaaagtgctgggattacgggtataagccacagcacctggtctataaaaatgtttagagacagggtctcactctgttgcccaggctggagtgcagtggtatgatcatagcttaccacagcctcgacctgctgggctcaagtgatcctcctgtgtagctgggattacaggcacatgccaacacacctggctaattttttatttattttatttatttttttgagacaaggtcttgctgtgtcgcccatgctgaagagcagtggtgcgatctcggctcactgcatccttgacctcctggggtcaagcaatcctctcaccttagcctcctgagtagctgggactataggtgtgtgccaccatgcctggccaatttttttatttttgtagagacagggtttcaccatgttggccaggctaatttttatttattttaatttttgtagagatggggtcttgccatattgtcataggctggtcttaacccctggcctcaagtaatcctctcacctagggcccttgagttgctgggattataggcatgagacactgtgcccagctgattggtgttactgagttcatctatgtctttactgtttctgcctgctggatctgtccacttttgatagaggagtgttaagatcttcaactgtaatcatggattcatctatttctccttccagtgctatcagtatttgcctcatgttattttgatgctctgttgttaggtgcatacacatgaaggactgtttgtctccttggagaattgacccctttatcattatgcagaattcctctgtataataactttccttggtctgaagccttttctttctgaaattaatatagctactcctgatttcttttgattagtcttagcatgtaattaatatctttctgcattcatttacttttaatctttatgtctatttcaagtgggttttttgtagacatcccttatagttgtgtcttgtttcttgatctagtctgacaatccgtcttttaattgatacatttagaccattgacattcagagagattgttggtatagttggattagtatctaccatatttgttactgttttctttttgttgtatttgttcttatttttgtcttccacttttctgccttttgtgattttaattgagcattctatatgattccatttttctcctttattaacatgttatactttttttttaccttcttcagtggttgccttagaggttgcaatataatttacagctattttaagttaatttcagataacacttttctgcttcccaggttgtatgagtaccttataatagcaaaatcattctaattccttcctcctatccctcatatgatatatataaaatatgtgtacataattgcacttggtcttagccaaaaggctgagaagcgatgtgcacataattcaattgtacataattgaatgtgtacataattgaatttttgctactattaatttgaatcaaaagttttcattttaccttcatttattccttcttgaatgctctttctttctttatgtagatataagtttctgatctttatcatttaccttttctgtaaagaattttgcttaacattttttgcaaggcaggtctactggcaggagattacctcaagttttgtttgtttgagaaggtctgtatttttccttcacttttgaagaataattttgcagagcacagaattctaggttggtaggatctttcccctcaacactttaaatatttcattccactctcttcgttcttgcatggtttctaagaaaaatttggatataattattatttttggtcctctataggcaaaatgtttttttcttgtggctgcctttaggatattttctttataattgattttctgtagtttggaaataatgtcctaagtgtagttttttgtttttgtttgtttgtttgtcttttgtttttttagagatgggggtctccctgtgtttcccaggctggttcaaactcctgggctcacatggtcttcctgcctcagcctcatgagtggctgggacaacaggtgtgcaccactacacctagctttctctgtgtagtttttttttttttttttgtcattcatcttgcttgatggtctctgagtttattggatctgtggtttggtgtctgacaatttggggaacttttctgtcattattgcttcctatattctgttcttttttctctttctgctccttctggaattctcattatgtatatgttacatcgtttgtaatttgtgccacagtttttagatactccagttttgttttgttttttttgatccatttttttctcttcgcttttcaatttgagtggtttctcttgagatatcctcaagctcagagattctttcctcaagcatgcccagtctaccaaaaaacatcaaatgcattctttatttctgttgcagtgtttccaatccctggtatattttagttatttttttagaatttccatttctctgcttacattgctcatctgcttgctgtctactctatccatgagagcccttaaaccattttgtttgtttttgttttttgagatggagtcttgctgtcttggccaggctagtgttgaacgcctgggctcaagtgatcctcccacctcagcctcctgagtacccaagactacagacacatgccattacacctggcaaacatcttaattgtagttgtttcaaatttctggtctgataattccaacatttctgctacatctgattccagttctgatgcttattctctcttcaaactttgttttttgtcttttagtgtgtcttatgacttattcctgatagctggacatgatacactaggtaaaaggaactattgtaaataggcccttagtaatgataaggagctggggaagaggaagtgttctgtagtcttatgagtaggtgtcagtcttttagtgagcctgtgcctctgaactatgaatgtcatgtgtctcagtctctcgtacttttttggtgggacggtggctagagcgggttggggctggccatttcccctcttccacatggaaagcaagagctggcttgagtttggtatttttcttccctcgcgtcagcagtttctgataaaacttcagcaggttaggctcttatcatatagttttgcctgagagaagaccctgttaagaatgatgctctcgtgcgtttcagaagggtctttttttcccccatgcatgtcagaagcatgagggagttttctctgattatcactgtgagaaccttgttgagttcctagaggtaaaactcacaaaagtgtgggagcccccaatgattggccggccctggagtcttgatctctccgacttgtccatgctgggcctccagcaatttgtcagctatagttccggttttcctacatcagccctggctctggaggagatttgtgcttgtgggtttctgccctgcaaggctcaattttctgcatttgccagttggtctccagttttggggtgctttgttctgcaaagacctcacctctttgatggacctaagaaaaactgttggtttttcccctgcaactttttcagctttttatttgttaagaaggagtatcaacttttagcttcttatgtgctggactagaaacctgaaattttgtgtctctagttttttttttttttaacagtttcaaataaggctgctataaacatttgtttagaagtctgtgtgaagtggggaagacctttgtagctagacctttctagcaagatttcaaaccaagaagccataagataaaagactgatataatgcatatgatagactaaggactaatttccttagtacataaaaaagccaatgatgtattagaaatgggcaaagaacatgaatagtgagttcagagagcactgtagtaatatttattgcagaattgcttattatactaaagttttggaaacaaccttcatgaccatcaattggtgaaagttatgatacaaatcctactatactgatatggaatagaatgatcttcaagctagaaaaacaaatttgagaacagtgtgtattgaactctatgtgtattgaacacagtgtgtattgaacactatgtgtattgaaagaatgtgttgggaagaaaatgtttgcattagaaagtgtttgtgttagataatgtttgtgttagaagataagagggcaaagagggcaaatatatatataaatgcacatggatgcatgggtgtctctgtagagagaagaaactgacagggtatgccttaggggaggcgaattggaggcctggaagtaagggctgggctgtagactttccactgtatctcctgttcctctgtttaaattttatgcagtatacttatattatctatatattagaaactaaaaattaaaagcctatcactctttaatagcaaagcattgatttattagtttttttgtttttgtttttgagacaggtttttactctgtcacccaggctggagtgcagtggtgcaagcaatcatagctcactgcaactcaagtgattgtcccgcctcactctcctgaatagctaggactacaggcacatgccaccaggcctacctaattgaaacaaatttttatggagactgggtctcgctatgttggccaggctggtcttgaactcctggcctgaagtgatcctcctgccttggctttccaaagtgttgggattacagatgtgagccactgtaacccactgatttatcaatatttttaagtagcttcatttaaagtgactggttgcatacagtctccatatctcagtttcctcatatgtaaatgagggtgataatagtacttaggctttagtgacacagttttgtgaagtgcttaaaaaacttcttggtgcacagcaagctctgagtaagagccacctgttactgtgttctacagatgaatgaccttgagatgttagccacattgcaagttaacttctgaggtagaactgtgcaacagaaattttttaaaaaagacaataaggcagggaaaacttgggtctttagtttggagtcgtatctttaagctacatcctatcctcattcagccacgtcactatcttctctgcatttgtcatcttggctgaatcaactctaaggctgtgaccagctctggtgctctgaggttgactgttctggaaatcttttatttcaggacacctcctacctgttcatcactggccctgatgttgtgaagtctgtcaccaatgaggatgttacccaggaggagctcggtggtgccaagacccacaccaccatgtcaggtgagaggccttgaagatgaccttgttgttttcaaacattgagaagagggcattgccaaagagcctggtggcagtttttaagaaatattacttaattggcagaccttatttgggaagactgtggtacagtctattgtactacactacagtgtattgtttacagatatagtgataaaggtagatttagtatataaaatttattaaataacacgctattagtaatgcttggttattctttaaaacaatttagagctagttgctggaatggtgattataagtaggtatgatttatgtatgtacagttgaacctttgaaaaaaaattttatcttattgtgacattttttattctaaggttggtatatatcttagagtacataagtgttttccaatcattggccaggtgcatgatggtcatatatcatgtgttgatgaatttggtcatagttgttaacttctttttttttgagacaggatccagctctgtggcccaggctggagtgcagtgacacaatcttagcttattgcaacctccgcctcccaggctcaagcaatcctcccaccacagactcttgggtagctaggactacaggcatgcaccaccacacccagcaaatttttttttttttgtagagatggggttttaccatgttgccaggctggtgtcagactcttggcctcaagcaatctgcccaccttggcttcccaaagtgctgggattacaggcatgagccaccatacctggcttttgttttgttttgtttttgagatagggtctcatgctattgcccaggctggagtgcaggacacagtgatagctcactgtagcctcagtcttccgggctcaagtaattcttctgcctcagcctctctagtagctgggattacaggtatgtcacatcatacccaggtaatttttatttttaatatttttttgtagagatgtggtctcactgtgttgtccaggttggtctcgaactcctgggcttgagcaatcctcccacttcgacctcccaaagtgctgggattacaggcgtgagccaccatgtccggctagttgttcacaactttaagattacgtaccaagtttaaaatgtataaagattattctgtgcctcagcactgaaacaaaaagttcttgtttaaacagaaaggcatggaattggaagtagggcatgattctgatattagtgaagacatgttagctgttggagtaattattgcaattccatgttttcctgtaaaagaaaccacccagctgtgaatggattacctaccacacagcaatgtaactaaagacaggagaaattgcttctctgagagattttacagcagtgagaggctggcatgcctgatttatgcacctcattgtactgtggttaaggcattgggtcagcatttaattgtcagcatttcttcccagtgtccctaaagtagagatgtgtcttatcagtgaagtcttagattagatgaaatgtagttttaaaaaagttagggctcttgatcccccacccacaaaaattgtttctccccatgtcaggttggcatcgatcttgactcattcctttcccttacctatcagcatcatttagccccatctttaagacatgtctagaatcagaacacttcttagcatcaactccagcacggcctgatgccatgctattgtctcagggctttattggcagcagcctgtttttcttgctggtatataatataaagctgggtcttgatggtgtcttagatttgatgaaatatgctgtttatttttccccattttaatagcattatatgtttgtagtacaaaacttagaaaacatacaaagcataaaaactgctagatattccatcatccacagataatcactagtgattttttggttatacccttgcagtcttttcacgcacatgagcgtgaatacacaaacacttactcaaacataggtatggacatactcttatgtaacctgagttttttttttttttttacttgacagcttaaagtaatgaatgtctgcccatgacattaaagtttcttctgtagcacaatctcaagtacgttttgtttgttttttgattgtagggcagtatgtggttttctttctgggcctgaggctctttgatggactgtgtctgatgcacttggccctgtatccccagggcaaggcacaaaaaggtgctccgtacatatatttttctctcttttcttttttcttttgtggtaacagctttattgagatgtaattcatataccgtatattttaaacacctatttatagtgtacaattcagtggtttttaaaatacattcagagttggataattattaccacaatcaatttcaggacattgtcatcaccccaagaagaaaccctgtgcccattagcagtcactctgcatttcaaccacagatacttctgctctaggcaattaccaggctactttctgtctctgtggattttttcattctggacatttcctagaaatggaatcatataatatgtgatcttttgtaactggttgcttttacttagcataatgttgttaaaggctcatccatgttgtatcatgaatcagtactttattcatttttatggccgaataatattccagtgtgtggatataccacatctagtttattcattgaccagttaatagacactgggtcatttccacttttcggctatcataaatatgcctgtattaatatttatatgcaagtttttgggtagacatatgttttcatttctctttgatttctgagttaaatgataactcgatgtttaacttttaaggaactgacagactctcttccaaagtggctgtacccatttataaatattttttgaatgaaagaattctgtcatgctgaaaatgctttttattcaacaaatactcatttagaatatgtggaaaaaggcaaatagcaaaggaattaaaaatttaaaatagaataataaaaatgtaaaaaaagaaacaaaacaaaacaaatattcatcgagtacctatgtgtgaagcattgttttaggtgctaggaatacatctgtggacagaacaaaagaaagacacctgcccatatggggcttatattctagtagaggagatagacaataaacattgtaaataagtacactatgcagtatgttagaaggcaatacgtgctatggaaaaagtataacagggtaaaggggactgggattgttgtagtttcaaatagggtggtaacagtaggcctcactgaggttaggagctgagcagattttaaggagttaactgcattgatatgtaagtggggagcattgcaggcagaggggaacagcttatgcaaaggctctcggtaggagagtgactggcccgatcagtgaacaaggaggatcattggagtagagacatgacacgatctgacttaaaaagctctgtctgtcagctttgtggacaagagaccgtaggggcaatggtgaaagaaaggagtctggtgggatgaacctggggagagagttcttggctccgctttctccatcatacctatggccttgtttggctgctctgtgatttcagagtgctcttcaagaattatggcttgattctcactaggggcaggtggctcccctcctttccttccactgttgctgtgcacctgtttgccaggtacattattcttaatgttggccaggcctgatcttaccctgttggagctgatattccaggagagatgtccggcagtaaacagggaaataggtgatgcagagaaaagtacgggaggagaactcccgcatggtatagggatggatagtgaaggatctgggagtgggtatggaggtgacattagagcaaggacctgaataaagaaaggtgtgacccctgtagaggtgtggttgcagaacagagggaacatgtgctgcatgagttgaaggatcacccggaaggtatgtattatgtggcattacatcctcagtggagggtgcagagaacagagctatcagcacggtctgctactgacatgccctagaagggcgcagtcaggcatgaagcagcaactttgggctggctggtaccctgactcaatcatatatgctccctgttctcttaggtgtggcccacagagcttttgaaaatgatgttgatgccttgtgtaatctccgggatttcttcaactacctgcccctgagcagtcaggacccggctcccgtccgtgagtgccacgatcccaggtgggttgtaggccggtgcaccttctctcattttgcagtgtagcttgcctttctctgccctgacaggacccccagggtctgccttgttgggcaagttgcagcagagtgtggtagagtggctcccaggtgtggggatgatgtcatgtttggctataggagcaaagaaagatgattttattttcctttttcctctctgtaatatctaatgtatatcttggtggtgaagagtggcccaaaacagttttaaagaaaaattttttgatttctaagaaactctcaagttatctagaattagagattcaagttttttttggtctggcctagtccccatgaagaagtctcccatttcctttccttcccctcacccacaaaaggaagagccatgattcttcttatgctgactatacctggcttttttctgtctaaagtgactggttcctgggctctacctagttgtccttttgaaataaataaatgtaaaatgatgcaaacagcatgccctttaggaaacatgtttatgcatactgcttatagccagaggctgggacagtcctggggaagggtgtgttgctggccatctggtgaagacctttccttttgctgttggagtctaccacctgttgtggaggcaccatagagtaaagtggaggccctgcccaggaactgctccacacctctagccgttccattttatttcctctccaaattataagcactcacttggcctggactttcttctgcagaagggatttgaaattgtattgtttgggaagaggtcattttcagatgctatcctgtagcttaaacctggactccttcctgtggggcctggtctgggccagggatgctctgaagagttgtgttgccagggcctcactctgtctgcctctgcccactccacaagggacatacccagtggcccactgtgtgtagtcatggaggggagagtggtcacaaggtccagagctgtgggtatagcctttctgagtatacagtttggagttcctgaagggtttaggacatcacttgaaggtattatggcccaggagcccagaaatgtctgcatagcccgctttggcccagctatacctcttctgcatatgattccaagggagatatatatccatatatatgtatacatatatatatgcatgtgtatatgcgtatatatgtatacgtgtatgtgtatatacatatgttcatgtgtgcatatgtacgtatatgcatatatatgtatacatacatgtatacatatttgtgcatacacacatacacatgcatacatatgcatgcataggtatatatgcatatgtatgtatatgtatgcttatgtatatgcatatgtatgtatatgtatgcttatgtatatatgcatatgtatgcatgtgtatgtataggtatgcatgtgtatgtatgtatatgcatgtgtatgtataggtatgcatgtgtatgtatgtatatgcatgtgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtatgtatgtatatgcatgtgtatgtataggtatgcatgtgtgtgtatgtataggtatgcatgtgtatgtatgtatatgcatgtgtatgtataggtatgcatgtgtatgtatgtatatgcatgtgtatgtatatgcatgcatatgtatgtatatgcatgcatgtgtatgtacgtatatgcgtacatatgtatgcatgtatatgtatgcatatgtatatgtatacgcatatgcatacatatatacatgtatgcatgtatacacacatgcatgtgtatatatgcatacccacacatatgcatgtgtacacgcccacacatgcatatatgcatgcccacacacatgcatatcaacacatatatgcatatacgcatatctacacatatacatacatgcatatctacacgtgtatatatgtatatctacacatgtgttcacatacatatatacacatatgtatatgtgtatatatgtatgacaagtaaaaagggaggactttattagcagatggggctacccttagttttctttccagcgtagagctttttgcgaagttgggcttgatggacacatggcctgacccaaggccaaacctcagcccaggagtacgtctcagggtcactgtagcccctggctgcccacactgggaaggagggaatgaaagcctattggagagaagaggttggagaggggcaagttgctgggtcctcctgtagagtgggagtgggctctggcttagtttttctgctgagacacttggatgcaggaggaaggagagagtccatgagcctgcatgtgacaggttctgtggtgattttgcccagagggcctgcagttttgctttttgaaggagctttagcagattaacctaacagggaatgtgaacccacagtggtttatgcagagctctgcctttgcatttccaagtccttgttcttttaatgttccaggaagttgggctgggctctcccagggctgtgtcttgttcactataatgtccttcagtgccctacacggtacctagaatgtaggaggtattcagagaagataaatgaaagaataacgtttagaggaataaactcattttttcctctaaaagagaaccagaagatcttttggattgatacttgtcccaggttcagttaatatggtggttaaaaaggaatgactctttggtgactgctttgtaagcccagcagggacagaactggcccagtccctatgacgtgtcaccccatttcctttcccaccccattcccacaaaaggtaactggctcttcctatgttgactatacctgccttttttctgcctaaagtgaccgtctggttcctgagcttgacacaattgtccctttggaatcaaccaaagcctacaacatggtggacatcatacactctgtaagtgccacatctgtttgtcttgcctgtcctagtcagccacattcatgggcattgtgcttcggcttagtgaggaagcactggaccacttggcctccatgtcagacagcacaggtcgggaatagggtgggcacaggaccagtggccactgagtagtgtgttctggaaagacctagtggctatagataccctagtggcacagatggacttgagggctggagataggagtagtaagggccagcagagctcaggagtctttagaaggccctctgaggatcataaattaggggccatgtccacagagtctagagtgaggccagagtgatcattgttaagtatcattggggccctctgctcagagggggttttgtctttatagagaagagagtacacagggcatcctagaaggttggactgtgtgtgtggaggtccgtgggagacaggagccatttgtacctttttttggtacagcagattcctgggtcattaagtaaaggggacagtgttgggcaaactgaaggcatctgtagatggccaatgccttccttaagggtacactgtgctctcggtagtccttgtgcaacacatcgtgatggctctctggtaactctagaagtcagattctccctcttccctagggtttgctgttttctgttattgtttttgtcttttttattcttgtagtctcttcctgcaccaaggattagcctgagatgtaaccttaaggtcttccttaggtcttttctgagcctttgcaggggcacgtgcaatcactttctaattttccctgcatatgcagttgtttttgagtgtcctagttgttaacgtctggctcccaaaagtagaaaaagagaaaaaaaatgaagatggtaaaaagatgtcagccctttaaattccttggaagtcagttcagcccaaagcaggagagcctcgcaacagtgtggggagttgtagcaacagtgaccacccatctctttgcacctctgtgatcagaagcagcagtcagcaagcacagattctcaatatttggaggacagggtccttttatgcccaccccggctcctgcaagctgtgtgcaaactgctgcaggaacacttgcggaaatatctgtcatggagctggggtgggggatgggtagctgctactatgctaagagctgaaattaactccaattttcagtccaatccttcccctggaagttgcagtctttcaacagacgccagagtcaaaatagttccatcagacagattctgccaggcaattgttgcctgggtggggagacagattcctggtgcttcctactctgccatcttctaactttttcttaaggtacatatgataactcttgattctcattataaagttttatatcctgctacctattaaatactcttgtttgtaatttttttctgtcatttatttagggttttattttatttatttatttttattttattttattattattatactttaagttttagggtacatgtgcacaatgtgcaggttagttacatatgtatacatgtgccatgctggtgtgctgcacctgttaactcgtcatttagcattaggtatatctcctaatgctatccctcccccctcccccaaccccacaacagtccccagagtgtggtatttagggttttaaaaatgtggttgtatactgtctatgtataaataagagttctgtcgggtgcaggggctcatgcctataatcccaatgctttgggaggctaaggcaggaggatcctttcatgccaggagctcaaaaccagcctggacaacataatgagtcaccatctctataaaaagtaaaaaaatttgctgggtgaggtggctgtcgcctgtagtcccatttacttgggaggctgagatgggaggattgcttgaacccaggtgtttgaggctgttctgagttatgatcattgccactgcactccatcctggtgtgcaagactccatcgccaaaaataagtaaatgaataaaattttatctttccagttattttacatgtcatttctttccttgtcttgcattggctacaactccctatatgtcaaatgtaatggtgaatcatagttgtgattctgggcatctttgtattgtttgtaagtttagcaagactgctgtcagtgtttcctaatttatatcttttttcatgttgaagctactactggcttctgttttaaatatttttgttgttgtttattttgttcttaaagttaggaatgagtgttgaatattgttgaatgcactttcagtgtttttggagatgatcatgtgattttcttccttagatctatttataaatctatcctagtagatttctgaatactaaacttccttcattcctgaagttgtatattctgtttgctaatgttttgagtttctgcattgatattatgtgatactagtgcgtatattttaaggtattttaaaatcaggttttggtatcgatgttgtatttgctttacttatttatttatttaaaaaaaatttttttttgagacagagttttgctcttgtcacccaagctggaatgcggtggcacaatctctactcactgcaacccctgcctcctgggttcaaccaattctcctgcatcagactcccaagtagctgggattacaggcgagccctaccatgtccggctaatttttgtacttttagtagagacacggtttcgccatgttggccaggctggtcttgaacttctgacctcaggtgatccacctgccttggccccacaaagtgctgggattacaggtgtgagccaccgtgcctggcctgtatttgctttatgtattagtgttctagtgctgccataagaaaataccataaactgcatagcttaaacaacagaaatttattttctgtcagttctggaggctagaagtccaagatcatggtgttggcagggttggcttcattctgaggtctgtgtctctttggcttctggactacactcttgctgtgtcctcacgaggtctttgctctcagtgcatgcagaaagagatctctggtatctcttcgtcttttttttttttttttccctcagagacagggtcttgctttgtcacccaggctggagtgcagcggtgtgactttgactcactgcaggcttgacctcctgtgctcaagtgatcttcccacttcagcctcctgagtagctgggactatagctgcatgccaccacatctggctaattttaaaattttttgtagagatggcaactcactatgttgcccaggctggcttttccaattatttatttatttttttttgagttggagtctggctctgtcgcccgggctggagtgcagtggcgtgatctcggctcactgcaagctctgcctcccgggtacacgccattctcctgcctcagccacccaagtagcagggactacaggcacccaccaccatgcctggctaattttgtttttgtatttttagtagagacggggtttcaccgtgttagccaggatagtctcgatctcccgacctcgtgatctgcccgccttggcctcccaaagtgttgggattacagatgtgagccactgtgcccggctggctttccaattcttttcttttttttgagatggagtctcactctgtcgccaggctggagtgcagtggcacaatctcagcttagtgcaacctctgcctcccgggttcaagtgattctcctgcctcaacctcctgaatagctgtgatttcaggcacccgccaccacgcttggctaatttttgtatttttagtagagacggggtttcaccatgtttgccaggatggtcttgatctcctgacctcatgatccgcctgcctcggcctcccaaagtgctgggattacaggcatgagccacgggcgccaacccagcttttccaatttttaaaagaattccagtcctaacagattagggtccccctcttatggccccgtttaactttaattacctctggaacatccctctctccaaattcacttttttttttctttgagacagagtctaactctgttgcccaggccagtgtgcagtggcgagatcacggctcattgcaacttccaccttccaggttcaggagatgcttctgcctcagcctctcaagtagctgggattacaggtgtgtgccaccatgcctggctaatttttgtatttttagagatggggtttcgccatgttggccaggctggtctcaaactcctggcttcaagtgatccacttgcctcggcctcccaaactactggcattagaggtgtaagccactgcacctagaccatatatttacttttaactcaaaaagtattgtattattacacttttttattttgctttttaaaaaaacttcttctggccgggcgtggtggctcatgcctgtaattccagcactttgggaggctgaggcgggtggatcacttgaggtcaggagttcgagaccagcttgaccaacacggtgaaaacctgtctctattgaaaatacaaaaattagccgggtgtggtggtgtgtccctgtaatcccagctactggagagactgaggcaggagaatcacttaaactggggaggcacaggttgcaatgagctgagattgcaccattgcatttcagcctgggcgatgagtgaaactgtctctaaaaaaaaaaaaaaagaaagaaaaaaagtgaatatgctagaaaagagtcaaagcagtgactttagaagctacttaagagtgcacacacaaatcaatacggtagtcaggggaaggcattacttctggggaagaagagtacaaaggaaagagagaggtacctttggaaattgtgaagggaaaatgaagcaagggggttacatttatgtacctgcaagacatacaaaatcgaatacactgaaggacactacatctttccccatcaccctccctaaaattagtcacccatgaactaaactgcactttgctatactgacagaagagggtgctcttgaactaggatttttgttcatttgttcatctgccagctttggagaatgcagatacaaatagttttcatttatataaagctacaataagaaaacaaaaagtgagaatgaaacatgtcagttgatggaactcccttcactgtaaaagtcaatcatgaagcagctgactatgcttcaatctgagtgcagtagcccctgataagcatttgaggttgtaaaaatagaaaattcagaaactaatgacaagatggagagataatagtaagaagttaaagctgattgaattaagaaaatgggcaggggagacaaaattgcatcagaaatgatatcaaaattgcaaggtgctcaaaggagaatgtatttcaatgaaaatttaataaggaacattaaagaaaagtagataaatagcctaaaaaatgaatgaaataatataaaaaagtaaaagtagattttacattctcaccacaaaaaagtatgtgaggtggtggatatgttaactagctttagtcatcctacactgtatacatatatgaaaacatgtacgttgtacatatatgcaattataaaattttaaaatagtacagatacctttaatacaattattggttatattgtcacatctgggattaattttttaaaattcttagttaaatgtatgagaaaaaagtgactacaatgaaaggcaaagaagaatgaacatacatataattggagtgtctgaagaaaaaccagtagaacagacttaatatttaaaactgtaatccaagaaaatagtccagaaataaaataagattcagatttatataatgaaagagcacactgagcacgtgggaaaattgacccagaattgtcaaactagagaaaatattaactgttcgatttttaaaataaggagaaatactcaggacctttgggcagaaatcaaatgacttacaagggcaagagaataaaatggcatccaacttctccaaagcaacgtagaaaagcaaggaaacaacagaaaagcactttcaggaggctgaaggaaagaatctgtgactaaggattttatgtttagcaaagctcaccttcatgtattaagactgcagaaaaccagttttaaaccaagaaccgagggaagtttgtgttaatgaggctttcttgaggaatctactagagaatgagctttatccaatcaagaggtagctggagaaatttcaacaaaaggattggtagtgattatctaatatacttaattataattctaagactaaaacagaagtggggatgagggtagagaacaatgtataagtactatatgtttagtttcagaaaaaaatgcaactgaaaaatgggaggagaagagaggggaagaatattgcagaatcagctcactgattattgttagctaacagatatcattaaaaacaaactagttaataaaagattaaggaaatgaactaaaggcatcaaaaggcataattacaaaggtaaccactagactaaaaaatacaaacattctttaatactactcacataaacagtatatatcattgtgggtaatgataaaggggaaaaataaaaaaaaaggtaaaagacaataaatatagaatacatagtaattataaaaaataatatgacaggccaggcgtggtggctcatgcctgtaattccagtactttgggaggctgaggcgagcagatcacctgaggttggaagtttgagaccagcctgaccaacatggagaaaccctatctctactgaaaatacaaaattagccaggtgtggtggcacatgcctgtaatcccagctacccgggaggctgaggcaggagaatcgcttgaacccaggaggcagaggttgtggtgagccgagattgcaccattgcactcaagcctgggcaacaagagtgaaactccatctcaaaataataataataataataataatatgatagtaaaaaagtgtcataccaataaatatggatgggtttgattcacttgttaaaaatatgtctaatttgttatggaccaattatattcagtatataaatgtgattcagaaaggctaaaaataaggaatgggcagaaatatactgggagaatggaaacaataacagcagtatttgtgacactaatattgaacagagtaaagttcaggtattaaccataataaggaaggactttttttttttttttttgatatggagtctcactctgtaacccaggctggagtgctgtggcacaatctcagcccaccgcaacttccacctcccaggttcaagtgattctcctgcctcagcttcccaggaaggacattttcaactgctaaaagccatagttcacaatgataatgtaaagcatatcgaatatctgtgccagaaataaccaccatctttataaagctgaaactataggagattcaacagacttaggtagaaagactgaataggagatgtatacacagcattgttattacaaagcaggtcaaatggacaaaagtaataatttaggagacctaaataacgtaataggtagatcttacacatttcttttggactttacaccctggtaatgaacaataaatcttattctgaagtgcacatggaatattcacaaaagttgatcatatgtattagatcagaaagaaaacatcattaaatcccatagagcaaaaaatactgtgaaacaacattgcttaaaattagaaacttttgtagcaactaaaacaaaagtagcctccagccgggaaataaatcttctagtaaacaattcttggatgaaaggggaaaatagaaaccaaatgacagaattctaaaagaaaaaaagacaaaacactatgtgtcaaaacctatagaatatgtttaaaacgatgaacagatgaaaatctgtttcctgaaacagtaaaaatcagagaaggaaaataaacaggccaggtgcggtggctcacacatgtaatcccagcactttgggaggccgaggcaggtggattgcttgagctcaggagtttgagaccagcctgggcaacacggtgaaaccccgtctctactaaaatacaaaaaattagctaggcatggcggcatgtgcctgtaatcccaggtactcaggaggctgagacaggagaatcgcttgaacctgggaggcagaggttgcagtgagcccagatcgtgccactgcactccagcctgggtgacagagcaagactccatctcaaaaaaaaaaaaaaaaaagaaaagaaaaacagattcccaactggaaaagccaggggaaaaaaccctgtaaaatatttcagaataaatccaagaaataatttaataaggataaatgcagaaatttatgatggaaatagaagaatagctgcaattagtaaacactggctaacttcaaaaaagagacagtaaaagcagaagtatgaagtgagaaagggaataaccattgaaaaagaagaaacttaagaatcgttaagaggccaggtgtggtggctcatgcctataatcccagcactttgggaggctgaggtgggaggatcgcttgaagccaggagttgaagaccaacctgggcaacatagtgagtccctgtctctacaaaaatttttaaagttaactgggtgtggtggcatgcacctatagtcccagctacttgagaggcctcagtgtaggagaattgctagaacacaggagttcaaggctgtagtgagctgtgattgcaccatcatactccagcctgggcaacatagtgagaccctgtctcaaaaaaaaaaaaaattctaagagacaagatacattggaaaatttgtttggaaaacacagtttaacagaaattgatcccatcagagataggaagcttaaatgaaccaccaaattccacggaaggaattacttcaccaaaaagcacaaggagctggattcagtggctcatgcctataatcccaacattttgggatgctaaaacgggaggattgtttgagcccaggaatttgagaccagcctgggcaacatgacgaaactctgtctctacaaaaaataaattagggccaggcaaggtggctcacacctgtaatcccgcactttgggaggccgaggtgggcggatcacctgaggtcgggagttcgagaccagcctgactaacatggagaaacctcgtctttactaaaaatacagaattagccaggtgtggtggtacatgcctgtaatccccgctactcgggaggctgaggcaggagaattgcttgaacccaggaggcggaggttgcgatgagccaagatcgtgccattgcactccagcctgggcaacaagagcgaaactccatctaaaaaaaaaaaaaagccaggcatggtggtatgcacctgtagtcccagctactggggaggccaaggtgggagttcacttgagcccaggaagttgagggagcagttaaccatgtttgtgccacggcactctaccctgggtgacagagcaagactctgtctcaaacaaacaaacaccaggcccaaatagtttcatgtggaatttctgagacctttaagggccaaatagtcctagtgccacataaattcttccagagcatagaaagtaaacaaaacacacaagaaccttccaaaattttttaaaagaagtatgatatcagtacctgaacctgataaaggtagtacttaagatttcagtttcatattgcttatttctttaaaattatatctgtggcctactgggatgtattctaggaatgcaagattggttctaggaaactcaataatatactgtattaacacatataggggagaaaaatcacaattatttatatagacgctgaagaaaacctttaagaaacatcaatacctattcctgatagacttcataaaataggaattaatactttcttaatgtaataaaatttggtatagaccttttcaaaagcctgcatctcacctaataaagactagcttctactaggattaggaacaagtataggatgcccattattcccattattatttaacattgttctggaaatattaaccaatacagttatccaagaagaggaccaattagagacaaaagccttgggagagatgtcaagctgtaacgtaggtgatatagtattgtagtattcaagaaaactctagagaatgcattattatactaaaacaatacttgaggaacaggatacaaaattaacatatagaaatcttcatatacgcaagcagtaaccaattatggtagagtaaaagcctctcttacatagcaacaggaagataaaatatttagtaataattttaacaggaatgtacagaagctgttttagggcaaatttatttttttagacagggtttcactctgtcacccaggatggagtgcagtgacccagtcacaactcactgcagcttcaacttcctggtcaagcaatcctcccacattgccaggactacaggcatgcatcaccacacacacctgatttaatatttttttttttgtaggaagaattcctgctatgttgcccaggctggtctcgaactcttgggctcaagcgatccttctgccttggccttccaaagtgctgggattttaggtgtgagcccccaagcccagcccagggtgatcttaaaaacacttttgaaaatcaaaagtaggccaggcatggtggctcacacctgtaatcccagcactttaggaagctgaggagggaagatcctttgagcccaggagtttgagaccatcctgggcaacatagtgagaccttgtctgtacaaaacaaaacattaaaatagacttgaacaaatggaaagacattccttgttcctggggttaatgttattaacaaactggtgattcttaagttgttctataaatttaaggcaatcccaataaacagtttttaaaaactagaactagataagtttatacaaaagtgcacatggaaaaataaaagtgcaagaatacctaagaatatactgcaaaagaaaagctgtaagtggggactagccatgctttatattacagcatcctatagttaaaactgtggtacaggcacataaatagaccagtggaatagaataaaagagccagaaatagactcaagtacatacagaattttagtacagtcacgcgttgcgtaacaacagggatgtgttctgagaaatgcatcattaggcagtttctttgtgcgaccatcatagagtgtacttccacaaacctagatggtataacctattacacacctaggatctgtggtatagtctgttgctcttaggctgcaaacctgtatagcacgttactgtaccaaacactgtatgcagttgtaacacaatggtaagtatgtatctaaacataaaaagggtacagtaaaaatagggtattacaataggaccaccttcctataggcagtttgtcattgaccagaacctctttgtgtagtgcccaactgtatatgataatgatattttatcaaatctcaggggcaaaaattagcttttaataaatgatgctggggcaactgactagccatttaggaaaatataaaattagattcatactttacaccatgtacaaaaataaactacaaatgggtcagaaaactaaatataatctgtgaatccatacaagcactaaaagaaaacacagatgaattcctctgaaaccttaggggaaggtttagaaatgcttttgaactgtaactcaactagtttcagtgaaagatagacaaagctgactgtgaaaattttaaaatcccactcttcatagcaaaaaactataaataaaatcaaaaggcaaccaatatgctagaagaaactcttggcagcatgtatcccagagtatgaatattcttaataaagagctcttatgctgagggattaacaaccaaaattgatagaaaagtgggcaaaaaaccacggatagatagctcacaaaaaagatataaaatggaccttaaacatgtcaaaagattttcaacttcatacataatgctagaaatacaaattcaaattacactgagtattttctcatatgttagattggctaaaaataaaaaccccgaaaacactttccattggaaagtcagtggagaagcaggcactcctgtgcattgctggtaggggactctggtattatccaggactaaattagcatttgccctttaactcagcaatcccattcctagcaatttaccctgaagatacacttcccaccatacaaaattatagatgtacgaggttacgaccattacgttgtcatttgtaattgcgagatactctaaataacctaaatgtaaattttaaaataatgtaagccacgtgtagattggttgaataaactttggtacatcacacagtacagtactatgcagaagtgaaaaagaatgatgatctctatgaactgataggaagtgattcccaggacatattaagtgaaaaaattcaaagtgcaagagtgtctgtactgttactttccatgtaagaagggtaaattaaaagatacaaatgcaaacacacacataatacatcagaaaataatgagattaataacagggtaggtgggactagggtggaagggatggggaaggaacactattaaactgtattagtattttacatattaaaaaataaaatcaagactggggaaaacctttaaaatgaaatacaaacatgaacctgttttaaatgagtgtcttttgaacctatattttgactatatacctttaatctaaagaccaaaatagctgtaaaaaaattctagctagtaggtctgttttttgtagctaagttagcagttctgaaaccattttctctgtatttgaggatcgaataaataagtacattttgagggtagtagcagccagattctgctatcggagaagggagttgtgaatatggcaagagaaaaaaatctagaatgaaccctatagttgcactggagtaggattagaattatcagcatgaactcatggtttttcatatagctggactttggacgttttagaaggagtcacacacacacacacatccctaaaaggaacccaggccttttggagaaatggctgattgtagggctggggcaggaaagaaaccaagatgaaccagaaagtaagatacttccaaaatataaggtagtgctcaaagaatgatggggacactttagaaggacacaggaaccagcatgaaggaactttggtaaatataggacaatttaaacataaaatgatggtgaaagattataatccatagaataaaacaatctataagttcatattgatacctataagtaaatgggaaaggcaaagatctttcttgtggtagatgtcagctaataaatggagaagaaaagtggaattggaaaactcaccctttgggctgggtgtggtggttcacacttgtaaggagggcggattgctcgagcttcggagtttgagcccagcccggccaatacggtgaaaccctgtctctactaaaaatacaaaaattaaccaggtatggtggcatgaacctgtggtcccagctgcttgggaggctaaggtgggaagatcgcttgagcctgggaggtggaggttgcatcgagctgaggttgctccactgcactcccacctaggtggcagagtaagaccctgtctcaagaaaaacaaaaacaaaaacaaaaaaacaaaacaaaaaaactcaccatttggcagctatcatgacagtaatgagtcaggcaagaatcatggctgcttggtggctgctaggatgctaaacctagtggatgaagaactagattaatgattaaagtttgaagaacaggattttatgtagtctcaacgtatttcctcacaaaattcttattaaattggagaaatagtaactttacaaggaaacctgcagatatcaccatcattaatggacaaatcaacacattgtgccacttgatgagaatgctccttctgtggtactcctgtggaaaggcttagctcaaaattaaacatgaagaaataccaaaggaacccaaatagaagtcatgctttacaaattaactggtctgttgtcttcaaagatgtcatgattatgaaagacaaagatggagggggaaagttaaaggagcctaaagagatataaccactaaaagcaccaggtgatcctggctcaggttctggaccagaattttgttgcttgtgctgctataaaggatactattggaacaattggcaaacttgaataatgtcatataataagaaatagtggccgggcgcggtggctcacgcctgtaatcccagcactttgggaggccgaggtgggcggatcacgaggtcgagatcgagactattctgaccaacatggtgaaaccatctctaaaaatacaaaaaaattagctgggcatggtggtgcgtgcctgtagtcccagctactcgggaggcttaggagaattgcttgaacccagggggcggagattgcagtgagccgagatcgtgccactgcactccatcctgggcagctaagcgagactccgtctcaaacaaacaaaagaaaattgtgaattgggcacagtggctcatgcctgtaatctcagcactttgggaggctgaggcaggtggattgcgtgaggccaagagtttgagaccagcctgcgcaacatagcaagaccctgtctctacaaaaaatataattttttttttttggtggcatatacctgtagtcctagctacttgggaggctgaggtgagagaattgcttgagccctggaggttaaggctgcagtgagctgtgatcatgcttctgcactccagcctgggtcacagagcaagacctgtctcaaaaaaaaaatagtattgtggtaatgtttatttcctgattttgataatatcactgtagttataaaaaagaatgttcttatgtgtttatatatatataaaagagagagtgatggtcgggcacagtggctcacgcctgtaatcacagcatgttggaggccaaggtgggaggattgctcaaggccaggaattggagaccagtctgggcaacatagcgagatctcatctctactaaaaattaaaaaattaactgagcatggtggtgcacagctgtggtcctagttgcttgggaggcagaggtggggaagatcacttgagcccaggagatcgaggctgcagtgagccataattgcaccactgcattccagcctgggtgacagagggagaccctgtctcaaaaaaagaaaaaaaaaaaaagcagaatagtttgtagtaaaataataatgaagaatcggggtgaagggtatatgtactgttcttgaattttttatttttatttatttattttttgagataggatctccctccgttgcccaggctagagtgcagtggcataatcttggcttgctgcaacctctgccttccagtttaagcgattctcctgcctcagtctcctgagtagctgggattacaggtgcctgccaccacaccaggccaattttttgcatttttagtagagatggggtttcgctacattggccaggctggtcttgaactcctggcctcaggtgatccacctgcctcgacctcccaaagtgctaagattacaggagtgagccactgggcccggcctgacatttttatttaggttggaaataatttcaaagtgaaaaggtaaagttgtcacaaaaattccacactcaaataggacttttaaaacaaacttcattggtgtgtccatcttagcagcagttgaggttttccacaccatttctccccagcagggaggaggtgctgcctctgcctgttgtcctgcttccttggagaacctgtgatagagctggagctgtctacctctacctctgtaattctgtaatagaaatgtcattctgtagtgtcattacatcttatacttgtctttaccattttgagctcagaagtaaatttattcctgcaggttgttgatgagcgtgaattttttgagatcatgcccaattatgccaagaacatcattgttggttttgcaagaatgaatgggaggactgttggaattgttggcaaccaacctaaggtggcctcaggtaggatggagctcttataagccttggttttggggttggaggccagggaagcctgggtccatggtatcctttctgtcttttgcctgttcttcagacatggccttccatgaccagaggaaaaaatctaaatggttgttataaaagctaattttttttttttttttttttttttttttttagacagggtcttactggtgtctaggctggagtgcagtggtgtgatctcagcacactggaccctctgcctcccagggtcaagcagtccttccacctcggcctcccgagtagctgggactacaggcacataccaccatacctgactaattttctttttttgtatttttggtagagatggggttttgccatgttgcctgtgctggttttgaactcctgagctcaagtgatccgcccacctcagcctccgaaagcgctgggattacagacatgagacaccacaactggcctataaaagctacttttaatatctcaaaatgcttctttcatactccttttcaaaggtttataggaaacttacattcttagtgtataaggttttcaattttttaggggtcagttttctgttcccccctacccccagctaaatatatgactcacccactaatcatgagctccatgagggcaggggtggtgatgtcgtattcacagtagtatctccagtgccttcaacagtgccaggcacatagatggtacgtgacaagttaatggcatcttaccatgtctgtgccccacagctttctggtgatatggccagacctgattcgcagccaagtgagggagactcttccatggctgtgctctgggagggattgggagtgctggggtggggactgtgaataccacttctctcctcaatatttttcctcttagatttgttttgtatccttgtttaggaagaatctgtctttcttcatgacctaacctcatcttatttctgccatggaaattttttattgtctttagaaaactgttttggctgggtgtggtgcctcacgcctgtaatcccagcactttgggaggccaaggcgggtggatcacgaggtctggagttagagaccatcttagccaacatggtgaaaccctgtctctactaaaaatacaaaatacaaaaaatgagctgggcgtggtggcacgtgcctgtagtccagctacttgggaggctgaggcaggagaattgcttgagccggggaggaggaggttgttgtagtgagccggggattgtgtcactgcccgggaggcagaagttacagtgagccgagatcacgccactgcatgacagagtgacactgtccccacctccccaaaaaaaaaattttgtcatggtaaaatatatataacaaaatatgtctgtttggcccatttaaagtagtgcaaccgcagtgattacatacaaagtgtatgcaaccatcaccactgtttccaaacattttcatctcctcagagactgtgaacctgttaaacaataactcactatttatctcagcctccagcctttgctattctaaatctactttctctctctatgaatttgcctattttagatatttcatataaatggaatcatacagtgtttgtccttttatatcaatcttatttcacttagcataatcaggcttatttcatttagcaagattcatccatattgtagcatatgttagaacttcatttatttttatggctgaataatattatgttgcatgtatataccacattttgattgattgtccatttgtcagtggacacctgggttatttccacctttgggttactgtgaataatgctggaataaacattgatatataagtatctgtttgaacctcagttttcactttttctgggtgtgtacccagaagcaaaataactgggttatgtggtaattctaggtttaactttttggggaaacaccatactgttttctacagtgtctgcactattttacattcccaccagcaatgtgcaagggttccagtttttccacatccttgccaacacttattattaatttttaaaaatagtaatcctagtggatgtgaagtgaatggaattgtgtttttgatttgcatttctcatcaacattagtcttggtgagcatcctttcatgtgcttattggccatttgtatatcttctttggaaaaatgtctattcaagtccttttccattttttaattttgtgtgttttttgttgttgagttggagttccttgtatattctgtatattaaactcttacatttgacttacaagtattttcttctgttctataggttgtccttgcactcttttgatcatgtcttttgatacacaattttttttttttttttgagatggagtctcgcgctctcttgctgtctccagcccgggctggagtgcaatggtacgatctcggcttattgcaatctctgtgccccgagtttcaagccattctctcacctcagcatcccaaatagctgggattacaggcatgtgccaccatgctgggctaatttttgtatttttagtagagacggggtttcgccatgttggccaggctggtctcgaactcctgacttccagtgatctgcccaccttggcctcccaaagtgctgggattacaggtgtgaaccactgcacctggctgaaaagtttttagttttgattaaatctgatttctgtattttttcttctgttgcatgtgcttttgttgtcgtatataagaatttaaattcaaggttgtgaaggtatgttcctgttgtttttttcctgagagtattacggttttagcccttacatttagcttttaatttcgagttaattttatatgtattggataggagtgcaacttcattcttttgcatgtggaaatccagttattccagcaccgtttgttgaagagattattctttcctcattgaacaggtgtggcgtgcttgtgggaaatcaacaggctgtgggtgtatgaatttgtttctgtattcttaacactattctgttggtctgtatgtctgtccatattccagtgtcacactgttttgattactgtagctttgtatatgttttgaaattgggaagtgtgtcttccaactttattgttgttcttaggattgttttaggcatttggggcccttttaaattccatatgaattttggtagtgactttcccatttctccaaaaaaggctgttggaattttgatagggatggtgttgaatcagtagattactctgagtagtattgacaccttgacaatattgtctttcaatccatgaacacagaatgtctttccatttttcttctttttttatttctttcagctgtgttttgtagttttcagagtccaagcctatcacctctttggttaaatttattcctaaatgttttattcttctagatgtcatgtacatggaattgctttctcaatttctttttcggattgttcattgctgctgtatagaagcacaactacaaaactgatttttgttgatcttgtaacttgcaactttgctgggtttattaactttgttagcttttgtttcaaaatttatattgctacattttgtttgattgttgatctgtggacatggggtattttcaccttttagttgtgaataatgctggtgaatattgtgaatattatgaaagttgatgaatttgttcattagccctcttgtggatttgctgggattttctatatatagggtcatattttctgcaaatagagatagttttacttcttcctttccaatttggatgctttttatttttcttgtctaattgctctggcaagaatttcttgtacattgttgaattgcagtggtgaaagtgggcatggttgtcttgttcctcatgttaagggaggaaaacctaatctttcattattgtataatgttagctgtgggtttttcatgaatgccctttataatatggaggaagtttccatctgttcatgattttctttgttttatcatgaaagggtgttggattttgtcaaatgccttttttgtgtcaattgagatgatcatgtggtttttgtccttccttttgttaacatggtgtattatgttgattttcttatgttgaactgcctttgcattcctggaataaatcccactggatcacagtgtataacctctttaaaaaaatagacttacagaacagttacaggtttgcagcaaaattgaatggaaagtacatagaattcctgtacaccttctgctcccacatgcacacatgcacagcctccatatgtccaaaatcctgcataagagcagtatatttgaggttaatggttgtattaatctgttttcacactgctataaagacaccacccaagcctgggtattctataaaggaaagaggtttaattgactcacagttccatatggctgggaaggcgtcaggaaacttacaatcatggtggaaggcaaagtggaagcagacgttcttcacatggcagcaggagagagaagtgcaggcaggggaaatgccagatgtttataaaaccatcagatctcatgagaactcacacactatcacgagaacagcgtgaggaaaaccacccccatgatccagtcacctccctcccttgacacatggtccctccctcaacacatggggattacagcttcctctctcaacacatgggtattacaatttgagatgagatttgggcgggcacacagagctatcccataccaatagtattttgttttaaatttcagattctactggtttattgccaatatataggaaagtaattgatttttgtatattagccttttatcctgcaaccttgctatattattagttccagcagttattttttggtcacttctttcagattttctgtatggacaattttgtcatctgtgaacaaagacagtttgatttcttccttctcaatgtgtatacgttttattttcttgtcttcctgcattagccaggacttccaatacaatattgaaagatagtggtgaggggacatttggtcttagcaggaaaacttctagtttcttacaagtaagtgtgatgttagttgtaggtttttcatagatgttctttataaagttgaagaaattcccctctatacctagtttattgagagtttttgtcatgaatgtattttggattttgttacatgctttttttgtattcatatgatcatgtgatttttcttctttagactgttgatatgatagattacgttaattgatttttgactgttgaactaaactcacatacctgagataaatcccacctggttttgatgtgtaattctttttctgcattgttggatttgatctgctaatattttgttgaggattttttcatatatgtttatgagcaatattgagatatagttttcttgcaatgtctttgtctggttttggtatcagagtgatgctggactcatagaatgagttagaaagtattctttctgcttctgtcttctggaaaagattgtagagaactggtattaatatcttccttaaatgtatggtagaattcactagttgaaacctgggctttatttgctttttaaattatgtaggaaataaaaagtgaagttagaaaccaaaatactcaaatcctggtttttatatttgcccatgtagtcatctttacttgagatatttatttcctaatgtagctttgtgataccgtctagtgttcttttcttttaacctgaagggcttcctttagcatttttctgtggagtaggctggttggtactgagggcctcagcttttgtttatctgaaaatgtcttaattcttaaattttctctcatttttgaaggacagtttgccagatatagaattcttggttgacacttttattcttttagcattttaaatatgttatcctgctgtctctggctttcagagtttctgctgagaaatcactggataatcttaatgaggatttcttgtaaatgatgagttttttttttttttttttgctgcttttaagattctcttttgtctttcagtaatttgactataatatgtctcagtgtgggtttctgaatgtattcttcttagagttagttgagtttcttatatttctagtttcacatcttgcatcaaacttgggaagttttcggacattatttcatcagattatctccttgccactttctcttagtcttctcctggtgctcttatcctgtgtatgttggttcacatgtgggtgtcccacaggtcccttaggttctgctcatttaatttttttattttctcctcagagtaatttcaattgttttatcttcatattctctgatctttcttctgcctgctcaaatctcctattgaatccttgtagtgaatttttcatttcatttattgtacttttcagctccagaatttttcattattttcctgatttcctttagttctttgtccatgttttcctttacctctttgaatatatttaagactagtttaggctgggcatggtggctcctgcctgtaatcccagcactttgagaggccaaggtgggcagatcacctgaggtcaagagttcgagaccaacctagccaatgtggtgaaaccctgtccctactaaaaatacaaaaaatgagccggacgtggcagagggtgcctgtagtcccagctacttacgaggccgaggcaggagaatcacatgaacctgggaggcagagcttgcagtgagctgagatggcgccattgcactccagcctgggtgacaagaagcagaactccatctcagaaacaaaacaaaacatctcaaaaaaaaaaaaaaaacccactagtagtgttttatagtctttttctagtaagttcagtgtctatgcttacttagggatagtttcttcattttataccttgtgatttttttaattgaaaatggggtatttatacattataatgtggtaacgctggcagtcaaattttcctcttttcccaagctttgttttttttttttttgatatttaatgtcatatatgtttgcctagtgtctttttgcaatgacttttccagagactatattttttgtcatttgtggtcactgaagtccctgtttcttcttattgtttctttctttcttttgagacagggtcttgctctgttgcctgggctggtcttgaactcctgtccttaagagattctcccaaagtagcctcccacagtgttaggattacaggtgtgagccaccatgcccagcctgtttcttaacttgtatatttgacagaaattttcttgaacaccaggaactaaaaccaagaaacaacaaacaagaaaactcctggtcttgaaattgtctctgtgttggggctctcctttgatgcttagccaaacttgaactaaggtttgagatcagctcaaggttaaagtttaaggttttctctggtcttttattttgtaatagtgttttcattttcattcaacttcttttcttatttcccctctcagatcttttctgatcgtgtatctcatcctaggcatacatgtgtctttctgaattctccctattcacgggtgcttttgaatgcactaatttcctaaagacactctctgttttttttttctcccatatcttaggtggtttcaacagtaatcttttgcccagacatctgcaggttgttcctctaccttaccatgatttaaagaaatgcctgctacatttccagcctggataagttctgagttaggtgaaacagagatgtgttccttgtgtcagtccttcaggcagcccacagacaggttagagcagacatatgcggaaatttgtgaatgaggtctgctctgcttcctccagaaccagggaggaaatgggacaagtgtaattaaaaaggcacagagctttcataccattttcttttatttttttgagacagagtctcactctgtcacctagtctggagtgcagtggcatgatcttggctcactgcaacctccttctcccaggttcaagcaattctcctgcctcagcctctgaggtagatgggattacaggtgtgcaccacgctcggctaatttttgtatttttagtagagacagggttttgccattttggccaggctggtcttgaactcctgacctcaggtgatccgcccaccttggcctcccaaaatgatgggattacaggtgtgagccaccacatctggccatttttttttgttcttttagagacagagtgtcactatgttgcccaggcaggtctcaaactcctgggcttaagcagtcctccactttggcctcctgagtagctgggactacattgtctttttattgttgatttctagggcctggcttgtgacttgcctatttatttcctttcctttccttttttttttatttgagatggagtctcactctgttgcctagagtggtggtgcaatcttggctcactgcaacctctgcctcctgggttcaagtgattctccttcctcaagccttctgagtagctgggagtacaggtgcctgcaaccacgcctggctaatttttgtattttttagtagagatgaggtttcaccatgttggccaggctggtcttgaactcctgacctcaagtggtctgcctgcccgacctcccaaagtgctgggattacaggtgtgagccactgtgccgggccatgtttttattcatgaatggatattaaattttttcaggtattttctctacatctattgagatgttcatatagtttttttcctttatttaataatttcattagttttcacatgctgaaatcaaccttgaattcttgggataaaccccacttggacatgatgtattactgtttttttgagatggagtgttgctctgtcacccgggctggagtgcagtggcatgatttcagctcactgcaagctccgcctcccgggttcacaccattctcctgcctcagcctcccaagtagctgggactacaggtacccgccaccacacccggctaatttttgtatttttagtagagacagggtttcaccttgtcagccaggatggtctcgatctcttgacctcgtgatctgcccgcctcggcctcccaaagtgctgggattacggtcatgagccaccgcgcctggcctactgtttttgtatatattgctggacttgataatgtgccttacttaaaaagtaaaaatttttcatttatgtttttggtctgtattcttttctgatgatggtccttgtcttgctttggtattggggtaatactggtctcatagaattaagttggaaactcttctaggaggggagatttactagtaattgagctcctactctgtgctgctttatagattccatttcctttactccttggaactatgctaggaggcagtatcgtccctactttgcaggtaaggaaccttaggtcaaaaggcaaagtaatttctcaagggcacgttgccatcatcagtggagccagaatctgattggaagctctgaggactctctaagaccagcccttgaatgctgcctcccactgatggctccctgcggcaaggccggctgtgtctcagctggcggcagccctttggtctgtagtgagtctgtagtagtctagttctgggcctctttggccagtgacagacaggtggattcttcatcttccctgtttcctggagtttgaggggtccttgttaccattctgcaacaaagaagtgttggtgcctccacagaaaccagctttggatggctgctgaggacaaatccccattgtggatagaactgggaattgcctggatactcagtatggataatctctctctttctaggatgcttggatattaattcatctgtgaaaggggctcgttttgtcagattctgtgatgcattcaatattccactcatcacttttgttgatgtccctggctttctacctggtaagtttttgacagagtgggggctaggagagttgcctttcccagtaaggtgcccactttatttggagatcttcttgcagaactccccgaggacttgtgacttctccatgtattctgggtgtccagaagatagggctgtgtaaggaatggccctctccagaggtgggaaagacctcacagctgagagtggcaggataaccatgtgaggacttgtgggtatctagtaactcttcctcatgtctaggcacagcacaggaatacgggggcatcatccggcatggtgccaagcttctctacgcatttgctgaggcaactgtacccaaagtcacagtcatcaccaggaaggtgaggacctcatgttggaggccatgaccctgctcactttcctacagcatagccgtggtgggaggtctggcagagttttaccagggctggaaggagtacaccttgctcatccttaaaaagatctcttgaggatgttgttcccagccccgcagaaatgtctgtgcttttttaacacaggggaactgaaggcagtagtgggaaaaagccagaaaagataatgagcattaactttgaaaggtcttacagaccgtgggccttcaggagcccagtagggctattcttgttctttgtcccaattttacctggtttcctggggtctttcagggacatgatctggctgtctcaggctctaacactcagcatttggatctgttttaggcctatggaggtgcctatgatgtcatgagctctaagcacctttgtggtgataccaactatgcctggcccaccgcagagattgcagtcatgggagcaaaggtgagggcctcttgcttttccctttctgggtccaaggactcgactctaccagcgagagctcaaggcatagctgggaaatgttggagagaggccagggcccctaggttgagccaggactgaggtgaatgggacctagaccttggtaagtctccctcttggggctccagagatagctctgcctcctgtcctataccctttcttcaggcccacgctggtgtcttcatgccaaggtgggtgcggcaggtgaaaggaaagtgagaggggtccagagtggttttgagattgtaagtaaagggggcaaagggttgagtcaactgaagtcaccttcagaagtattggacattctcccagctccacctcagcttccagggagggccccagagctactcttttaagctcataagaagctaaactgtaggtccgaccctagtgacgttggacaaggtacttcctattgcttgacctattcctcactcctccctgctttgaagtagctattgtggtcgaatcagataacttccaggtcccctagagttgacttataggtgctctgacttgaaggccaatccttctaatttccagttcagtctggtcgcctctggccaccgaattgtatactcaggtcttagggtaccgaaaaagggaaatagcacatttaattccccttgatacaagaccatggatttaataatggaaaacagggctaacatctttggctcaaagaaatatgatgagtgcaaatggagatggtagaatgggctctggggagagaagctactggcttttgcctgactgccccttattggggccacagggaagcatcacatcccatcatgcagccccttgtgtcatgatggtcagccccaggcagttcctccctctatgctatggcctttagagatggcacttcccctcagtacactgatttaccaagaaatttgcacccacacacagtgataatgagttgaaggagatctgtccaggttgggacgaccaaagatgttcatgaactcctctaatcacagggcgctgtggagatcatcttcaaagggcatgagaatgtggaagctgctcaggcagagtacatcgagaagtttgccaaccctttccctgcagcagtgcgaggtaggggactgtggtgaagagggcagctttgtttgtttggtcaacttgctcattctttctctacagaaattgtcacataactgcctttttgcctttgcagtctaatctgttgactagtgagggttgggactgtccctgggcagtcatcacttggactaaggactgtgggacaggctgctttggtaaccacaattaaaacaacattgccaaagtgtattaaatttctaggtgttgttccagttgtctagtgctgtgcagaaattcaccctataactcaacagcttaaactaaccaccgtttcccccactgcttatggttctgtggggtccacaatttggtctgggcccagctgagtggttcttgtgctggtcttgcctgggatcacccacacaggtatagtcattctgtggcttgaccggggcttgacagtccaaaatggcgtcacttacttggtagttgctgttagctagactcactccccacgtggcctctcacccttgaggaggctagtccaggcttccttacatggtgtcccgagagtagcaagggggcaaagggaaactgaggcctagatttggaagttgcacagtgtcatttttgccacattttataggccaagaaaactcaacaaggttaagcgaaggaatacaaatccacctcttgaagagagaagtggtaaagtcacattgcaggacttgtgtacaaggatgaattgttatagccatttttgaaaacctagatgtattttctttatttcctattgaattcattgtggcaggatggaggcattggagcaagcagggtatagggagggtgtccgattttccttttcttgccaagtgctcctaggccagaagttggggagctgtcagaacaggccagctcctgggatacaagggggaattcacagggcctaccatctctgtatcaggttgggcactgcttatactgctggccccagggatggtgcccaggctgagcagaaggttgaggggtggcatcatctcgggatgcagatgatccactcccttttctgtgcttcaccagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctc

SEQ ID NO: 2671 - DNA, 79847 bp, Homo sapiens; identical to SEQ ID NO: 2670
  source 1..79847: mol_type = genomic DNA

SEQ ID NO: 2672 - DNA, 9026 bp, Homo sapiens
  source 1..9026: mol_type = genomic DNA
tccttagcatgctctcatatttaattataattataatataatagaaccacagggaagggggatcccttgtcccagccactcaggtgcctgctggccgcctggatgctggtggccctgccccaggagtgggggtgcagtgtgtggatgtgaggagtggataggccacggcgggggtactaggccccgggggaacgcctgtaccttcccacccaggccctggtgggagcccggccaacccctttaaataatttcaggaatgggttccaaggagagctcccagggtgggcacatggggggccctaggtgcctgcacttctgccctcccaacacccaggtggccacagctgggaggggcctgagtcaaccccagccctgccctcctgaccttgggaccgtaggatgtccctctcccgagtggtgtgaggggctggggtggaatgcggcggcaggaggccagagtgctggctgggcctgaaaggcctccagctctgcctgcccgcttactgcctcagcttccctgccccacaaagggcctgaggtgctgcctgggcatgtgtaaaggtggaggggtttcctgccctgcccaccacagccaggagctcttctgaccttccctgaaacttctctaggcctgcagggagcagataactcctggggagtccccagccccatgtacctcccactcctgtgcccagtcttgggccctgcgtccagggcgtttcgggatgccactgccaggggcaccttggctgctccaaggccatctccaaccagcccccaagttcaggcaggaggctccggggcgtcaggcagggccacggcgccttcagccccgggccgcaggcagcagcagcagcagcagcagcagcagcagagattcagggagctggacgcaggcagctctgtgctggcaggacctgaagcagtgactgcatctggccctccctgtaggggacggtgacacctgctgcctgggctcactgtgggcattgagacatgagtcctgtggtggggctgtgcctggtgcaggtgcaggctggagccccggtcgcccccaggcagctcagcccctggacggcctgcaatggcctgcaccctgcctgcttctcctgaggaaatgcgctgacccgggctcatggtggagggtctgcagaacactggtggccaaggaagccggtcagaggggccaagagcagtgtccatcctcaggcctcagtggctgggcactccgagggccgtcagctgagcccctgcgggcgggggatgaggtgcccattccgctaggaaagacaatggtggcatactccgtctgctcagggacacagggcacggggggctccggggtcttctctcgccactggaaatccagctccccatagtccacagagaacacaggcacggctgaggggtcctccttctttgaggagaaagggagagggagtcagccccacggcccaccgcaggaaggaggcccgcggctccacagcctggctgcagtaccggcaccgaacctgggccccccactatgagctgcttaccctgagctgtcccaccactgccctctgtgtgatctggggacaccacccctcctctctggctcaatgtccccctctgaaatgtccctggcattcttgcagatttaggattccaaaatgtgacttttcaagctctcctgtctccaatgtaagataagaaatgaccaagcccaccccacgccctcgcaggtgggcacacgcatgggccgggcacacctggagaccgcaggcaggcacatatgtgggccgggcacccccagagaccgcaggcgggcacacgcgtgggccaggcacccctggagaccgcaggcaggcacacacatgggccgggcacccccggagaccgcaggtgggctggggccccagatcatggctttagggattgaggttgctgcctgggggctggggaggtggggtcctggctataatagaatgtgagtcctgcaggccgtgtggtcccagcctgtccttccacctctgcccacccaggaaggaaggcacagtggatcatgcaggaaaagagtgagactcaccaggggctggccggtgcgcctggctcctattgtccctgcagagaaacacacttggggtcaccaggccgaccctgagccgtgctcctaggtggggggtcttagtccaggggccttcatcagggacttagcctggcggggagatggggggaggtggggtggggtgagggaagggtggaggaaggggaggcgggagtgagggccgccagcagggttagggcagggcaggccgaggggctgggatgacgttacctcgtgcggcccgggagcagatgacggccaggacccagactagcagcaccaggctgcccagcaggccgcccacgacaccaaccaccagggtttggaactggccggctggcctgggtgaggggctggggtgggctgtgggcacttctgcccttctctctggaagggcacaaaggtcaggggttaggacggggtcagggtggagggtcagggtcaggggtgagggcagactagaggggctggggtgcttccagagctagaggacagagatgccggtcaccattccccaggtgcaggacagagccctggactggagctggggggtccctgccctacgaccctggagctcctgatcctgtgcaggaggggacacccaccccaggaccggctcagctcacccctgccccggggcctccgaggccgcacctgtcaccctgagctctgcccgcaggctctctttgatctgcgccttgggggccagggagatggccccacagaggtaggtgccgctgtcattgcgccgggccctgaccacgctcatgtggaagtcacgcccgttgggcagttgtgtgacacggaagcggcagtcctggccgggctggctgcggtcctcggggaaggcggccagcttgtccgtctggttgctggggctcatgcggtaccagtttagcacgaagctctccgatgtgttggagaagctgcaggtgaaggtggcgttgtccccttcggtcaccacgagcagggctggggagaaggtgggggggttccagggcctgtctggggagtctgagagatggagagaggtgaggaaggggctgggtggccccacaaagcctccccggccacctgctcacatccctcgggcagcaagggctctggaagggccaccccagctggaatgtcattgagaagtctctgctggggcctctgccacccggggatgggcactggcctccactgcagagcctcttccttctacgtgaggctgcagcttctgcacagcacctggctctgacttgggtctccctgatttcctactaagagccttcacccccttccccgttgaggccagttcccccagaaagggctgtttgggggctacccatccccagcccctgacccttgggcatcctggcctggtcctgtctgcactgctctggcacaggggagtgtaactggtctgggtgggtggggggctgcccatggagaccccagccctgggaggagtgtggccccttggcaggctcagggtccagtctttgcccccttttcaggacaagctcggagctgggaccacgtggtatgggcattgctgccctgggcagtgggcagtggggcctccacattttccagcaagacagtggggactagagctcacagcaaagatgcttcagagacgagatgggccattgactcggatgtggacagacacggggcccccgaccctgggctcccaagacaaggacctcctgaaacatatgcctgccagggtcagggcttgggatacccgcatggcaacgtgggggtcgcggctcttccgccaggcggaggcaccaacacaggcgcttaagatccaggcccgagatgccatgcaacggggtgattttcccggctcacccacaggtcccatgccacagggttccccaaacatggcgccagccccacactgtcagacccagtgcactgtcactcagttccgtctcaggcctgggcacggccccccagcgaggtgacacagagaccaggccctggttgccacagctgcggtccctctgcttcctgggacaggcggcctccgtggcaggcggtggtgatgactcaaggagcaaccagctcagaggaggagggggctgctgccctcgtgtccctgcagccaggctggcccacggcgtgctggctggacaccagaggtgggtgggtctgtcatgtgaccaggaccaactcctagtgccaacctcactgggcaccctcccaggggacgagtgaggggtttgaagtgaccttgaggccacccagggtgtccctgttccctctgtgcccatggcctcccggctgacaagcgctcgcctccttcacctgcgtgcctgtcccccagcttcctggtggtgttcccagaggtggcaggggcgagggccagctacacaaggggctgctgaggtgagccccctctctgagaccgcccttgtctgccggccggccaggggaagctccctgcataggcgtgtgcggcgtgggcccggggaatcttccagccactccagagtggattttgaccaaggagggctgtggggtagtgtgactctcagggccagcaggcagccaggccagggcactcagagacctgcctgaatggaggaagatgggcttctggcatcagggccaagagggctcctgggaggcagcctgggacagggtgggctgcagcccttactgggcctaggctggggctgggtggactcggcacagagcaggggaaatgccctgccctctgggtttctgggaatgcagtggggacccaggggccccaccaccgcaggcagcccctcggggtctccatctcccaggccagggctgccatgcagctgtcgggacagacaggcaggtgaggaacagaagtcatcacgggtactgtgagcagggaccctgcatggctaggaagtgctaagggaccccccagctgtagggcgaggtgctggcgacaggacaatggccgctgtgtgtccacaccgcaatgtccctgggaccatctgtgcattgttcttgtaactggaaacttagctgctatttatttgcacacattggtggagggacctgctcctgacttgatctgtgctggcgctgacaggctcaacccttttcctgtctggcttgcaccagccctcagccactgggcctcaagccaggaccctgggctcctgttccgccccccccaacccccctattttggaatccaccccggggagcaggtccagctgggcccctcggcctcccctgcctccaccaactggctgggtggggtgggggctagacctcggtgtctgcagttcaagcagccccctctcccacctcccccagccagtctcagagactggctcccacccagtgtgggggtgctgggtggcgacccccacgcagggcctgcctcaccccagtcctcaggccacctcctccaggaaggcttcctggcctcccttggctggtagtgtctactaggaaggtgaatattcagaagtgaccactggctggtcctggatcaagttagatttggggtgtttctatgggattccattgtttccccaggtgctccctctcggatccacgtaggatcgtgggttgatgagagagggctgtgccctatgcagggtcaggagggagacagagcccatcccggggctgtggaacaggcctgtgaggtggcggtgggggtgctcccgcagagagaccgcattacaggacattgctttccagaagcgcacagaagaaggctgcctgccccgggcggaggaacctgctggcccagaccagacccggcatctctgaccgtggtcccattagggacaaggaaaccgtcccacgggctgtgctgggatgaggacagcgagcttgtccctagaggacctggcaggggtgaggagtgaggtcttccaactcctcacagtcgtgtgtgtgtgtggaggtgggaagggctgtgggccgaaccgtgtccccacagattcctatgtggaagtcctaaccccatgacctcagaaggcggccttattaggaatagggtgacggcagctgggactaggtaagatgagggcacagggctgggtggccattgaccagcaggcctggcttcctgtacagagtcacccgtgcagagatgaaggcagagcctgggggatgcttctgaacccaggaacacagagggtggccacaaaaccccccagccaggagaagctgagcagagccctctcggagcacagggagccgaccctgtggcccctcggtcctgcatgtccagccccccacggcgggaggacaggctctgtttttaagccacagccgggagaggctgagcagagcccctcagagcacaggggagccgaccctgcggagctccatcctgcacgtccagccctcagtcggcgagagggcaggctctgtttaaaagccactcggtcggcggagctttgtcatggcagctccagccgcccagtccccaaagcaaatgtgtcaatattcttagttattgattctaggtgagggatattcattgtttttaaacgtttttgtatatttttcaaaatagtccgtttaaaatctgacttcaaaagtttgactttaaaaatcagactttaaaaatatgtgtcatggaggccagatgcagtggcttatgcctgtaatcccagtacttggggaggctgaggtgggaggaccatttgagcccagcctggggaacatagcgagaccctgtctctaaaaaaaatggaagaaattagcctggcagggtggcacgtgcctatagtcccagctactctggaggcagaggtgggagaattgcttgagccccggaggtcgagtgagccgagatcacaccactgcactccagcctgggtgacagagcaagaccctgtcactaaaagaaacaaacaaaaaagtgtcaggggctgggctgggtagttttcacagatgacccgatttaatcctcaggacgcagccttgccaggaggcgtcctcacccatgacccaaagcacacggagaagtcagtaaggggccaagtcctgtcgaaggcccagagctcagcagtggcagcgctgactggagctcacagtggtcccacgccaaagcagaggctcttatttatgctcctgccctcggacggggccaataagcagccgggttggggatatctcataaaacacaagggaagcacacacctgaggtgggagtggtggccccgggaatgaccgaatggcgaacgcagtgaatagatcaggagggaaaagaggcatcctggaatgaagaccactgcggccggggtggccacatctgggtcaggacccacaggaccccagtcatgcccactgcgccttgctgagtgccctgtgctgttaccagtggggaaaccgaggcatgccacctgtgagagtcttgtccggcacaagcgcgggcacctgaggcacgagtgtcaggctgcggacaccttgctcttatctttcccgcctgggtcggggagggtggcgtcccgagggcgtgcctgaagagccgggacacggggggagaggctcggctcccctcctgcctcgctcagctccccctcccctgtgacgagcgcccctctgccctctggttcccccgcagtcgtctccctgggatgccttttggccctttgctctttgccttttgcccagaatctccagttctgagtcctgagtgacccacgggccaaccttaagaggtggcgctgaggcaggaaggcacggccctgacaaggatgctgcctcaggtgccggggagcaggccccgggagaggggccgaggtggggaacccccagtcgcctgccacagtgaaggggcaccaggacccccggggcaggagcctcgagggggtgtcagggcggccccaggggtgcccctcatcttgtcctcccagtggtgtcacaccccggtacccagcagggcccagagggactgtcttaggcttggcctgggtgaaaccaccctccccaggccttggcatccccaggtgcaggctggctgggcacagagggccagccgggcacagagggtccaggagcgggctgtggtcacagtgtacacagagggcccagggtcacgggcagcccaggaagaggctccctctctcctcgatccgggagagtgaggccaaggcctcccccacggatggtctgaacagggctcggggagagccctggaatctgggcagagacccaggcgggcacaatccccacccaggagggatcctggagacagaagaactgtcctcactcgaacaggtacactttggatataatgagaaaaatatcaccagctcatctaaactttgacgtcgtaaagccaaggttagtcccacatggggctcatcccatccttaggaaaactcgagtgaggaccaaggatgcctgggcaaggcagagccgccacgcagactccccacggccaaggtttggggttctggccagcctgacccgtcattctacagaaacacgcagccccaaggaccggctgagaggggacagaggtcctgcctgcccaggagcaaagaggggacttgggccaggggaggagttggggcccagagaggaacccaggagttcgagctgcccaaagccacacagctcagggtaaggggcagagctgggggccaaggctgggcctgccacagcaccccccgacctgccagggactgagagtgaaaggtccctccagacccctcgctccgggacccctgggctgccagggccaggcccgcctcagcaccccccgacctgccagggactgagggtggaaggtccctccagacccctggctctgggacacctgaccgccgaccccacctacctaagaaccatcctggccgccagcccagttgtagcaccgcccagacgactggccagggcgcctgtgggatctgcatgcctggagcagccccaccagagtgccgccttctccactgctcaggcggaggtgagcggaagggaaact

SEQ ID NO: 2673 - DNA, 60738 bp, Homo sapiens
  source 1..60738: mol_type = genomic DNA
gcaaaccttaagctgaatgaacaacttttcttctcttgaatatatcttaacgccaaattttgagtgcttttttgttacccatcctcatatgtcccagctagaaagaatcctgggttggagctactgcatgttgattgttttgtttttccttttggctgttcattttggtggctactataaggaaatctaacacaaacagcaactgttttttgttgtttacttttgcatctttacttgtggagctgtggcaagtcctcatgtgagtaacgagtgggttgagatactctcatactattatgttgtggaccatgatgaggctgccagggtgggggaagggtggcctaccttctctccacaccatttgaggcaagagacattctgcctcagaaattgtgctgaggggcacaaataagctaatgtcctcctgccccagatttctctcacttgttcctatgcatattgttcttgttgctcagttttataaggtgagatattttctgcaccaaatatgtgcactgtaaaataatataactattcttaagattgtctctcagcttagagttttcggaggcttaatggtgaagaacttaaaaatctgttttcctatgactgacatctgtttgtgattatccatttagcagacggtgatccctccaggctggcctttgtttacaagctatgcctaagaggcagctgttggtggagggggaacaaaaacaaaaaacccaaaactattatcttaataacttatagaggtaatcattattgaacaaaagcatgatttggggactatggaaaggcttattctttccatataaaatgatcagcgaaaaggtagaaaaattaaacagaactgaaataattgctattgattgctcaccgcctggatgcactgagtagaagagcaaaggcaatgggttcatgtggaggggatggaggtggagaggctaagcctgagtgagattaccaactaatcaggacttttaacccaaaaatactatggctctgaggggcagggaatgagagacctaaattgacaaaatgcagagtaaaaatattcagtgtgagcagtaatgagacagttgtatcagggtcaaatacggagttggcctggatgtcctccaagctcctttccaagcctaagattctgtgagtggatgaacaatcctggtcctgctgctcttgccactggaacctgatctatttgccttcattatttgaggtctccccatcatcaggctctttgttgtctgctgcttcagggtgtcttctccccagatttctcctgttggtgagcttttccattgaactggagctcctcacaggcaagaagcacacctttaaggttctctgagtcccaagttcctagtgcagtacctggcaatacacataggtgcttagtgggtgcttgccgaattgttgaatggatttatttgatgaaatgtcaggagaatcaccagaaatgaaatgttcgtgtaatggacagggggaagtttgaggttgatttgaaaaaggagatggtagagacagtattatgggtcatgcttcagagtttatttgctttacaatacattggacagcaaccagtagattgttgtgtgtcattttaattccacatgctaatgtccaaatatgtcatatgtcttaattgttgcatacgtgggttactctgtaaaggggcaactgtagtatcacctcctcatgccacaccctgctccactgtagctgggctcgataaccttcaaatcaactcacagaattccaggacagacaagagcatctgaaaggttatctagccccagtcacctctgatgccttccagctgtctctaacacacctgtgggctgacttccagttcttagtcttcacggctccctatgatgaactgcccctgctttgagggattttcctccattgcctcagaagtactgccctgggggagcttctgatgctcttctgaccaccttgtctctgcctttttcactagtcctctgttcctgctctccaaattttgggacgttcctgagttcagatcttttctttataatctttcttttatattctccccatcagatggttcattcattcctcaatattaactaacatttccatattagaaataacttccttatctttagccctaaattttgtcccaaactctggacctacaattttttggaatgcttatgccttgcccagactaaaaccaaacttactgtcttccctctaaaatcagctccccatcttctatttctccctgccacccttcctcccccatggctccaatattgtcttgccagtctggtcttaaaaccacagtcaatcttgttgcttttctctttgtctcttgtgcatggctgatcagcagtcaattgttttgtcaattgtcttatatgtttcttcttcctcttccttgcttcctttttctgacctgaagttagggccttgttaccaaacatctagatgaatacagtgaccccctaattgagaggctgtctaccaattccacccaccctcaattctatactcaaaaaaaaaattagatgtaatctttttcagatactcctttggtattgtcacttagtttttgagtgactgccactatttcccgattggcagctctgcctggcattaagctcttgacattctcaacctaagtgtccagccaagttactctgttcattgtcccctcaacacgcctgtgcatttgcacctctgagactgcttctgagtcagctatgcactgccctttagaatagcttcaaccccaaatcctaccagtgcttcaaaggcccagttcaaatcctacccctctgggaagtctcccttcctttagtcaacttctagggcttttgcaattttatcacttgttttacatcagttttactatttttcatgtgtgagagttttaaccttccaattatggtacaatgtctttaagggcaagggccctttcttagaggaaaccctctatgaattctccaatgataaattattctatgaattctcacaactttctaatataaaggcttataaaaagtgggaactcactgtttattgcttaaaaaattgagatttaatttgaacttaaatgctctattaaattgagtagaatagcatcttaaggctactggtagtctatctatgccacagatggtttagagatcaaataattactcatatacctatgacagcagagtactggctgtaagatccccccaaaactcaaatacctattgggtttgtcaggcaacaaaaataagtgaatccagctaggtctaatacaatggaaaatggtaggacctggggcaaactctgcataacttgcccaaaggcattcaaattcagattatgttcagacattgctaattacaattagtgtcttagacacttggcttcaaaacagtggttagttcaggtatttcagatcaattgggtatgcatttatctaggtcttcatggatagccgggctctactagacactgggagagggaagaggcaaatgggataagactggcagtatttaacaaagaatgaagtattttacaaacatgatcctttaggctggttattgttacacaaaggaatgatttgctaggattcttgagatacttccatagaatgtctatgcctcacttattgcacagaccagagaattccataaaagcactggctgtgtcttatttacccttgtatactagagcttggcacatagtaaataccaagtaaatgttttgaataaaagaaagagataattaaagcttcagcaccacaattatttgtatttcatctatcagtttggaaatagatctccacagacagtagaaatggcaagaaactaggcctatagcaaccaagaagtgaaactgctagaacctaccatcatttctgatcctcttgcaaattttgcttgaaaaaaatttcctcattttctgtttacgaacttatcctcagaatttacagatgtttccttgatttctctggaaagatacaacttcctaatgcaattgagtaaattgatacttcttatgtagaaataagcagaataagctgggcaaggtagcccacaactatagtcccagctacttgggaggctggggcaggaggatcacttgaagccagagtttgcttgaggccaggaattcgaggctgcagtgctctatgatcacacctgtgaatagccactacactccaggctaggcaatgagtgagacctagtctctaaagaaaaaaaaaaaaaaaaaaaaaagacaaaataagatcaaaattgagtatgaactgataaatacaaggtagacaagaaatatcctgagaggcgcaatcgttctgcagacatttgcttgggaagctcaggggaggatttatgaaggaggtagccctgagtgagtcttaaaaaatgggtagacttttaccaggcaagatcttagtgaagttagtgagaggagtggtcatataggaattcatgggatttttagaccaaagattaccaccctcataagtgataatgacgatgaatgtgaagaatgtttaccacttgcaaagtatttttcacataccttgtccaagttcccacaagcatttctgttcactacctgtggtttggtcaagagacccagatattagagaacgtgttgatttctagtttctaactccgcccaataacattaagatgaaaatggatagccacataggaacagacatcaataaacatatttagaaaacacaagtgaattttaaaaggggagacttaagaggtggcatggttgtttgaacatgttcgtttttgtctcctggagaaaagtcagcacaatgctcattcagctacataagtgtttctgttacagctctttcagtccaccattcggcaggtcctgaattcttgtcccttgtccagaaaaaatgaggtatgtggacaactggagggtgagcaaggcggagaggagcttcgttgagtgacagaacagctttcaggagacccaaagtgggtagcacttttccataggcaggaaatgagtgttcaactctcagcagagaggagacccacaatggatagctccttaccacaggcaggtcatcccagagaggtgaggagacacaagccaggcacagtggctcacgcctgtaatcccagcactttgggaggccgaggcgggtggatcacgaggtcagagttcgagaccagcttggccaagatggtgaaactccatctctactaaaaatatgaaaaattagccaggtgcagttgtgcacgcctgttgtcccagttactcaggaggctgaggcaggagaatcacttgaacccgggaggcggaggatgcagtgagccaagatcacaccactgcactccagcctgggtgagagagcaagactccatctcaaaaaaaaaaaaaaaaaaaaaaaaaaagaaaagaaagaaagaaagaggagatctgaagtgagcaactgcttcccctagctggtagtcccaatgtctgttcaagtctggctgagtccagggttttgtgtttgtttgttttgtttttttgagacggagtctcactctgtcaccagggctggagtgcagtggcgcaatctcggctcactgcaacctctgcctcccgggttcaagcgattctcctgcttcagcctcccgagtagctggtattacagacacccaccactacatccagctaattttttgtatttttagtagagacggggtttcgccatgttggccaggctggtctcaaactcctgacctcgtgattttcctgcctcggcctcccaagtgctgggattacaggcatgagccactgagcccggtcgagtccagggtttttacaggctcagaagggaggaagagtgtgctgattggcccatgggcagccatggaagggcccagaaaaagcactgtaagttcttaccccaggctgtggactccacccacaattggcaacctggctcccaggctttgggccatccctggcttgaaggttgggtttcaccagggacctaacccctttccgccaaggaacctgtctccctcttgccatcaacatgctgtccatgatgcccaggctgttcgtgccgaggggtgcctgcaggcctgccctgagccaccctcagcccctgctcagcctccctctgtgcttgtcagcacccaacatctggaagaggtcgaggcagcagggggctagtgtgtcagtaccatcctgagcacccacatgcctggccgggttgtgacagcacctaggcttggccacaactttgcttcacccagtagcaggtgccaggagtgggaagaggccagggagtgggagcaggcactttcaaccttgtgggagcaggggacttcctgggcccctgagagtacagagatgcctgggtccagagccactgctgggcagctacaggggtgcctgggagcatgcggttcccaccccgccaactcagtacggggcgggactcccacctgttcttggcctccctggccacacctccactgctgcagctgctctaaacgggcagctgctgccatcactgtgagctatgattgtgccactgactccagcctgggcaacagaaagagacctatatggtatgttaaatggtaatgactgctttgggggagaaaagatgactaaggattgttgggaatgctggggtagggttggagtgctcttgcaattttacataagacagtctcaggagaaaaaacaatgaaagtgtccgggtagagggacatgtacactggcagcaaggtcttcccttagggattggatctgcggaagaggccacacaggcctggaagcaggcttaaggccattcaggctaggaattccagtgtttcaaagacagactgcaatggatggcggttggtaggtcaaaagctccagataacatctctcagccctgcgaacaccttactctcggggagaaggatgggcacagtgggtcctttaaagcatggggtccaggacaggggcctcttgtcttggctgttgaaaaaactgggttttacactgagtgaaatgctgagccatcggaaggttttaagaaaatatggtttgacttttattttttaaaaaccactctggctgcagaatcaactgcaggaaggcaaaactggaatcatagcatccagttgtcagactaatgcagaaatcaccatgagaaatgacaatgactctgaccgatatggaagcagtggaggtggtgagaaatggtcagattctggatatatttgaaggaagggccaatagggttggttaatgaatcagatgtagagtgagaaaagaaaggactcaagatgactccaaggttcttgtccttcacctcaataagtggaggatggagcagaggaaggcaagactagaaggtaaaaatagcagtgagaaggctctgctatggtataagaagaaatgataagaagctgaattaaggtgatggcagtggggtggaagaaaggagagccaccatgcaaaaagtatccaggagggagaattaacaggactaggggatgggccatatttgcaagatgagaaatgcagaggtctaagattctagcttaaggtgggtgttgctactattagcataataggaaaacaaggcacaaagacttttcaaaatttgtccaaggtgttagaggcttacaatttgtaaaaccaggattaaacccagatgtgtctgattttagagcctgagctcttactcattgcataaaccatattttccccagaggaggattagtaggaaaggaagctgctggttggaaagtatctttatagcagtgtctgttcctcggtttgctcaaggggacagtgtgccaggaaagtccccgtggaagggcaaggaagaaggggaagttaaagccagtggcaggtgatccaagaatcttttctgttgctagagctatgttacatgctgtcctttcatgctctaaaaataagagtgctggcaagtgccaggcctgttggtgcagcttaagatgatacctttcttggatatatatgcatctgaataaggaaggctatcttctggtcaagctaaggtatgccatgagcatttccctgtggaaagcacttaattctgttcccagttgttacctgctgtaagatctccctttctaaaataaaaacaagaatacagctcactgaggaccttacatttccctctagctactgactcatttctcttctcctttttatagcactcttcttgagagagttgcctatatttgttgccacatctttacccattctcttttgaacctattcaagctttcatctgtacaaaactcactgatactgtgcttgtcaggatcatccatgacctccatactgctaaatgcaactctcaagagtatttggctctactgatcactcctttgtagcactgtgttttaaaatataggttttattattatttaggtatggtgaggccaatatatcaggaaatgactgtcgttgaaaaaagtatgttgtactcacagatcccaagagaaggggggcacaccatgccacaaagggccacatggggaagcaccagggtcagccaggaggtgggtggggggtgcgcaagatctttattgtggtttcaacaggaagaaatgggtgaagcagggtgagtggatttaggattagctgatataaataatttcagcaggctctggggcataggggctgtccctagtcttctggtacttggccctggggtgattaaggcagttgcatagtgttgggaatgtgaaagcccccaataaatgaggcagttgtgggtatgggctctgaaatgggttggtttgcatttgaaaggtgtgctcatgggcaagtggtttactctctcttagaggttagaattggctaaccctgggagcggcagtcccttcagggtcagcaaggccccaggtgtcaaagcatcagaatacagaaaataaaatgcatggataatacacactgccatttgcctttgtacccttcctttcaatcttctctgctggtgaccgctcttcacaaagatctataaatgttggaataccccatgtctcagtccttgggcactctctttcctatctctctgtaggtgatgtaatgcagatatccatgactttaaatctttaacacttctgcattgatgactcctaaatttacatctctaccccaactgcctactaaacacctccacttggctatctaataggcatttcaaaccaaatctacaacaaacgtaactctttttccccttccttaatttgcttctcccccagccttctccattttaataaacagcatctccattgccttagtgactcaagccccaaacttaggaattttcccagatttccctctttttctcaaactatatatctagcctgtcagcagttcccttcaggtcttttttcaaactatagaaggcctaaacaaaggaaagacatgctgtattcatgaattggaagactaaatattattcagctggctgtattccccaaattgatctatggattcaatgcaatccctaccaaaattccagcttcctttgtctgcagaaatgagcaagttgaccctaaaattcatttgaaaatgtaaggaagcccgaatagccccctaaaaaaaaatcttgaaaaagactaacaaagttggaggactcacactttccagtttcaaaacttactacaaagctacagtaatcaacgctgtgtggtactgacataggatagacatatagttcaataaaacagaatcgagagtccagaaatacatccttatatatatgatcaattgatgttttgcaagggtgccaagacagttcaatagggaaagaataatttcctcaacaaattgtacaggcacaactgaatgcccacaatcagtagaacaaatttggaactaaagttcttatatttaggttcttgatccattttgtttaatttttgtatatggtatgaggtaaggctccaaatttgttcttttgcatgtggacatccagttgtccctgtacaattgctccatttatatttatcttagcagaaaatacagatgtaaatctttgtgaccttgactaggcaatggtttcttaggtattacacctaaagcacaaacaataaaagaaaaaagtagataaattggatttttttacttaaaatcaatttgtgtttcaaaattaaataaaatcaaaattaaattaaaacatttatccttcacaggattctataaagaaactgaaaagacaatgtgcagaatgggaaaaaatatttccaaatcatatatttgataaatagtttggcaattcctcaaaaagttaaatatagagttaccatttaattcagcaattctactcctacatatgtacccaagataattaaaagtatacatagacaaagacttgtatatgagttttcataggaactttattcataatagccaacaagcagaaacaatccaaatgaccatcaactgatgaatgggtaagcaaaatgtggtatatcatacaatggaatattatttagtcacaaaaaggaacgcagtgctgatatatgctacaatacagatgaaccttgacaacattatgttcggtgaaaaaagccagccacaaaagtccacatattgcttgattccatttttatgaaatatccagaataagcaattgatagagacagaaactagattagtggttgccaagggccatagggaaagggaaggggaaataggaagtttctgctaatgggtaaggggttccttttcagggtaatgaaaatgttctaaaattggataatagtgtttgttgcacaactccgtgaacatactaaaaaccacagagtcgtgcacttaaaaaaagtttgtgttttaaatatatatacacacttagacacatataaccctctttcgtatatcaattatactttaataaagctgttgaaatttttaaaataaaattttaaaacaaagaaaaaatatataaactcgccaacagaccacttctcacccctactagcccctctactctaagctatcagcatttctgcaaacacattcctaaccgatctcactgcttgtaatcttgccagcaacctctccctctcagcaatagtctattgcctacaccaaagcttagttgtctcttaatgatgtaaatgaggttctatcattctcctgacccaaaccctccactgcttttcatcacactcagagcagctctgctgttgcctgatttagatgtatggctccaacagatttcccctgaagaaatgattccatggctgataaaagttggaaagcctcctcagtttcagaccattatcagattagctgtgtgctctgtccctttcctcaaccataagaagtccatggataaagaaagcttcagagtaaaggagaaagcatgggaggtacagcaggaccaaggtggggcattcgcagcccccaccctcatcagagccagttccctactctccctgtctaaacctcttagtaagaggtagttcaagagaggggcaaactcaattccagcactcaaaagcacttgactactttgctcagtcaactagcaagtatttattgagaatgtagctctgttctatggagtcttattttcaagtgtcagactcccagacatccagtccaggtaaagaagatggtgtccattattcatttgacaaacaaagttggggttcaagggccagctattgaaaaaagctatggaaagcttcatgagacgtgcaggtaactgccaatatgtgtggttcacaaggactggttcatattcagaaacggccattagaaaaggaagaagaacttctcatttggatttataaagagtgtcttgtttactcttaatttatatcttctcttctccaggaaatcaacctataacttctcctcccagctccactctaccatggtctgtcaccttccccaaatgatttgttattcccctgttttcaaaagtgaacaaagaaccaaagacccagcaaagtttcacaaggccctgagactttcaattgtctatttcagatcaaatacagaacatgatcttcctcctgctaatgttgagcctggaattgcagcttcaccagatagcaggtaagaaaggacaaagggagaggcttaagaaagaagagcaggtggtggttcctagccaaagccaaaaatgagaatgtggccctcaggctgagggctttctttgagaggacgtatgatttctgggctattccaagcaccacaaaaaaaaaaagagtccccatggtggcttatacatgccaatgtccctatctgacagaaacggtgactgagaatattgctccatctattcccactatccagtgagggtaatgacaagaagacaggatcactcagaccatgtaaatctaaactgatacaagagggcaggggttgagttcccttaaaggtgagatgccaagcagctgtccccttcctttctggcagggagagtaaggagacaatggccagggaacaccgttactctaaagataatgtcttgaagacattctgcatattattagttgtttctgtgagtttcttttttgaaaagcaacaatagcagccgttggtcattcataccttaatgtggtttactgagtcttcctaaaacccaaatgaacaatgaaccttaaggctatccctttggacttgaagaaaggacttctattggaggatgagggtgagcagaaagaaaagcagtttcacagttggttgttctcctggggaaggtagttcagaccattcgagggtgtagttagaaccatgagtgcactattttggatgaacaccaggagctaagagagtaacatagaggtgtggacagaggattaagtcctcaagacaatagccccagccccatgggaaatcatctttctgctcatgattgagaaataatggctcccttggcacttgataacctttcgaagagctttctcctccctactagctggttccagatcactcttcacccagtcacattcctctcactcacttgagctgcccagcctggtctggcactagagacatgcacttggggccctcctcaaaggaagaccctgagatattctgcttacttctactctgctcctgcctgcagggccagctaaaggaacttttcatgttttctttgcaaggaaccctgcctggctggcattttagagacaagcaaaaggggcaataacttccttgctacaaaacagcttcaagtttccatagagtgataagggaaatgagggccaaaagacactgttccccatcctgtggcaggactgggggcttcaggagaaaacttggggaatgtgtaacctctgtgggtttgtagcttaaaaacactgagatcctgggttttctgtctttgttttttgccttttctcttaggaaaggagtgagctagggtgacaaggggcaacattttttatccctcattggctctttctacagaggaaggatcttttcttctaagataatcagcacaagacaatgaagataggcactagctcccagttaggtatactaatggggcaaaaggaagagcatttacatttattgaagattcactaaatgccagatactgtgctaggcaatttacatatggtatagttcatttaatcttcacaatgatcattttgcaggtgagggaactagaactcagaaaaggtacttaatttccccaagattacatagttattaggtgacaccggcaagatttcaacaaagctaatgtcctttctactttactgtgctaccatgatgatggtaatcaaaaatggcagacaacccataaatcttccaactttggaataggtttttgcactgaagtctgaatatggatacgtattgaatgtttattctggatattcacagaatcaaaaaatatgtgtaatgaattatgttgctgaattaactgaaaggaaagtaaaaatgtagcgctttctcattttcttcacgaatttggaattcttttctgctttccactatgcagataacatcagttcagacaaatattaaatacctacctaaattagaatgccttctcctcatgggatttttttaaaatcttgtcatttcatgtctctttaattaaagagttttgatttcagaggagggtacctgcaaaagaaaacaacaaaaaaactaaaggatctgagaaataattagtgtttacttctggggaggggaggaggtctgggatgggggtaaaaaggatagtcttatctattatgtatattcaggtttttgttttttacaagaagcatgtattaggtattatttgtataataaaatataattttaaaaatacaagaaatttctcatataaaaatatgaaagtaatcagactgcaacactcagtgcctgagacagagctacagctatcagggtgtccagacagacagaagattacattttcttccttgctccttgtacagccccagacctgcatgcttcattgaaaagaaaagaagatacctgaattaaatcaatgtgatgcttagtaccctatcagtgcacatttcttttctatttttaaattttaaaaataacacttggccaggcgcagtggctcacgcctataatcccagccctatgggaggccgaggcgggtggatcacctcaggtcaggagttcgagaccagcctggccaacatggtgaaacccctctgtactaaaaatagaaaaatattagccgggcatggtggtggccacctataatccaagctactcagctgaggcagaaaaattgcttgaacccaggaggcagaggttgcagtgagctaagatcatgtcactgtattccagcctgggtgacagagtgagattccatttaaaaaaaaaaaaaaagaaaaaaaaacacttatggcggtattctcagtcattacaaataaataaaaacaatccatatgccctggagaatttgattccaggagtaggtctagaagaacttcaactggagaatggatagagaaatcatggtatatttgcagaatatatattatatatataatagatagcatgtgaataaattaattacaaaaacatatgactacatctattattatatagcatgtagataaattacaaaaacatgtaactacatctatgaatcttagagcataatattgagtaaaaaataaataaataaaaattaaggccagaagataacacatagcacaatgtccttttcataaataaatatattgcttaagcataccttatatatagaagataaagcttaaaaagtaaagaagaggccgggcatggtggctcacgcctgtaatcccagcactttgggaggccaaggtgggcagatcacgaggtcaggagaccgagaccagcctggcccgcatggtgaaacctcgtctctacaaaaaatacaaaaattagctgggcatggtggcacaagcctgtaatcccagctactcgggagtctgaggcaggagaatcgcttgaaccagggagtcggaggtggcggtgagccaagatcacgccactgcactctagcctgggcgacagagtgagactccgtctcaaaaaaaaaaaaaaaaagtaaggaagagactgataagcccgatattcaggacgccagttacctctggtgcaggcagacatacatcattagtaatgtgctagttcttagggtaggtggtaggttcacagatgttcattttacttaattaaatatattttgaaaatttatttaaagctttctgttgtaaaatatatcacagagaaaaccacatgaaacaactataaagcttaacattactataaggtgattacttttgtaaccaccacccaggttaagaagaactttgtcagctccccagaaatgcttcacataccctagcccaataaaacctcctttgcaaatactcttcatagcactatctgatatgccctttatttttaccttttttaaattaaaacaaaactttttagagacagggtcttcctctgtcatccatgctggagtgcagtggcccaaccacagctcactgcagcctccaactcccaggctcaagtgagtctcctgcctcaatctcctgagtagctaggactacaggcatgtaccacccggtctggctaattttttaaacatttttagtgatggggtcttgctatgttacacaggctggcctcaaacgcctcgtctcaagcaatcctcctgccccagcctcccaaagcactgagatcacaggtgtgagccatcactctcagcctgccctttattttttcatgaaagaaattgctgaagaggactaaaagaagttttagtaagcattcaataaatgtatgttctttatagtttccaaatcagcaaatatagacatcctgcatttttaaggagatttatatattttattggacatgctgtaatttatttaaccacttccctgttggtagacattatttccattttcttctgctagattaatgcttgaaaaaaatgtgtgcctcctaaagactgtgatgaaagttgcctctgaataaaactcaaacaaatcattaatcattaactctttccttacttgtatgctctttggatgctctactgtgttatctataaaataaagtttgaagtgaaaaattagggtaaaacattttatatcatttttaaaggatatatacatggatgtacttacatatgcatgtttaaatttatataccataacatttattctttttttaaaaaagtcttatgaattttaacaaatgcatagtcctataactaccaccaccacagtgaacatccaggacagttccatcccttgccaaacaaacaaacaaacaaaaagcttcacccaagtcttaagtccaggcacttactgatctattttctgtccttatagtaatgacttttccagaatgtcatataaatgggatcattcattagatatccttttgtatctggcttctttcacttaacataaagcatttgaaattcattcatattgttgtgtgaatcaataatttatacctgtttgctgttgagtatattctagtgtatgtatactatattttgtttataaattccccaattggggcacatttgggtatttcccattttgggtgattacaaataaagttattataaatatttgcatataggtttttttgggcaaacctaggttttcatttcacttggataaatacctagaagtgggattgctaggtcacatggtaagtgtatggtttattgtgagaaactgccaaacctttccatagtggctgtaccattttttcattcccaccagcaagtatatgagagttctaattgttcctcatccttcccagcactggtattcttttctattttttctttttttttgagacagagtttcgctctgtcacccaggctaaagtgcaatgccgtgatcttggcttactgcaacctccgcctcccgggttcaggctattctcctgcctcagcctcccaagtagctgggattacaggcacccaccaccatgcccttcttttgttttgtatttttaatagagacggggttttgccatattgaccaggctggtcttgaactcctgacctcaggtgatccacccaccttggcctcccaaaatgctgggattacaggcatgagccaccacgccctgctcttttcttaagtcattctaataggtgtgtagaagtggttctaacttgcattttcctaatgactaatgatattaagtatacatatatttatatattattttataatcttatatataatatacatattttatatattatatatatattttatatatatatacacacacacacacatatttttttctttttttgagacagggtatcactctgttgcccagattggaatacagtggtataatcatagctcactgcagcctcgatctctcaggctcaagcgattctcccacctcagactctgtagtaactgggactacaggccatgccaccatgcctggctaattttttttttttaattttgtagacatggggtctccttgtgtttcccaggccagtctcaaactcctggactcaagccatcttctcgcctcagcctcccaaaatgctgggattacaggcataagccactgcacctggccttagttaagtttttatgtacttattgtatatcttcattggtgacattcaaatcatttcatcctttgtaattgtatactaaggaattaaacgattgtttaattattgtttattttcttattgtaaggttttaaaaattctctatttttttgagacgcagtctccatcagtcgcccaggctggagttcactgtcgtggctcactacagcctctgcctcccaagtttaagcgattctccagcctcagcctcttgactggctggaattacaggcatgtaccaccatgcttggcttatgtttgtattttcagtagagtcggggtttcactatgttggccaggctgtctcaagcttctgacctcaagtggcccacccaccttggcctcccaaagtgctgggattacaggtgtgagccactgccacgaccttaagagttctttattctagatacaagttctttatcagatattgattttcaaatattcttttgaagtctgtagcttgtcttttcattttcttaactgtgtcttttgcagagcaaagattttaattttgatgaagtttgatttatcaatgttttcttttatggatcatgcttttggtatcatatccaaaaactctttacataacccaagatgtaaaagattgtcttctatattttcttctacacattttgtagttgtatattctatatgtaaggtttataatccattttaatttttatataaggtgtgatgtataggttaagctcattttagttttacatgtagatgttcagttgttccagccccatttgttaaaaaacacccatcctttccccattcaatagcctttgaatcttcatcaaaatcaattagtcatatttatgtgggtctatttctggactttttgttccattaacttatgtgtatatccttttgcaaatatcacacttatatttgttttttttcttacatttttatttcaaaatctaaggacatcttataacccagaaatattttttataccttgtcatgtcttagaggaaagagccaccccagtcttttttcattgatgtttttcttctctcttcgtactccagaggtagatgaaaaccagagggccacaatgaccatggtgatgcctgaggtcattctggggcacagacctcagcctaggttactccacttcgcctatctttagatccaaaactaccctgctgactgctgagataaacaaaggagaataatcaggttggggaaaggatttctatgcgaagacatgtctccatgcagtcctcctacactgagcagagcatgagtcaggtgcttagagcaggattttgtcctaaaccaggaacttcagagttttctgaagaatgtggctatgtaaagcacccccccaccccacccttacttctcaagtacattacgtggcaagtctgaaaaaacttacacttctgttgttaaatgtgggggataaaatataaacttagtttcaagaggaagctatcttgggaggtaatgcaaataattcgttgtgtgtttcctgaataagtgacaggtgctgactaccattgatgcttcattgcaataaaatgcaaagctcccccaagaatttttgaaatgcatcaagctaggtgttctaatctagcaaaaggacctgcatacatgaatttttcatgcttttgccaagtcttttgccctttagtttagttaagggccccacatgaatggaaagcctgtgttgtcagcttaattttgtagttgtggaaaccttccagttttctcctttgtctaataccttcaggagttcaatcctaggttgaagcttaatttaataaccatgtggcatgtaaagtagaaaacaaaacatcttttccttagcatacagcaaaaaaaaaaaaaaaactcactcatggatgtagtgtacacatgccagtggatatatagtcataactgcagtcattggtagcacagaaataaatgtgcattgaagacacagagatgaatttgaattccggttccatgagctaccattctttgaccttgggcaagttgcatcacttctttgagcctcagtttccccatctgtaaaatgtggatagcaacatctacctcgcagagttgctgggaggatcagatgaaatgatgggctagcccagtgtctgacttactgtgtttaagaaatatcaactattacgctacttcccagtgacagtccaaatgcagaccagtgttataactctacttctcaaacattaatgtgcatgcaaatcaccgtgaccttcttaaaatgcagatcctgattccctaggtctggggaaggcttgaaattctacatttctacctagcttccaggtgaagttgaggacaacactttgaaggcaaggtggtaaaagacgcttgcacgtgcaaatgttactttgtgtaactaatggttcgcaatactgtctgcactttagaagctcccaggaaaagaaaatctttaatgatgctgacctcatctccaaaataatgtaattttaacagatccaaagtagtgcctgggcattagtgtgttttaaaagcctcccaggtgattccaatgttagccaagattgaggccctctgcttagtgaatctaatttgcagctgggcttgagaaaaaacctcttcatagaattgtttgcatcagtgtcttgattgcctctgtaacttacaataagcaagaatgtttcaggatttcaaaaatctattgcattgcctaaacctcttattttgtatggagtaatcaagctcaaagtttgcatgtcttagaaactttacttggggcaaaattagaccaagtaacaattaatcttctaggtattctgagctattcagacatatgattcatgtttgctaattgctcttttctcttgtaaatattagctgaaaaatgtcacctgtctgacaagtagcatattttatgcctatcactcctggcacgcattcttacaaggcagacaggaaaaataggaagaaaatggacttttatcaaaggcccaggcagtaaagaggggagttctgctgtaagctaaggggagttccagaggaagttataggcgttccctttcttatgacaagaaagcatagtgcagtaaataaatttgctaaatagattcaacagtctctacccaaagtcatctatttaattcttgttgttatgcagactcagcaactaaccttccttgtaagccccattttcttccctgtttcctgtttatcaaatgtaattaaacaagagaagtattatagaagagtaaaagtagtaggtaattcttgaacttggcatatgattactacatatttgatgaatagttgaatattattcttcaaggacagattggatttggtatcaggtggctctgcattaagttataagggacttaataactcaagtatttaaggacggcttccatcataaagggatctgcccttaagagggtcccattatggagattctgaggtgagagctattccaagtgtgcagtggattaaaataaaagaatcatacaggaaatctctttttacatgccttattccagggtctttgcaacctggcacagcaagtgcagatatgattagcattgttttacacatgtacactcaccttatagccctgcccctgtgcccctcctgcacaaaagaatgctgggcacacgtgaactcctctctgtagaaaggcacattaatgttctagccatggttaaaacagggatagaggcaagccaaaaatgtcggtcatttgaaataaatctcaagtttgtgcatatcactatcaagtgtgctgtgtggcaattaagaatgccaatttgtgtgatcacaggcaagttgcagtttgatgaaaggaaagcagaggtgaatatataaccagggtcatcctttctttctccctctctctctttctgtcatttatttgccaagctcttaactagaacttgctatgtgctaggtactggatatatcaaagcaaactcagcctggtctttgccttcaaagatttgcaggatagtgggaagaaaaacttgaatcagaggacatctgcagtgggaatcattcaagcagcagaaaacccaaaagttacttatactgtgaaatctgatcagagaatggactgtcctggttagtaaaatatcctggaggataaagattggccatgcattccacatatgaattaccactttcccaagaattaaaacatggtacgaaagaaaggaacgaacatttgctgagtgcctactgcctgccagatctaggcacttcacatgtaacacctcgtccagcctccaccacaatactgagaggtagagttcaacctcattttatagataaagaggctgaagctcataaagattaaaggacggactcacagtcaaaggactcctaatcctgagtcagcatttgaacccaggctcacctgtcactatatcctatgctcttccgtatcacattttatactgaaacaacttctggaatagctaatgcttagaagcagctcccaaatatttgttgaatgaatgatttgattgaatgaatgaataaatgaatgaagcaagctctactgaacataatttgatctaatcttctgtgattattcagaaactacttcaagattttcctatacctccatcataatgaatacccattcattaatgatggaagcagcctaattttgtcatttttcacactttattgatgtaacactacctttactagtttggccactccttatgctttttttatagaactatttagatcaattcaacttttaaaaaataaagccacatacccctgtggtagatgaaaaacaagtatcatttgcactggtaaatagagaataggaagaaaaataaatgcagtgaaaataaagcagtgttatcaaatcctacccagatactgttatctacccggaagcttcctgtttgattaaaaggaaaaatagccagtgttagaggtgtggaagtctagttgaaattatatgcaattgaaggattaaaatagaattgaaaagggaataaattcctctctgaataatttaactccctttaggctttgattctgcctcatctaaaatcatcttacatacttctagtggcgtgtccctcacattttggtaaactctgagtggaaactacggattttgtagtcaaacatctgactggctctggattttaactttactaacatatgtcctgaagtgaactgcttggagccagtttcctcaactatataaccataatgacaaaacaggtttcacggtcatgttttcagtattaaacaatatagttaaaagtacctagcacagtgcctggcatagaacatactagatatacattaagtatcagttccatttttcctttccctttattgtcagaaaatagaaagcatctacagtgggcttgtatgatgtggtggttagaaatacctgatctgattctggctgtgcaatcttgggcaagttacttaacctttttgtgcctcatttttgttttctgaaaaaaaggatagaatattattacctaccttgctggcttctgggaagaagctcagtgagacgatgtgttagcagagtgtctgacaattgtaagaattcaacaagtaatagttattattaccatcactggtgagaggaagtgatacctggcacaaaaatatatggattaatcaatatggattgagggaaacaaacctggagaataggatgtgaaggtatttaagtaacatgagctcagaccttgatggtagggaagtcgaaaggaagcattttgttcttatatgacagatgacctggaatgactgcagggcttggggggtcagggactggaggtgggagaggcctctgagagcaagcagtgctgtccaccagaagctcttgctggggtgcccagagaggagcaaagggcagtcagctgcacaggagggaatgtttggaggagagagccacctcagatcagcgggtcaagaatcccactcttgcccagatggatggggcaaaggagaaaaaggattcgccacgggaatgtccagataagacaggtgccttttggaaaatgggggtgagatgggtctcaggttacacttcgtaagaactggaatgtaaagtaaaggcagacaatgacaaaatatcttgttttcttttcagctttattcacagtgacagtccctaaggaactgtacataatagagcatggcagcaatgtgaccctggaatgcaactttgacactggaagtcatgtgaaccttggagcaataacagccagtttgcaaaaggtggaaaatgatacatccccacaccgtgaaagagccactttgctggaggagcagctgcccctagggaaggcctcgttccacatacctcaagtccaagtgagggacgaaggacagtaccaatgcataatcatctatggggtcgcctgggactacaagtacctgactctgaaagtcaaaggtgagtggtgtcaaggactagaatccatggaagcatctctccaacagaggatctgcaagtcacagaaacccattaaaggtagctcaagcaaaaacaagcaggctgcttttaaggagacagctatttcagagaaaatgaaagcatctgctcggaaataatttttgacatctgagtacaaagcagccgaagtacaagtgaaagggggtaggacctataggaataaaatgggactggaggaagccaggaaaattagtccctgaaatgtgggagggtatgaaaaataagctttgcctaattcacaattctcccatggaacatccctgacttgattattaagatactctttttcaatagtttataccctgaatccagagtttttaaaaccatggtttgccgcccattcatggattaaaatatcaatttagtgagtagcaaccagatgcacgtttcccgccctttaaaaaataatgtatagaagagaatagacagagtagatcagacgacatcacagagtaggactgagtactgtaaaactaatttctgagggacgtgtgtgtgtgtgtgcgtgttgggtcatggtataaattttttttttcttactttggatcataaaaagttacaagtttggaaaacactgctcaaatgcaagccctatttattgcagatgaagtagctgagatccagagaagggaagtgggtagcccaagagagtcccatgaagtctatagctgtccctattcctctggattcagggatctctccactccagcacaattgaaaatctaaatataaagagaatcttcacactcttgtttgttctagaaaaggtgatttgaggaaagacatataacaactataaaaaatagattttgcttgttcattggcttatggtctccaggcttgaatgctctgagataaatgatgccaatatttctctggcctcttcccctcccacgcattggacctcagatggtctgtactgtcttctagagggtttgtgggttttggccccaaaaaaccattaaccttggcagaaagtgtgtgactttatgatctggtacaaagaaggacaaactagagggactggacatgaggatgaatattgtgttcgcccttatccttgggcaggttattttgcctttcataacctcacattttgcttatttgtagaagacgaacaatagtagtaccaaacacacaggattgttgtcaacattgagagagataatgaacataaagaactgagcatggtacccggcatataataagtgtccagagacttggttaaaagaccctcagttgttacaggggcagtgacctcctcacacctcaaccatcaatgagtcaccaggaaagccattagcctagatgtaactgttttctatctttattgcatttcctacatccaggcagcagctgggaggaactctagaacactgaagtttgtctgagttcccttaatgtaaggctgtacattctcaggatgccttgatgtactcgaatatctgcaaccctaaatcaccacctctgtttttattgatctctatctgaatgctgtattaatgggccaggccttctgcccattctctcaaactgagaactgtctctcattcctggggaggcaccctgcctactccttacctagatcagggatttctcagttgtggagagatttgttccttatagtgttggtcatcaaactgggatatttggggattacaaagacttttcaagggatgtatgggcacaggcagttttaggaagtgagttcctagatcctcatcttccccaaatactcgttcccaaaattgacgagcctgacaatgtgcatgccaggcaaggctcttggggttcccctaaaacacttcctcttttaagcctaccactcactcatcatgaatatagtccattgtcccagggtgtaaaaccctctatagtgttaaataaaagaatgattgggaacattgacacctgatggaactgttatgactaaaaacccttttgcaaataatgtggtatctaattttctgctttcaacaaaattgaaggaggcccttataaagttaataactgataatcaaaaatgagtaatttttgccatgtaaatcaggtcaaagaatgaaatggcattgctgtaacgaaactgcttccattcccattgatttactcatacgaacaagattccttagcctttataagctacaaaaaaatgaaaaatagaaatagaattgaggctgaattctattatataaaatcattccaaccatgtcatatggttcttcggattcatgaataatttggaaaagagagccatatccatcttattaagggacacattcccaataaattttcatctttcatgtttaataattatcaatattcataacattttacattttgatcaaatatgtgttaataataatagaaataaatgtccaacaacgatagactggattaagaaaatgtggcacgtatacaccatagaatactatgcagccataaaaaatgatgagttcatgtccttcgtagggacatggatgaagctggaaaccatcattctcagcaaactatcccaaggacaaaaaaccaaacaccgcatgttctcactcataggtgggaattgaacaatgagaacacatggacacagggaggggaacatcacacactggggactgttgtgtggtcgggggaggggagagggatagcattaggagatatacctaatgtttaatgacaagttaatgggtgcagcacaccaatatggcacatgtatacatatgtaacaaacctgcacgttgtgcacatgtaccctaaaacttactgttaaaaaaaaaaattagatcttaatgcagaacaccctgaacatttaaagcttcatagtcacaagagaaaagttttcatttcaatagctataaatattttgttgttgtaaagacatataacgataatcaatacaaaatctgtcaaacaaaaatatgttacattaagataaaattctgtagggaaggtgaaattggaagtgagtttcaatgaatgaaaagaaacaatttagacagagaagaattttttcatttaataatttatttatttttacttagaaggaattgaatagattaggttccttacccaaaaagcctctgttatttgtcttatttatttattctcttttttccacattctccagtctcattccccttttttaacacaggaaattattccagcatgtttcatacatattcttttgtttgtaagagcttatttaaaatatgtaatattgttttagatgcatatattttttttcttgtggaaactatattgtactatatatatatattttagaaatggacacattaggccgggcgcggtggctcacgaccgtaatcccagcactttgggaggccaaggcgggtggatcatgaggtcaggagatcgagaccatcctggctaacatggtgaaaccctgtctctactaaaaaatacaacaaaaattagccgggcgcggtggcgggcgcctgtagtcccagctactggggaggctgaggcaggagaatggcgttaagccgggaggcggagcttgtagtgagccgagatcgctccactgcactccagcctgggcgacagagcgagactctgtctcaaaaaaagaaaaaaaaaaaaaagaaattgacacattaagtttattgtgaaaacatgattacaagcaataacagatataacagcagaaaaaattgtgaagttatgtgcaccttcttttgagatcatttttttgggtatatgtgaatgtattttatctttttttaattgacaataattgtacttatttatgggatacatagtgatgtttcaatatatacaatgtatagtgatcagatcggggtaattagcatatttatcatctcaaatatttattatttctttgtgttgagaacattcaatgtaccccttctggctatttgaagctatatactgttgttaaatatttatatgtatttttcaaggataatgttgtatataaaagataacttcttttatatttagtcacctttggatacatatgtaagagtaaaataattgttttactaaaaaaattcataagatgctgaacattatatgtttttccagtatagaaacttatgaaaaattataagaatcaacttaataggtgagaagagcatactgcatcatacttattttaggaggaatacaagcaaaaaaaaagttggaccatcacctaagagtaggctaccctgatccagggtctctaaaagaagcaagatagatctgaggccccaatgagggttcccatgaatgaagtaggactagaagaaggacatgtttttatcttaaagtgcctgatccatggcataaagcttgaaaatgggtttgtttatagcaccttcgttgatgtctgggcagaaattcttatcaaatataatgaaaagagttaatttcaaaaggacagaacaaattatgaggtggaatgaccggagattctggaagagacagtgataaaggactgtggtttctgaaaagccaggtggcacctacatttctgggggcaatccatctgaggaaggggcgggagcatggccaaagaacagagaggccccaggagcccaggggtctctcagaggagctggggttgagaactggtctgtgcaaaggtttccagacagggttgcagaggaggcactaaaaacaagaacaccaagagccaaaccatcctgaaggcctgggcagggcagggggatgggaagagccaacaccaggaatgggctgaagctgacagaagtacttcaaaccagaaacaatgaatttaaactatgccctaccacaaatagacttaacagatatttacagaacattctacccaacaatcgcagaatatacattctattcatcagcatatggaacattctccaagatagactatatagtaggccacaaaacaagtctccataaatttaagaaaatcaaaattatatcaagtactctcttagatcacagtggagtaaaactggaaataaactccaaaaggaaccttcaaaaccatgcaattacatggaagttaaataatgagtgatcattgggtgaacaatgaaatcaagatagaaatttaaaaactctttgaactgaacgataatagtgacacaacctatcaaaactctgggatacagcaaaagcagtgctaagagaaacattcatagcattaaatgcctacatcaaaaagtctgaaagagcacaaataggcaatctaaggtcacacctcctggagctggagaaacaagaacaatccaaacccaaacccagcagaagaaaagaaattacaaagatcagggcagaactaaatgaaattgaaacaaaaaaaatacaaaagagaaatgaaacaaaaatctggttatttgaaaagataaataaaattgataaccaagaaaagaagagagaagatccaaataatctcaattagaaatgaaatggagatattactactcatatcacagaaatacaaaagattattcaaggccactatgaacacctttacacgtacaaactagaaaagctagaggagatggatacattcctggaaatatacaacccttcgattaaaccagaaagatataggaactataaacagatcaataacaagcagcaagattgaatggtaacttttaaaattgtcaacaaaaaaaaatccaggaccagacagattcatagctgaattctatcagacattcaaagaagaattggtaccaattctattgacactattccatgggatagagaaagagggaatcctccctaaatcattctatgaagccagtagcaccctaatacaaaaaccagggaaggacataacaaaaaaagaaaactacaggccagtatccctgatgaacatagatgtaaaaatcctcaacaaaatactagctaaccaaatccaacagcatatcaaaaagataatccaccatgatcaagtgggttttacaccagggatgcagggatggtttaacatccacaagttaataaatgtgatacaccacacaaacagaattaaaaacaaaaatcacatgatcatctcaatagattcagaaaaagcatttgacaaaatctaacatcctttatgattaaaaccctcagcaaaattagcacagaaggaacatatcttaaggtaataaaagctaactacgacaaacccacagccaacattatgctgaatggggaaaagttgaaagcattttccctgagaattggaacaagacaagacactttcaccacttttattcagcatagtactggaagtcctggccagagcactcaaagagaaagaaataaagggcatccaaattggtaaagaggaagtcaaactgttgctgtttgctgatgatatgatcatatacctagaaaaccctaaggattcatcttgaaagctcctagaactggtaaacaaattcagcaaagtttcaggatacaaaattaatgtacacaaatcagtagctctgctatacaccaacatcaaccaatagctgcaaaaataaaataaaatacttaggaatatacctaacgaaggacatgaaagacctctacaaggaaaactacaaatcactactgaaagaaatcacagatgacacaaacaaatggaaacacatcccatgttcatgaataggtacaatcaatattgtgaaaatgaccatactttgtagattgcaaaagcaatctacaaagtcaatgcaatccccatcaaaatactaccatcattcttcacaaaagtagaaaaagaaatcctaaaattcatatggaaccaaaaaagagcccacatagccaaagcaaggaagactaagcaaaaagaacaaacctggaggcatcacattgcctaacttcaaaccatactataacaccatagtcaccaaaacagcataatactagtataaaaataggcacatagaccaatggaacaaaacggagaacctaggaataaagccaaatacttatagccaactgatctttgacaaagcaaacaaaaacataaagtggggaaagtacatcctattcaacaaacggtgctgggataattggctagccacatggagaagaataaactggatcctcatatcttaccttataaaaaatcaactcaagatggatcaaagacttaaatctaagacctgaaaccataacgattctagaagataacatcgaaaaagcccttctagacattagcttaggcaaagacttcgtgaccaagaacccaaaagcaaatgcaacaaagacaaaggtaaatagataaatagggacttaattaaactaaaaagcttctgcacagcaaaagaaataatcagcagagttaacagacaacccacagagtgggagaaaatcttcacaatctatacatctgacaaaggactaatatccagaatctacaaggtatgcaaataaatcagcaagaaaaaaacaaacgatcccatcaaaaaatgggctaaggacatgaatagacaattctcacaaggagatacacaaatgaccaacgagcatatggaaaaatgctcaacatcactaattctcagggaaatgcaaatcaaaaccacactgcgataccaccttactcctgcaagaatggccataacaaaaaaataatagatgttggcatggatgtggtgaaaagaaacactcttacactgttggtgggaatgtaaactagtacaaccactatggaaaacagtgtggagattcctttaaaaactaaaagtagatctaccatttgatccagcaatcccactactaggtatttacccaaaggaaaagaagtcattatacaaaaaaaagatacttgcacacgcatttttatagcagcacaatttgcaattgcaaatatatggaaccagcccaaatgcccatcaatcagtgagtggataaagaaaatgtggtatatatattatacatacatatatatatgcatattatatatatacaccatggaatactacttagctatgaaaaggaatgaaatcatagcatttgcagcatcctggatggaattagagactattattctaagtgaagtaactcaggaatgtaaaaccaaacattgtatgctctcactcataagtgcgagctaagctatgaggatggaaaggcataagaatgatacaatggactttcaggacttaggggaaaggatggttgggggtgagagataaaaaactccacatttgggccaggcgtggttgctcacacctgtaatcccagcactttgggaggccgaggtgggcagatcacgaggtcaggagatcaagatcatcctggctaacacggtgaaaccccgtctctactaaaaatacaaaaaattagccgggcgtggtggcaggcacctgcagtcgcagctactcgggaggctgaggcaggagaatggcaggaacctgggaggcggattttgcaatgagcagaggtcgcaccactgcactccagcctgggcgacagagcgagactccgtctcaaaaaaaaaaaaaaaaaaaaaatggccttcaccctaagaaggaagaaaccaagggcagaggaaggaaacaatcaaagagaagcaaggcagcagtgaaaagacaactgtacgtttaagcctctaaggcccaaggaaagcatttgctaaaagagccaagtctcagtgtctttttttcccttggggaaacagaagggtgtaagaaaatcggagtcaagaaaatgtcctgagctccgcctgcagtagcgggaagcctaggagtaaaataacacgttttttaaaaataaagaaagaaattattttaaaaaagaaaacaatgtcctgaatttcaatggggtgggggggaggggaagctcctggggattacaaactcgttaacctgctattccttttcaggcaatttaacagatgaattgaaagcagtcctaaaagatttaactgattactagaaacttgcatagatcctctaagaccaaggcatgtaaaactacatttttccatttatttactgtcattatgactataaaacagatactaccatgtatacatttcatctttatttcagaaattacagcattgcttgtaacatatctgtcagacagccagaacaaaccagggaaacagaaaccatttaaacctgtggaaatctaaagctgaaactagtaattcttttaatgagggagactgagaagccaaacagagaacagggaagcaattcagaaattagcaatagcagaaagctgctcctaccactaggctatagtgaaaagggggaaggcagggttaatggagcccagggattaaagtcacttgacagacactggaacccagtgggcctgtccattggtatctggagccagggaagagatacatcttctgctggagaggccacaaaagtatagagcataggggagaaataccttcccttctccctccagtccaccctctagtgttcctgtcttgcttcctattggctgtcacgttcctaggctatacaggccacaggagtctgccttcctgcaacacagagcagagaagaaaaagtgagagatggatctgaaggcaaacagacccaggacacacaaagcacacacaccttgtgtattgggtggtaaaaggtgggataataatacagttgactagatctataacagactgaaaagctagtagttgttgagtcagggacaacgaaggctggctgatggcctcagtcaacttggagacaatctccaagtgctaaggggtctgttattcaggttgtaaggatatagccaacctaactgagcagcagatcatatatttagcaaaactgatcttatgaccttaggttacattaaaaccctggatatttgtgctgcttagataatatctagaatatagattgtgttacatatcctttttaaagaacgtggcaaaactaaactataaccaaagactactatctggaaatgggtctgaagactgtatcttgtgagatatagttaaaggaggtaggcatgttttacttagggttgaaaagactagatggagtcttcccagttatattcaaatatcagaagggttacctgcaataattgctaacactaattgagtgtttactacgttctagacatctaactaattatttaacacccttgttaaggataagtattgctgtatccatttcctaaacaagaaaactgagggtttaagaggtcatataactagcccttggctaaagcctactcaaactgctcagattctgaactcatgtttttaactacggtgcttaccatatgttgtgttactaaactagacaaataccaatgggtagaagctacaaagaggcacaattttgcttggcatgaagaaaatctttccaatggaagtttaacttgcttattgtataatcatggcaaagactgcttctagaggaagtaggagtttccattcatagatgttttcaggcaaaagttatttagcagtttactaatatcagaagaaaaatattactaaagataacaagggacacttcataatgataaaagagtgagttctaaaggaacacataacaatcctaaatgtgtgtccatttaacagtatagcttcaaaatattaaacaacaattggcagacttaggagaaccagtcaaatccacaattacatttgagatttcaactcatctctattacaactgatagaacaaacaattaagaaaatagaaaatctgaacaacacaattagccatcttgacctaatagacatatgatatatagaacatacacccagcaactacagaacacacattgttttcaagcgtatgtggaacaatcatcaaagcaattatctaggagaattgctgtagaaggtgtttttcattgagcaataagtcagatgacttgaatttttggagtacttccgcctcttaaattctaaaatttactcatcttttcctaagaatatcaccctcagtccagcttccccactgtgggaagcgattccttttccaccaccttccaaataagaaagaggctgtggagacatttctgatactgcaaaaatgtaggatgtgggctcctgtcccttccccaaaccttgctgattcttgtagtggaagagctctctctctgtctccctatctgctccctcatgtatcccaagtcaaagcctcagccaagctcccaattcctggcatccctacttctgaaatcacttctcaaccaggacaccaagatcagtttcttggtccaagccacctgcaatagtgggctggaccctcacccacagtactctgctcctgttcttgttctacttcattccccaaaagacttgagagcttacagaaataatctacagtatgatcatataaaatgattacaaaagacattgaaccaagggaaaataagtgtagataaataatacaaaatgagagataaagtgagtactcgaaatacacacttcgggtactgtttgattatgaaagataggccaaagttttggcttcaaggagattggtgagtctaacaggtcaagtccttcagtaggctgcttcagtgtctgaattgccttatcttctactactgctgggtgctcctaagaacctcagagcatattcctctatctgcttatgttgcaccatccctagacatctgcaattacacagagacacatcctcttatggtgattccaattaagaatgcattacaaaatagtaatatgaattttacccacctcatagggtctgcatatcatttaaatgacataatgtattatatgtattatgtatatttatacattagggggaaagatgtcagagctttttgggacataccaggaggcccagctgggtgtgctgaccacatggagacgagaacttcaagggagagccaaagtgcacgcaggttctggtggatgtttcattgtgcagtgaccctgctctctagtgaacccagatctagtgggtgttgtttgctataatgaatcaaattgtcaactcttaacattgagacccacaacacaggaggggaacagaggggcaaaaattgtgaagaacggcatgaacattccttctcttccataggatgtaaaaggacgtggcacaaagctcaacacatagaaaacaataagtaaatcatacacatcagatggttttcacatggttgttaccattattttaatgtgaaattgtttttcacaaagtttgtacctatttatacttccaacaatttaggagaaaaaagttgtatcacacctctgcctttacttcaagactacacttacttcaaaaattgtattgaaatttaatttcttaaaagaatatttcctaccgaatggaagccagtgctcatcccctcttcctctcaccaaatatcaacaggtgactttccacactgcctggtaactgcatatggtattgatatttgtttatttttagctattatctaagaccactggaaggtttgttcttgtgtcttctagtctcttggaatatcatgcctattttacttatttttaaagtttttataaggttgtaatgttttattttaattttaaaatttatttttaactggcaataatgtatatttatggggtacaatatgatgttttgatctatgtatagattatagaaagagtcaatcaagccgggcacagtggctcatgcctgtaatcccagcactttgggaggccaaggcaggtggatcacctgaggtcaggagttcaaaaccaggctgaccaacatggtgaaaccccatctctactgaaaatagaaaaaattagccaggcatggtggcaggtgcctgcaatcccagctactcaggaagctgaggcaggagaattgcttgaacctgggaggtggaggttgcagtgagccgagatcacgctgttgcactccagcctgggtgacgagcgaaactctgtctcaaaaaaaaaaaaaaaaaaaaagaataaatcaaactagttaacatatcacatcaccaagttgtttttttgtggtctttatttttttctcttcttaatctcaaaacagagaatgtaaaaaattcatgcttttagcaaatttgaatacagaatgcattaactgtggtcatcacacatggcaatagatcactaaaacatttcctctactctgagactgagcaacatcttccacatccccagcctctgataaccacctttctactctgtttctatgggatctacttttttagatttcacaaataaatgagatcatacattatctgtctttttgtgcctggcttacttaacttagcataatacccttcagttccatccatgttgtcatgaatgacagattttacttctttctaagggctgtaagtattccattgtgtatatataccacattttctttattcattctctgttgatggacatttagtttggttccacatcttggttattgtgaatcatgctgaaatgaataaaggaatacagatatctcttcaacatactaaattcaattcctttggatatatacccagaagtaggactgctggatcatgtggtcattctatttttagttttttgaggacctctatactattttccaaaatgactatacttagatctcagctttcttgaggcagggagccatatctgtttaattcactcagcatatactgcaaagaagcaggtgtgtgtatgaactgtgtgtgtttgtgtgtatgtatctgcatgtgttagggagaagtgcagaataaatatacccaactctttactatgtatagacattatctaggtctttattttttttctcttcttaatctcaaagaaaacagaggaaaggaggaagtaaaaagtaaatttttgcctgaagatgtttggaaaaaataccaaataaagtgagatagtgggtaatctagtgatttttatttttccgtcctctttctggcctccaattgtgaaataatttatagcactgtaagaaagaagccacaaattgtggtagcttggaccactgttgaggtctggaatcagaattccaatgttcaaatattggtcctaccagttataagctctatgactatgaacaaaacactcaacttctctatcttcagtaaccgtccacaagaattgggaatatcaacaatgccatctttattgcattgtaagaattaaataattcaatatatgtggaaaatagcatgatatcagggatatacaatgtgtttacaaatgataaccattattacttaatattgatagtgataattttattcatttcacatggcatgaagtaccaagctctataggaatcagaaaataaagtcttatttctttttcttctctattgtccagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgtgagggaacttactttggccagcattgaccttcaaagtaagagctgcccccacttcctaggtctatcagttagggttcagacaagaaacagatggcatactcgagtgatttgaggagagtgtaataaagggactgtttacaaaggtgtgatcaccatttggagaaactacaaaggatagtgcagaacactggggcttcaatgttgggagggcaattaccactgttggagaagttactggaatcagaagggagctgtagggaaagccccacttcccaggagctgtagccacagaatagggaagctgccacatgcagcgactccaaagggtggaaactggatgaatgaataccccaactcattctcctcccaccctccaatctcctgctagcacctcccattggctgaacccagctagaagtcagagaatacaagggtccactgttgtattccataaaagtcaacttctcagggctcagagcaatattgacatgtacagaatagatctggagaggaaacagaaaatatctagtacaatagctaatcactgtgattcatgcacagtgtcatgagccagcaggatgaatattcctttgctgtacttgctgccagtcagctggttatgggtttttccaagaaatttggtctctaacaaaattcttcagagcctttactgactatgctggatatttttggaagggatcccatacttttgaacttcatacagcagaatttcaaacaatcttgggaaaataacaacttttatctgcccagtaaggacaactaacacctagtatcataatcatttcgtaagagacaggtaatttcatcaccgagtgcatatgttttctaatgctcttatatcaaattaccacaagcttcacagtttaagacaacacagatttattatctgatacttatggaggtcagaaagccagacttgagtttcactgggctcaaatcaaggtgtcagcaggattgcagaggccctaagggaagattccactttcctgtcttttccagctgctagaggccacctgcattaattgcctcatggcccctccctctatcttcagaggcagcaaccctatcattcagccttctgcttctgtcaccacatctctctctctctcttttttttttttgagatgaagtcttattctgccccccaggctggaatgcagtggcacgatcccggctcactgcaacccctgcctcccgggttcaagctattctcctgtctcagcctcctgagtagctgggattacaggcacatgccaacatgcctggctaatttttgtatttttagtagagatgggtttcaccatgttggccaggctggtctcaaactcctgacctcaggtgatccgcccgcctcagcctcccaaattgctaggattacaggcgtgagccatcatgatcagccacatctctttccctaactagcttgcttctctttgccacctcttaaggacccttgtgattgcattaggtactccatccccctggttatttggggtgatcttcccatctcaaggtccatcttcaaaattccttttgccatgtaaggtgacatattcacatgttccagggattagaatatggacatctttggggagagccataattttatttatcctactgagaagggatatactctcagactaaaggacagtccctagtactgattcaatctggctttatagaaaattcactatattgtcattgtatttcacagtttgccctttgtcttagctggtaagacagagcctatgataaggacttgtgtggcatgcaggtatttaattggcaaccccagagggcagaagcaagagatttaggagtttaagagagggtaatataagagtatattatcaaagttgtagtgtggacaacagaaactcaaatattcaaggaccagcatgtagacagcctcctaagatgtctactcagacaaagaatttcaggtggaaggacttgttcatctgcttcacgcccattggttgacaggaatatgaactccattctgctgctgggctagacatgcatgtgggctgagtgagctttccccagtatccgtagcatcagaaaagtcgcagggcagaaagaaaagtatccaatttgaggtgaattactgaccttgaagtgagtgtaagcctaactagaattctaccccagctggctgaagtgaaaggtgaggctgagaggaaataaggcaggactgcacagtccccaattgtactgttcaaatccactcatgcccttcattaagtcagctctgccactgagccttccagctgggaggcagccacaatctctgcagaagatttaatatacaccagtttgtggaacaagctgtagttcctgctgctgctgtggatcccaagccacagttgatatttgttgtctcactcatccaccatacattccagatttccctcacctaacaccccagatggaatggtttctttgcctgatagggtgacccagacttaacgaccctaagagatctgagcttttgatcagcatgcccttaacagactggggttgttgcaaatatcttttcattatcactggatatggaagtaaaaagaaccagtgaatcagcggacccctgagttccagacatactcttccttgtctccattatgtagcagtgttcaagattttcatgataatcaagattgatttctccaccagtatggtaatttttttctttgctcactggtctgccaatattaagagctcaaggtggccaggccagtagcagagctttagatgcagtagaacaagcagagtatcccctgctagaattccccgtaggaagccagacctttgattcagcagagcctaaatgtgtggggttgagtgaacttctatacgtgagtcattagaagtaatggtgagaggggccaacctgcagcactgggatagccctggtacagacgtagaacatgcttgaggaggttgtcaggaggaaatgagttagaccttgcacagaactaccaccatcaagtacagttggggtgaggcagacatggtatgagttgaggcatcagagatatctgatgctttatgccaaattaaaattaattttttcatggagtgacactgatccacagaccagactccaagaactttgcagtgactaaatacccatctcatcataactttcctggtattttcttctggaaaaaattcttccctgatacagttttcagaggcagctagatgcactgtcatctctccccttttcccacttccctacctatccacaatttactacccaatgccaacactaaagttagcccaacttccttctaactaaattattagtttagaaggaaagagaggagtcatgctaaggatcttaactgaaatcaaaacattagaggctgggcatggtggttcttgtctgtaatcccagcactttgggaggccaaggcaggaggatcacttgagcccagtagattgaggttacagtgagctacaattgtgccattgtactccactccagcctgggcaaccgagtgagactctgtctccaaaaaagaaaaggaaaggggagaggaggggagaggaggtagggaggggaaagaaagaaactagaaatccatcaattttaggaccaacttcaggtaaaaaaatgaattaggcaagttggtctttcaacattctctacctctctttatatcatggttgagaccacagacttctcacctcatgaaagatgaactctaactaattcatactaaagctaaagcctctaaagaggattaaatatgagcaatcccacgagaacttttttcccctggaattgtttattcaactgtcgttcgttatatggaatttcctgcctggttaagtgtaggccagtactttggatgaattgtagttttctagaaagacgcttcttatataagaacctctccagggaaacaggggcctgtatgagatgaattgagaaataactttacaccactgattatgtcagtgttctattctgcatggtagagatgtgaaagggcagactgaccattgctctggaagcctttacgctgtgagaagttaacagtggagtaaaatggccactccactctcttcatggaagccaacatggcttactaaatagtcaacaaccatgggagagacctgtggggtcttcatcagagctcaggatctcctagggtatcactcataaatacagccatcagggagatggagaaatctttgtgcagccagaaattctcaacctggttttacccatccttcccaactttgtattcgtcctactgtttactgacatggatcctctgcttcattaaccatcccttcctcaccacatgctctctgaacttggctgcaccttttctacctccatgccttctttgctcaggtttttccacataaatatcattatttccctctctactagctccaagcccaccctctctctggggcagctcagtcactccagggcacaagggggtctttccctcatcccacattttgagacctactacctggaccatttgtttgccttgtaactatgcttgcctttttaattgctattttattttccatgtattttcattgttcacacaagtcttctttattccacactaaggcaaaagcagagtcctgtgttcataataagtgctcaacaaatgttgggttgattgggttggagattccatcttagataatcgcagtcccatcatgccagctaccagactgtgtggacagccaggtcagagcagccaaatgatattctagcttgtggcacaaataccagcaacaaaataaccaaagtcacacatctgcctctgagttcctggcttctatttctcaagggcatttttaagttgtcttatgactgttccctttctactcattctcataaattgagctgtggactgctgtgacccacaagcttctccggaagtcaatgtataaaacaaacacggaaacgaagagtatggtgggtggagggtactccactgactctagaatggatgactgaacattccaaatttcaagcacaagttagggagcaacagatcattttccttttgaaatagggtttcttctgctcagccagttgttgtattttcattaggaaatggaatgggactacagcacaaaaaataaatataaaaggacccttgtagggctggcagaaaagagaatccttcctaggagacctggaggtgattccaggcagtggttgagagcatgggctctgatgtcagacaggcttaaatttcaaactctctctctattagctttgagaacctaaatatcctacttagccactctagcactcagtctctcatgtgtagcatgagggtgagtagtggtagacagtttatagggttatagtgaggattaaatgaaatgtgcttataaagtgcttagtactcagaaagtgtgcaaacagtaaaaaaaaatggtatatctagcaagttgcatgccttacttgtgagttcatgaagttgtggcaaggataagacaaatattttttgccattgcatcattatatcattgctaagagtatgccattattggccaggtgcggtggctcatgcctgtaatcctagcactttgggaggctgagatgggtggattgcttgaggccaggagttcaaaaatcagcctggctaacatggtgaaaccccgtctctactaaaaatacaaaaaattagccaggcatggtggcaggtgcctgtaatcccagctactcaagaggccgaggcaggagaatcacttgaacccaggaggcggaggttgcagtgagccaagatcatgccactgcactccagcctgggcaacaagagggaaactccttctcaaataaataaattaattaattaaattaaagaaacgacaaaagagtatgcaagaattttaaaacaacttagaggaatatgtatgaggatacaggctaagctaccataatgaagagacctcgaaatacagtgagaagcgagacagaagtatctttcgttccatgtaacactcaggtggttcagagcagctaagcagctatgttccatagagtcattcagtgatccagattattttcatctgttgctctgccattctccaggatgttgtccctataaaattgtcaaagctcagtcagtgccaaacccatgtttcaaccttcagaaagtaaacgagtggtggaaaacacattcaatgttttaaggccaagaccttgaaaactcactctcttagcctgaacttagattacatggctgggcccacttaactataggggaggcttggaaacatagtctctgagaagccatgtgtccagctaattccctaatactaaagttgaaagaaagaatggattaaccagcagtataccacaaggtaacaaatgactaggaggatcaggctaggtggactagaaaagagacagtcaattcagtgcaacaattccatattggcacttttcatgtagctgttgcttggctctatctagagaggactcagaggtagtttagataaggcctttgccctccaaatacagtctaagcagactgatttcctactggatgttcaactttggagtcttcagggatgagtagggcttctgtacgtggaagagactatgagggaacctgcacaggacaagggtttgcataaagacactgaggtagggacctctcctgttgtggggacagtgagaggcccaggtctccttgactcacaaagtgcttactaagcacttactagaaattaagaagcagattataatcaatatgggttatccaatgtttggatgagcaaggctccttatcttttcttcgttaatgttaatcacactcttttggatggagacaaatatctgtgggggctgagctttgggtcagatagatctgggtttgcaatcctggcattgacttttacttagcagtgatgacctcacatagattatttagcaactctgagacttacttcctcaactctaaaatgaggggctcagactaaataatgtctaatctcttctccagtaaaacaatccgtggttctcagatagcactgtgctggaggtagtggggtttgagggctgggaagttgggaggactgagcccttcccgctgagcagtttcgtccagtttttcctgtaccagcctgtcatgtttattccatgtgaatgactccagaggcaaaattcaagcttttgaatagggcacaaattaacttgagtaccctttcatttccctgtaggtgaacactcctctagccctgccttttgtcagtctggagcccttgttctaatctgtacacaccagaggactttacaaggctttccccagcctccagaattattcttctgatccaccctctactaaactcaccctttcctcagtgctaggacgttgaaaaaccgaaacaaggcaaagggccaattgtaataattcacactaaggcatgagtgactaggtttagtatattaacactacctaggatattctatttcttccaaaaggatcctgttaatccttgaaatttaacaactaatggtatagattctaagcactgtgagtacttgtcagtgggggaaagacatttttgggctgagagactttgccactgggaagagagagaggatgaggaggagaagggggatagggaggaaaaagagaaaaaagaaagaaagatgattagatgatagatggatggattgatggatggatggaaaaaaataacatgagagagtggtaaaaagcacagaatctggaaccagactgtatcttagctgggtcacttactatgtaacttagggaaagcttcctagtctctctgtgcctccctttcttcaccagtgaaatggggatcatagcagagccaacttcacagagtggttgcgaggagtggatgagctgataggtgcagagcacttagaatagggcctggtgtggagtaaatgctccacagagctagccgtgttggctgtcacccactcatgtggccagcctgttggtctacctcttagttgccatgtaacaggattctggtgcttttcctttgcccaggtcagatggaacccaggacccatccaacttggctgcttcacattttcatccccttctgcatcattgctttcattttcatagccacagtgatagccctaagaaaacaactctgtcaaaagctgtattcttcaaaaggtaagtgagttttattcatggtaacccaatgcactgggtgtctgcagcatgagccactgctttgcactgcaggcctatggcttgctgctttcatgctaaacccactcagagcttatgaaccactttgagcttgtcttgatgattatttttccccagaagaaaatggctctcatcgtcagtgagctgaacttcttacactgagttttttaaagggaatgttttgttcttatgtctgaaagagtttgtcttattctttgagccaagagctttcatcagcctcatgagagtgatgttattttggcaatgcagagagctacgtgctccgattttgctggtgggaggttgccaggatcctttctgaggattccttccattttcacccctcttttccccagtctggatatgacctgggttaaacccaccccctctcccaggaatctcaacctcacggttgggtaaggaaaggagaaaggtttgtgaggccatttggggataaggaaacagctggttggtggtgcattaacgtctttcagcagctcccttcgagtttctccttagcctgttgtattcttaccaacacactcctgttctgttgtaccagctgggacagagcatgctgaagcctttcagccctgatttcattgcttcattgttcatgtgtctgtctttggtttcctgggtggagcctgcccacaaaacccccagaatgtatgcaggcctagctggtgctttcctaaacggctcccttgtctgcactcaatgaacttctccaaagatctatacatggcctcatctatagaaagagaaatgacatgtggaaataattcagtaggagtttgcagcagcactatctgaggactaggggaattttaagtggttgttatcttacatttatactcataacttctatattttcatctgccataaaatattgtcatgttctatttgtccattgccctatgtgtgtatgtattcacttgggtgctgaccacaatatttctaactgtagaatgcaaggaattgttgccaaaagaaaaagacagagggagggaagaagatggccaggggagtgagggagaaagagaaaacaggagatggagaagaagaaagatagaaagaaaaataaatgtgggagggaagggagcttcatggtaaaggaggaggtatgtccaacagaacttcgacttttaaatagaaccacttcagagagttgtgtcaggtgcacctcagttgtcttatcttctgccattcttcttttacctctcacacccatacctcagggttcaaggcctggggcctgaggactccttaataacttcagaaatgagcagctgagtgttccgttccagctgtctttgggagaatggaatggagtcacactcaaagatagagtggaaataaatcctctcctcatccttcaccccaatcttaagagtgagtgaggatatcagtagctccgagctgggaggtaaagctcaagttctaactgtgattaggagacctttcttacaaataagaattaagtgaataaatgtgcaaacaatttcttttatatttttaatgaaccagagagaaatcatggttgcctatataacccttgtctccaactcacttgcattcagatctgctttcttacatgtgtctgccatgcacacaaacttgtgtgccatggaaaagggttgagaactgctggtgatgcagacagagctttaaaccagggtcagagggctaggctgggaccttgtgctgccatttgttggctttctgaccttgtacaaattgcctatcttctttgagatggtctttctatctgtaaaaggggaagcagcaagagaaggaacattttacagcttattggccgaacttcactgccgctagtgtggttcaacttggactacagagaaatcttcctaactggtttccctgtattcactcctgctacctccaacttggtctgttctcactttttgctataataggcttttaaaaatcataaatctaccatgtgtcctctgtccagaccttctccatggcttcttattgctcactggatgaagttccaacgagcccaggatggtttgactcatgtctccagctttaactgcatcaccatcaccttcattgtctaaagctctaaccacacaggattttctagtcctcagaggcatggcagtctttcaattccgagttttctcatacaatattgtctcttcttaaaatattttttcttgttgtccacctgagttggagtcatcttttaaatctcagctaagcttatacttcatcaagtctttcctaattctacctccacgcaccacacccattacattaaatccccttattatatgtttccatagcacctacttcttctttcagtatactcagcacacaatcacatgtctaggatctgttttaatagcttggactaccaattaaattgcatcccttttaattttccaattgattcctcaagtacccacatgcccatcttagcaagaagttcagtgtctccctcttatagcatgtacttctccacctcccacaaactgccagaaagcttacttagcccacagggccagtgctaggcagctaggttagtcctccagagggccctggttttgagcagttgctgtctactccggccatgcagaatctctggtccttccagatgtctccatccactgtgcaaaggtaaccttgctggttccgatccccacacagaccacagtgctacaagattacagttcttatggttccccaacacatgctctgtcattggtcccaaagcaggacccctatgggttgatgaggtaggaggaggtccctgccttagccacagctgcacacagccagcctcttcccttctaggccctcatgttgagcctgggacgccagtcctaacttccttctcttcagttcctcttagggccattggtatcctgaatttcttagtccattgcaaagttaagtaaagaagcagcaggcttggtccctttccttccagatggcttcttagctcctgaacagatttacccacctatacctcagtgactagctctgtgtactaaagtgtattgggagggcagccattattggtccataaaaggtcctgcttaccattttcccctaagaggaaccattcaacagtttggggctcgagggtgacctgctgggctctagagaagaagctggcaacttctgttgcaaaataatgttaaattctgcttcatctgcttgtctttacgtttcaagaatacagtaactgtgtttctctgattcaccaatatatgcccagtgtctaaaaaattacctggcatataataaatgttcaatgaaattttaaacattgaacctactatatgcaggtgagtatgctagatctgctctgtccaatataatagccatctgtggctctttttaagttaaataaaaattcatcagtcacatcttaagtattcacacactgtaagtgctcaatagccatgtacagataattgctcctgtattggacagtacagatatacaacatttccatcattgcagaaagttctactgaaaaccactgtgctagaccctttacaaacttctcatttaatttcacaaaaattgcttgtggcaaggagaagtgtctttatgctggagttaagaaagtgaggctcagaaaagttatatgacttcccaaagtcatacagctgggatttgaatacaggtctgtttgactccaaaacttgtggcctatttgttgcaaaagtgcttaatacaaattggttcagtcaatattattatctttgaacaatggaaggagaaagtaagtttcaatccaaaataattgagtgacttatacattgacttgctgagccaatggcaaagtcaagttagaatccagcagaagtcaccagctacagaatctagatctttagaacatgtcttcagatcttcagaacagtgtttcttaaactctcttgtgaaggaacagttatcatcataggctggtaacagttcacctaccagcaccagcccatgaaccagactctaagtggcacagccctagaagattgagccagaattttacagaggtttaaagaccaaatatgctggtttatggttacctgtggcccacagagaatggcagcactaacctcaggcataaatgaggtacccactgaagccaacattcaagagcaattcctatgggttaaccattgggctcctttcaaatgcaaaccctcatgaaagagactacagtgctgaatagagacctccaaattccaggccaagctcaggatagtcatgagggaattactaaaaacctggtatatagggcaaaagcagaattaggaatggactgatttcaggaacccaggcaatggcaggagttgggcattaaatcctaaaagagaatcagagtgggagggaatatgtgaaatcagaggttaagaaaaaagtgaaaacctattcatgattgcaaagatatgaaaccaacctaagatcccattgacgaataagtggataaagaaaatgtggtatatatacaccatggaatactactcagccatgaaaaagaatgagataatgtgttttgcaacaacttggatggaactggaggtcattattccaagtgaagtaactcaggaatggaaaaccaaataccatatattctcacttgtaagtgggagctaagctatggatatgcaaaggcatacagagtggtataatgggcatgggagactcagaaggagagagtagggagtggcagtgaggaataaaaaagctgcatattgagttcaatgtacactatttgggtgacgggtgcactaaaattcagacttcaccagtatacaattcatccatgtaaccaaaaaccacctgtacccctaaacctattgatataaaaaaaaaattaaaagaaagatgtgaaatcaaggaaacttactggtgagcagcatcccattatgtgaacttgtgcttctgaaccagtaacttgagttactttgagccagtatcagtcacttataccttagtgcaaaattaattgatcagacattctgacctggaccagggaaggcaggcagaagtagcagtcaagactaaagcagaaaagggagagctaattctgcagccagacatttcctggattgaatacccaaattagtccctcagcctttaagtgcctgagggccaggagtagacagaggaatggaaagtgtgagacttctttgttcacactctttgcctaggggccagattttgctttatgcattaccatccgaagtcccaggccacagtgaacatttgggcttcgctatgtggatttatttagatttactttttgtcctgccatattttaatctataagccaaacagttttctcattaatcttattccatttctggaatttttccttttcagacacaacaaaaagacctgtcaccacaacaaagagggaagtgaacagtgctgtgagtaagcatgatttttacttttctttcttactttcttttctctctcagcttgaattttaaagtaaccactgttctattaattcatggaaggcaactgaatagttccagcttatagaatcttcctgtttggtagcatttcagcgaagcctcgttcttagccccagaacaatcatgccatcttttgctcggtctatattcctaagcactcctagatgatactgcactggacctctggtctcacatagttagaaacagagttaaaatcgaacagcaaagagaagatattcaactgcgatgcaattgacaatggatgtttttgcaacaaacaatgattaagaagtacattgttgtgggctctgagtcaagagtaatatgggaaaaacacaagtctcttcatgaggttgacaggtttggagctggaatctgtggaggaggaaggatatgatctaggggtcagaagaagtgggttactaaaatcattaagcctggttggatgaaaagcttagactcaggggaagcagcacatgattgtgggggctggcaagtttgaaatgtgtagggcaggccagcagtctggaaacccaggcaggatttctaccttacagtcttgaggcagaattccatcttttctgggaaacctcagttttttgctcttaaggccctcaactgattgaatgaagccaacctacatcatgggagataatcagctttacttcaagttaactgatagcaaatgataattacatctacaaaatactttcacagcaacatatagactagcatttgactaagcaactgagcaccatagccaagatgacacataaaattaatcatcacaggcaccaagagatgaggggggcagtcttggccatatatttggctgaagtaagtcaatttgtcattcctgcatgagcctttataaacagaagtaagtaaccaactactatttggtcattggagttgtccaagaggccagggttctgtctaatacctgttcatgcatgaacatgccaacctagattgcatgcagactaccagttttgggtttttgtttagttcagcaggatttttctcagctcactgcctctcaaactttcagcaacaaaaggacatctgtgatatcagaatctaccactctaagtatttggatgcaatagcaatgaatatctgagtaaatctaggtggggagtgggggcaccctgtagccaaaatgatttaacaaaatcaaaccaaaattttggaaatgatgccttggtacaatgaagagactacttgaggtaggtttgacttatctaatatcttattttctttaccaatacctaatgaggaatttaaatatttctagatagctttggaaaggtcccttaaagaggcaccagcataccactgccagatctaatccccccaaacactgttttcatcatcatcatgtcatctcttgtctctatagatcatatcaaatccttcccagagtttttcaggccttttgacaactagccacatttcactaagccaactcatctaccactcttcaacaaaacttttcctcaagttgagctgctccaccaacaccactgccatgagctcattcccacttctgtggctttgctcatgttggttatttttttggagtgtcctccctattccttcttacttgtcccaatcccaacttttggcatggtctactttaagatacagtaatgagtaactttattattataacaccaggcttctgttctaagacattagaagtgtgtttagactagctcatttaatcctcacagtagccctctgaagtacttactccctgcttcccattttataggtgaggaagaaaaacatgaagaggttaactaacttgcccaaggtatatagctaataatataagggccaataaattgattcagcaatccaggtgtccaagtccagaatccacacccatacactacactctgcttttttaaaatttaattcaatttttttttagagacagagtcttgctctatcacccaggttggagtgcagtggtatgaccgtggctcactgcagcctcaacttttggactcaagctatcttcccacctcagcctcctgagtagctgggactacaggtgcatgccaccgtacctggattttttatttttattttttgtagaactggggtctcactatgttgcccaggatggtctcaaactcctcggctcaagcaatcctcctgccttggcctcccaaagtgctgggattccaggcgtaagccactgtgcccagcctacatacacaacactctcttgcttaatctgtaagactctctcccccactcatacctttttatttttcctctgcattgtacacacaatctataccactcttaagcacatgattacagcgttattttctggctgcttctatgtgtctatattttaggtccacctggtcaatataataaagtgggatattagtgttaatgcaactatatggtatttgatatttgtctttctgtccgtttatcaatgtttcttatagtttattatataataaatttaaaaggtgtctgattttgaccaaatttgactaaatactaaaaaacaatattaaaataaattttgtttaattttagttgagtctatcaactcaaaaaagaataacgtacaacaataacaagtttcagaacattttttaaattactgattttatgagtataaaaataaaaaataaaaaagtataaagaaaacaaaaataatttagaatccattgcctagaaattgccatggttaagattttaatattgctcaggcccagacagctcagggctttgacattcccacacccattctctgccatcccagttctatctcatcccaaaaccatccattatgaggagagtgtacagctctaggctgcccgggagccatcccgcactctcattttgtgactcggcatcttgggagatggagtcttgggacttagcctggacatgtcccttgcatgtacttcttacaagacttttattcagatgaatattttcccttccaacttaagaagcacagggcttgctggttttgcttcactaaccagcaactgaagcaagacctgacttgtgaaaatgcctaatagagttcagtattagcgctgtttcaccatttcctggatctcttgcctttgtgcacatgatagaattgcacttctctgtgattaatttgtagttaagtgtggtcatgtaactcgctttggtcaattaaatgtaagcataagtgatgcgtgttatttctgggtagaagatgtaagagttggcatatgctttgccatattttctttatccatctggcatggtaaccagtaacattctaggtagtaattgctccatcagtctcagtctctgagtgactaaaattgacagagtcccctgctgaccctcaatgtacatggaacatgaacaagaataagcttttgttttttatattgagattttggagttgtttgttcctacagcattacctagtttactctaatacaacatggaaaaaactggaacctataataaatagaccctacgttgccatttaaacttctagttctgaggaataataatgtggggaaatactttctatataataaaaaaatagaaaattgcaaaataaaaatatacttatgtatcattcatgtcctattaaaaatgttatttatagactcaccatattcccttcctccagaaaaacagaagtaaaaatatgaaaatgcctgtaatcatgtttttggattatggaatcaagtattgctttttacttttatgttttctgaatttttgttgtacttcactacatttttgagtgccctgatgtattactttcaaaaagaagaagaatactttctgaagccatttcaaccatccccactcacctctctagatcccagtaaccaaatacattatataggactcttcatcagtccttatcaagtttaggaagggcgatgctataccttctttaaaggacacctaccaatgtcttagttgcctttcaaagactcctagcacagctaaatgtgatggatatgctctaaggatataagagctgaagtgacttgcataaggtcatatcataacttactgttagaaatggagctagaactcagacccactgagtccttgtctgtgacacactgccctttccatttgtggaagttgttcttgtatctaactttatctgtgctactatttgggcctagccattctccctcttatgcagacaagcagataaacagtaaaactttaggagtggattatgataccatagatatatatcatctatcctttacaaaatagttattacagtcatcaagccttggttagagtttacagaccatgtatcctagctacctcatttcacagattatgacattgggggctaagagatattaagtgacttccttaagtgaaacagtagcagaccaaaagaagtcatgattcccagcatagtgctactcactcatttattcattcattcacccactcacaaacctgtattaagtttctgttatttgcaagaccctgtcagttaggccatgtgggaactagaaggatgaatttatcagtcatccaagattcttacaattaagtattaccgataaggtactcaagaaacagttctcattcacataatttgggttaaaacaaaaagaagccagctttctatatacttttggtccagtctttacgttttttgttttgttttgtttgttttcatgagtatcccgacttccttctaagaacttccacctgagaactgaccacagcgtcagcattccacatgggtgtgtttcctttcccctttcccatttcagtggtttccaatttctttttcttttggcactataaacctttcgcaaaggaaatattagacagaactcctacatgtcaagcaaattaaaatagtggtgaaattagagtggaggacataatcaccctatcatataggctatttgtccatatcatatttgtccctacaaaggcctctaaggcaggggtccccaacctctgggccgcagaccggtaccagtggcctgttaggaactgagccacacagcaggaggtgagcgggagacaagcgggcactactacctgagctctacctcctgtgagatcagcagcagcattagattctcatagaagcgtgaatcctattgtgaactgcacatatgagggatctaggttgtgtgctccttatgaaaatctaatgtctgacgatctgaggtggaacaggttcatcctgaaactatagcctacccccactcccacacccaatccatggaaaaattgtcttccctgaaaccagtccctggtgccaaaaatgttggggaccactgctctaagataccttgtgcttcttggaacatatttggaaaatcatgtagctctcaaattatccctatgtcctgaagcccaccttaccatcaatcctcagaaatacccaacccatgtcaggcaacttcacactttctttcttcaggcagcacagttgtctcagggagggaggagagtgctattagcaagaggagtcactaacagcttcactcacctgtgcccatgaatttttaatggtgtgaaaagtctgtgtattttttatggttctctatggctcatataagagggacaaacaatacatgaaagttcagagatggggacaaatatcactttaagctggggataatcagggaagaagaaagttttcatggagaaggtgacttttgaatcaggaagaaatggaaacagcaaactcttctagatagaggagacactaacaggaaaggcagagaggcaggaaggtgtgggaaagtgcacgtgaccccgttcagagagaaagccaggtgtgagataagggggaaagactgttagggcatgtattgtaaaccactaattccaggcaaaagttagattttacttactaagcaagagtgcttcagttagatcctagcaggaaatggagggtatgcttagaagaggtaactgaggcaagtttaatttataaaggtgtgtgcagcattaagggaaaccagcaagggatactgagcatgccaggatgcaagagcaggcagggaaggtgactattcctaggtctgaaggagaaaggggagggagcagttcccagaaccctagtaaaaatggcaatgagaaaggtccatctggcaggacctatggtctttaacagagggacaaagtcaacccacaacttgtctgggaggttgctgaggaatagataccccaacctctctctcaacccactgcaacactctttttcccctagactgagcccagtcaaagacagagggaggagcccagtgatgcagtctgcaatgtcatcatcctggagcatgaatagagtgcagcagggtgaataatgagtctgcaggaattaatagaaatatctgacacaatagggaactataagaggttttgaataggagaggcccctgaaatgtgctccaatattactgaactatgtgtggcccaaagaatggaagaggaacagctcttgcaataggtctgaggagagaagctgaagacttggactagggcaatggtaaaaactgtggaaagaagttttaaatgaaaagttttaaaccatgcggcttccagctagatgaacttttttaaaaaaattagttcctcactcaaattttggggaggttatatattttctaatcataaaaaatgatttttcttatttgtgggcttttctccccagatctgaacctgtggtcttgggagccagggtgacctgatatgacatctaaagaagcttctggactctgaacaagaattcggtggcctgcagagcttgccatttgcacttttcaaatgcctttggatgacccagcactttaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttcaacgttctttatatattctacttttgggta

SEQ ID NO: 2674 - DNA, 134945 bp, Homo sapiens
  source 1..134945: mol_type = genomic DNA
ggaccattttaggaaaccttttattgcaaatgccattctgcatattgatttttgacagaaagtatcagaaatgcttctttcctgggaaaaggaatataaatgacagcaagacacattttagttgctactaaagaacagcattattttcaatcattttaagtcgctcatttaataagcaaggtataaaacagattaaaggtgggagcctgcaaaagggtaattaaaaaagtgtttcctccccgggaaacagcactgtttggtctgatcaaatgccgaagctgggatctgattctgggtgccgtctctcgctactggagtgctgaccagcaggctgcccatcacgaaaagaggttgcaaggccaggcccccaggtgcgctgggatttctggctggctctacttggggccagagaagggggtaaaggccttgtcacagcctgccatgcatgcttcaatctcttccacagtgcggggcacgcaggtcagcagctctatgccgctgtcagtcaccacgacgtcctcctcgatgcggacctgggtcaagccgacagacacacattatcatagagcagcctcatgtgccaggctagagggccgggcccattccaggcccaccccaccatgggatgggagcagctgacactccctgggagacgggtggcctccgggctccttcatggagccatctgcccatgtcacctgctcaccctgtctttgccaggtggatgggagcccctggagcgggcaggggttttgcaggatctctgtctgttcctactgaggggtgaggctccatcctgtgacagaccacacgaaggggcaggctaagcccacctcaagggaagatgtcactagggcccctgtcttgggactaaggagtctgcagctgcagtggaggtggcagatgttctgggagcaagaatggggcccgtgggcactcaccccgccaaaaccgcgaaagcgctgcaggacctcgcggttaaggaaggaggcgcgggccgggtccgccagggcctcatccaggaggtggtcgatgaagtagatgcccggctccacggtgagcaccatgcctggctgcaggtgccgtgcagtgcgcaggctccgcaggccgggctcgtcgatgcgctccacgccctgtggggaacagaggtgaggggcctgatgagcagctccagggctcaccgtggcctcatcaggagagatgggcatgtgagggccggtgccagtctcgtgggctctcttgaccattggggtcctcagcctagactcgcccctgctgtgctgggccatgggcaccctgataagaccttccaccctgcacatacccctggatcttgagtgtccctggccacactaccctagggcttgcttgagaagccctgtggccacccatgtgcacacacccggggcaagctgcccagacaggcctgtggggctggctgagggttgggctgcccttagccaggccccgctgctggccagaggagtggcagatgccaaaccactgaagccaaaaaagctcttaaggcggctgtgaagccccttggggccacagctttccttccaggcagcccaagtagaaactggccccagaagtcgtggtcccagctcccctaggccgaggcccagattttccgtgtgactgtccagggaggacaggtgccgtcatcagggtgggtctgccagccttagtgcgccagtgcaaatgtgccgtgtgcgcgtggcttggcaggtgtggctcccagaggagagctcggggccttacggcagggccctgggaaatagcccccagccttggagaacgcctgagggacagtggtagagccgctccctgcaggggcccctgtctgcgccccacactgccccagtgcacacccagcctggccttgtccactcacaggcacagctgagggggcctcagcttggctgagggcagcgggtgctctgggaattacaggagagctcctgctcgcctcaggtccccggggcaccatccggccggcggccagggcctctgagccagtgggcacgagtatgctttctggtcaggggatgagcctgccctgcccggctgcactccctccccaggaagcccagctgctggagcgggagctgtcatttctgactgtttgggggccaagaacatcagactccaattagcagttcacgtaaggtaaccagaaacaggctggctcggcctccacgctgggcacggccagagaggctgtgactgattccacggagggcagggacagccacgctgacctggagagagcaggccaggcgggaggcgatgaggagacaccacagcctggctggtgtggccccggccccacaacacttgcctctgggccgctgaccgggagctgaggccggagggcagggatgccccgtggctgaggaaccgtatggagtgacagtccctctgcgcaggtgagaggtgcatgtggaccgagctggggcctgtctcctgcccagaagctgctgggggtcccagggtctctgctccaggaccttcccgtccctgtcatccgaagcctgtgctgggctcccccaccccaccgccgcccatccctctccttcatgctattcctgaagtgtccgtccctgtctccacccacagcaatcgaagccaggggcctgggggaagcaagggcctgccaacgtcaggtttccttccttccagtcacccctccatccccatgggcccaccccggctgctccatggtacacggttgaggggcaggtttgtttccccagagaaacgaactttcctcccctctgaaatcttgaggtccaccactgaagtggggtgggggagattagaagggatccccagcgggcacagggcaaggcctgcctcagcccagtggcgcagctgccccttcagggtgttggctctaggggcctgcccgggggacctgctgagaacagggcgcaggcgccataagagaatgggaagggctgggccgggtggagcgcagagccatgtggggagggcacgagcccctgtggcccaggaagcgcagccttcaggggtggggaggggtcctgccctcaccgcgcccatgctcgcctctgcctgggcacagggcttgacaaggcctcaacttttattgggctccaagcagaggagccccagatgtgtctgcaggcctgaaataaaacaaatgacttttataggaaaagccatattttttccacaatgtttatctgtcagaagaatagactctgagcacaaagaggtgcttactggaaaagatgaaaacagtttgctgccaatttttgctggtggaaaaaaagcgctttggcgactaatgaataacgaacctcagctaacaatgtctggaaggcccagctcttggctccctgcacacaatgggatgaatagacattaggaaattaaaactgattttgtttctccaaatttaactgtttacacttgaggaaaaaaataattgaataataatgcttctcttaagcaattccccccactgcccccaccctgccaaaaaatcattcttagtgctttcaaaacaccctgcagccaagaggctgagccttgtcttggctaactggctggggggccccagggcgtgcacgattgcacaatcagccccctgcattgggcagcccgccaagggcagggatgggagcgccccagccgcccagccgagaggccgtagccacctgcccggttgggcctccccaagcctcacttaccctctgggtggtcctctgagggccggggaaccttgtctggagatggcccccagcctcccttatctgccaacgggccccagaatgcctggggatgaggaggctgcagggtcccaggtgtgcggcccaggggcctgggaggagagggcgaaccagcggcagagcagggctgctccgggtttgtgaggggccagggtgagtcgccagtgggtggggcctcatcaactccccacgccccaggtctgaatgaagccagaggcggcaggacgtgaggggtgccacgtagctccatcacgaagacctgtccttagcaccactgtcctgtggggccccatgcaccgtatcctgactgtgtgccaccttctggacaggtgacacctgggcccagcaggcagacagcaccgcctctatgtccagttctgtggaatgctcacagatgcacccctgtcttggccagggtcccgattcccccctcctcatggcctccgtataccacagggagccatggggcccatccctgccatcccaatacacgcctgctgcctcctagagtcccaccctgccctgggggtcaggctcagcggcagctgatgggcaggccactccgcctgccatgtccacactgacctctgggtagcctcccacgtcgtgcacgtcaatgcccaggaagtggccaagcccgtgaggcataaacacggcccccaggtgagcctggaccatggcgtccacgctgccgctcaggatgcccatgtgggccagctcctccaggtggatgcggtcagccaggcggtgcatgtcaggccaccagacacctgtgggccagagggagctgccgtgagccacagagcccagcagccaacaccgcagggccaggggctgggagatgtgaagccctcacactggctgtggtgggagggcctgaggtggggggtgagggggcaagggtactacatcgggggcccagggggacaaggactagggtggccccccgtgctgggctttcccagcaaaagctctggccctcgggacccttcttgtccctccattctgcctctaggggcaggttcctgtcacctgtagccaagggcccagcctgggtctactctgtagcccatggtgtgtccaccctgaacagcctatgcttctgggcccagggaaacctagccaaatccctgggcaccaggagaaacatgcacgtctccccagtagcagacaccaggagactctgtgggctctggccctgaggctcagacccaaaccctggctcagagctccgatggggttttgctgctgtggtgcagtggggaagcccgaggctgaaaagaggggtccctgcacatcccagaatggggatgaaacacccctggagctgctgcagggagcaaaggtttctggggagaaggtgcggctggcacggccccacgagctggctggcaggggttcggggccccgcctgccaacagcaggggcaccatctccaggggagccagatgtccaactcccggcttcaaatccaactcatctctgccgcatgtttgtggggcaaaggccaccaaagagagaacttcctaagcacagagctttgggggccacacaggctctgtggggctctggagcatggccgctaggaaggaggcccttagagagctctccacgtagagcctcagcagcccacgggtgcgcccgtcccatccccggactctgtggaatcccagcatcagcctctcctcatggtagcttccactgctggacttggcttgagcaccagataaggactcgaggccggtgaggcctcctgccctggccccatgggggctgggtttgggcaggccacgtgctggcagaggccggggccccaggacactctggccaggcacgtggcggggggcccctatcaatgtgcagctcactggctggagagggcgcccagcaagtccctgcggcacctcctggagaggtccagccccaccaggcggagtgaccttggctcccgagggcctccctgccaggcttgccttggcgcagagccagagcctgctctgcatggtcccgatcactgctgtgggaggggccggggagaccctgagctggcgagggctgggctgtgagaagcagggttctgaacctctgtggctggcggagggcagatgatgggctcggctggcgaacagggatgagagtccacactgggacacaggccatcacccccgacacactgggcacaagtccttcatgttgggacccctttaagtgccagagttggccactgtggtgctggggtctcaggcgggctgggggtgcacggctttgggcaggcagtatggctgttgcccgccattcacagcacagcgccccagccacggcagcagcctaagggtggcaggggtggagatgcccagacctgcccccaccccccacacagagcagggatcctcctcagagcccagctccccatcagcccagcctcctaggggctgaggtgggggcggccgtcccggggtctggggtctggcgtgggggaggccgtcccggggtctggggtctggcgtcggggaggccgtcccggggtctggggtctggggtctggcgtgggggagggcccggggtctggggtctggcgtgggggagagcccggggtctggcgtgggggagagcccgggcagacctggggcaactctggctgcagctgccctgtatctggggcagccctgggcacacacacccctggctggcccagcccgcacccctggcttttctgaggggcacaacatcccggaaaaggacacctggataactgcagcccacttggccgctcccccgcctccgtgagcctcagctgccgctggtcaaacagccccacctccgtgagcctcagctgccgctggtcaaacaaacaaacagccacaaggcaggccccggggggttgctctcagagcctctgtgtcacctgggggctggaggcagcaccccggacagtggcattggccaccattcctccatcgcgcatgaccagccagccctggttccacacttgacattcacttgttcctgggggtgtgcgccaagcctgcccagcctctgctgctgctcttctctgagaacccagcccggacaatcctggcccacctcgcccttcctctctgctgctgcatcctccagaggccagaccaccccaaggcacacaggccgttttacctcaggccctttgctatggcctgtgccaggccttgacctgtgatgcctcatccaaggggtctctgcataaaagctgtcccctctcagaggagaccttcctgccttgctgtcccaggcctggtgatttctccttgcacggtccatccagcctgcagccgtcccctggacggatctgctcgtttgcttctcatgtctcactccgagggtgggggtctcccgagggcaccgctgggcctggcataaagtgagtgcccctcaggtctcccaacagcctgcaaagttggcacatggggctgggaggcctcctgtgagtggctcgtgccccaagcccagctcaactgcttcctctcggacgcgcccttctctggtcaccaaaggggagccccgggaagtgcagccagctttccaaccaggctaacttcagcagtgggctacgttcttggcccagcctccgcagagggcgggaatcaggtataaatcatgctctgcggtggcccttcccgggggcaggcccggcgccgcccagatgtgccggcccgggggtccccttggcgccgctggtcttccttgcctgtgcaccctcggggaaggccttgcacacagctctcttggccgggagcagggagtttctgcctgtgtgtggttagggttgtgacagtgattcaacctccagcaacttggccccagcctctggcccggatggtggttacgacacccaccgcctgggcgggggcccctggagtgtgtgagggtcactgtccttgcactaggctggcagggtgggcaccaacttgagggttcccttgctggcctgggcccactctcaggctcctcccaccctggcagcctggagacaccgtcaagctctctagtccaggctggaaggcacccccggcccctagccagcctatacccagatgccacactgagaatcacacagcagaaattgggcaccagctgccctgcgtgccccaacccccagcaagcaccaaacctcattctggctttcccgaagcacccctgcacctgccccacccctcctggagtctgcctggctccctcctccgctgcacaccccttggatgcctgggccatctctttagaacgaacggggcaaacagggccattcccggccccggacgaagcccaggttctcagcttggcctggtctccagcctctccctcacccactcctgggtggggtggctggaccaaggccacgggtcccaagaactggccctccctacctgctgtttccttagctggggccacctcctccaagcccgttttcccagatgtgctcccattcctcctgtgggcctctgtggtgaggctcctcctccaggaagccctctctgattaccccttcctgtactttgagaattcacggaacacacagcacagctgggcctggttatgacctctgggccttgcaagggtggtgcccgtactctgctctgtgcctggcatgctgcggatgcttggtaaacgcctggaaggagaggagccccagcttctctcatggctctcctgcagccagtgttgtgccccatcccccactcctctgtgtactcagaccctagaacgggcagggtggcctctaggttagtgtcccatcatgcgcctcatgaaatggcagggctcagaggaacaagccccgctgctcctgccacccaggccccaggtgtggccagcgtagcccctgagtggtcttctgggtccacttggtctcctcaggcagcacccgctcctgctgggcctagggcccaggccagctccttggagcctcaaagcatccatcacagccccgaggcctcctacccggagtgtgacagccccagggggctcccgggcctgaccgagctacaaaggcagcatcctcagagctgcctccagacaaagagcgcacttcatctgtggaacatggccctcgggatggatgggtgtgagccaggctctaggggtgtaggacagcaggctccggccggggtcccagggcaggccctgagggctggctgagctggcacggggctgaggacctccagctcaccccaccctgcacgggacgtgagtagaagaaccccatctgctgccagaaattctggggacccactcaccctgcgtgagagcagggtgctgtgttggcccaggctgctcctcgagtctcctcccccacaccctggcagagtgccccgaggagtaagaagaggccaaggaactggctcaccattgcggccggcaggaggggtggacatggtgcccacactgaagacagtcctccccgtcctggcacctgccgcagagggtatctatgactggggtggcacatggccgccatgcctatctgcctgagccctgcactccacgccgtctcggaggatgaggactgacaggaagtctagctgctgggcccctgcccctggcgctggctgggaggggagcaaagctggcagaggtgccccctgaccacggggccacaggagacacatgccaggtgggccggggcaggtgctgctgggcccctctcccagccacctggtcatcccgcgcctcagtgcccctctctcgccccgtcaggactgttttggaggtggggacacttcctgccacttctttcccctcctctgacctcacattggcagcacccccgtcactcacaagtggccaggaccctgagggcagggacagagccaggagcgggggaacgaaacacaaaagagctcatgaatcgtgggccaccattgctgttccaggttgataggagctgggcccccagtgacaggggcacaggaggctcctgggtgagcacaggaaagagtagagaaaggcggggaggccagggagggtgggggggtgaggagagagggagctgggtcggggctgggaggcgaggctacaggaggctctggggcttgcaggcggagggcatggggccctcagtgctggggtcctctggagctccagggtggctgcagggactgagcccgcgggacagggacagctgtgctgcttctaggaacagccttcctgctgtggctgtgccaatgcagaccctgactcagggccaccctgccgggctcgcccatccgtcccagcagcgcctccccccattcccctcaccatgcatgcaggggtctgcatggggtgggcagcctgccccaacacaggagccgcgctgagcttggatcccacccaacctcccgtgcatggcactccccgaggtcctgcagctgctgggcctgccctgccacccgcctgtggactcccagccgccagggtagggtctccgtctgagcgagcgcagcctccttcctcgccgactgtgaatgacagtgaggaatgctcccccaccagccctaggatcaggggccaaggcctgcattcctcaaccccccagggtcctgaccattctttcctgcctctcctttgggcttagctatggggtttcctgctttatttactctccctggaaggtcacaggatgcagtcgggcagtctcggtggggtgtttgtcttggcccaggaattgaacccacgaacccagggcatttccgctgggacaaggcagggggctgacctggccacggcctcctcgatgctacgggaggcgacctgccccatccggagggcagctctgtgggcccagggcctgccccacgggccttcactgtgtgtgatccagatggagtccgactctgcccttgggggacaccaatgccacacagctcagtgtgggtggtaggtgtgggggggctgctggggggctgctccattcccttacacagggatcctccagaccccaggctgggtctgggcagcaaagcccagtggtgggtgggagcggggctgggggaggacctgcctcccatggtctgagatgagcctagctggatttggccttgtggccccagacacccctgccaggcctgaggcctgtgcctgccccaagagtcagcatgaaccaggcagcaccacgggatgggagacccagctcaggcctttctcagtgccacatggggcctggggacttgccccgaggtctggccactttctggacagaattggggctgctgagttgggccagggagctggccaggatgccagctgtggagatgccacccaggtcctgcccaggccgcagcaggctttcctgcaggtgaggccagccagggctgggccatccctggtttcagcacaggagactgaggggtaagacaatggctttcccaccgaacaccccccaggccttggcccctatgctgcgtcaatccgccgccctgctccccgtggcctggtgctacctctggcaccctgatgggcccggcactgcctgctgaccaagctgagctcctcagcctgatgcttgggtgtacagggttgctgggcttggtgggcccccgcccctcacaggctgcaaagctctgcttcgccgctgggaggctcagccccttgcagcctggggctctgactttctggacatctggatttcacgactgcccgtggatgtctgacactaccacttgatgtgatggtgacacagttcgcaatgacacagcccaccttggcacagctacagagtgggaggccagccctgtacgtgaagggtgtctgagagactctggcccacctgagaggctgtgcccggcggagggctctccgtggagggtacaggagctgggctcacagatactaggtgaatacaccacaggccacgctcacctgccaaatcctcctgctggatctgaaacactgatcattcattcgagtgactagtggtatttaaaactgagcaagaaattctcatccccagaatgaaggaaggagaaggagtggcgcccctgggcgactgcttcgtggaggctggattggatttgacagctaacgggggatgcttcccatggctgaagagtcagaaagaataagaagggacgcagcaagcaaactgtcccgtcccttcctgcacctcctttatggttttcacaggcgcacgggaattcacgctctcactccctcttccttttacccacaagggcccgctggccataccctctggcgctcttctgtcctcacccacccatctgcctggagacacctgtatattcatactcaggggtggcagctcctttttgtttgttttttgagacagggtctcactccatcacccaggctggagtgcagtggtgtgatcttggctcactgcaacctccgcctcctaggttcaagcgattcgattctcgtgccttggcctcccgagtagctgggattacaggcatgaaccatcacgcccagctaatttgtgtaattttagtagagacagggtttctccatgttgcccatgctggtcttcaactcctgacctcaagtgatccgcccgcctcccaagtgctgggattataagtgtgagccacagagcccggcctgctgctttttaagcaaagcaattccgcagaaaatgctgttttcctcggcagctgctaaaccaggtgagtccgatcagcgctgtcaccccatcacaagcttattgacttttggattttctgtcctgtcttccttttggggcacatctggggtccccctgcttgcactcatgcgtttgtcaagctctgttcctgttggatgcgtgaaggtgtggggctggggcctggcactgcccccagcgtccctccgcggctcctcagcctctggtgggggctctggaggctggactgggcaccatctgcaaaggcctgcccacagtctgcctcctctgaaagcgacggtggctgagggcccctctgaagcacacttgggccggcgatcgaggctgcaactcatcccagcaacgggctgtggggccgcagggactgctcagtcgaccgccgagccatcaagttctgaggccgcattctggaggctccagatctttctttcttcttttttccttgaacactgagggcgcacttggcagctgccagctctctgtgggtccttaacagagggcactccatgtctaactagatgccacggtccagagctggccaggcccgctctgaagtggactctgccttgggagagcaggggtctatccttcgcctgtttggggcttaagtaaggtacctggccagcaggcggcagagctggggctgggctcggggcactctgggtctggggcctgcatcctggactctgaagccttgcgctactgggctatcccctctgcccgcggtaagcccacctggctcctggaggacgcctgagctcccctacacagggggctgccttgggcctgcctgtctctctggaggtctgtatagctgtgggtgagaggcagtgggcgagggtgggggcaagctgggggggctggactatgacctgggcatggccaacacgaggtgatctctgacctcgacccagatggagggactccaggctgcagaaggtggctggggcctgtgtgctgagggcgggccctggccagacgatccagctgtgagtacagggccattgtcctgtgccactgcagccctggccccagcccagacctgattttccacctctgtgaatttgtggcagccccaaatgaccgaattggctggagactgttctgttgcttataaccaaagatgcagaacctgcgtgccttggggggccagctgtgcctgggccggtgtgggcagggaaagcccctctgcgctgcaggctggaccctggcagctgccgaacagatctcagtcagagtcgtgggagccatgtgcctgtagagggccaggcctaggggttggccagcacatggtgatcccataggaacctgcccaggctctggtgaatccaaggattacggcaggggtgctgtgttgaagccctggaaggcttgaagcaagaacatgagaagaccacatccctcaattctctcctctgggcaaaggtgacaagccaggacctcccatcactgctgggaaatggtttctattgttgcagggcagagagctggggttcgatcctgtgggtgctagactccacccctgccagggctatggaggacccaggggtcactcggcaggaggctggctgagcgggatggggacagcgggaggtgcccagggggaactcctgaaagctggccttgttgggaggatgctggctcccctccaggggacctcctctgcctgccctgacagacatcaacggcgcgcggtgggaggtcaagaggtaccagtggggcctgtgcaggctgcctggggttgggagggctgagggcaggacaggttggcctacgctggccgctgggagagagaaacaccaggcccatcctggcctcaacatggccatcatggtggtgactgtgacccctgcagggcactaccacaggccaggcggccttgcaggtgctttacacagcttaactcagtctccatgagtcggctgcttccccatttacagatgtggaaacggccacccagaggagggctttccatccaaggtcacagagcgctgagcggcacgtgaacctgctctgaccccatgccagtgtccagagtgggttgagccctccctggagtagacaccgcttaaggacaaagcaggagacaggctggcgtgctagtggccagtggagatgcgcaggtggaggccagcagaccggggagccttggcctgagccccgcaattcctggttctgtctgtccctgcctggtggtcagccttgtttcctaggagtgaccctggagacctgacgccactggaatctcagggactaagcatctggagtgtggcagattcaagtcacacaatgcagacccgttccctgcaggcacctgccacatagcagcgcccccaacgccacgtcagatgcgcctccccccaccgacccgctgctcacctggcttcatggcacccatgacggcacgggagctccgcagcactgcctcatagacggccttctggtctgcagtgaacttgccgttggcgggaaaggagcaggtgatgtcggaagcgaagcagtaatactcaccgcccatgtcgaacaggctgcggagagaggaaggcagggcaagtgggtactggggtgccaccgcccccttacccttaccgctccccacctgccctggactcgagggcagctggcccgggtcctggatgcaactccccctcacaatgagaccggtgtggggaactgccacctggtgtctcccacgggtgcgtgggcagcaaggaaacccgaagccatcctggaagacctgtgtcttccagggaaaaagggactcagggctcagcccaggcagggaaggctgaggggagtggggctgtcctatgcagatgacacccacccctgtggcctggcctccaagagctcagagccatggagaattgtttggagaactaaggagaggcagagatgccccaggaccccgcccgctgcctggcctccacccggcaccccaacaggctctcccaggtctccctgcacccagcacagagcacaggctgaggccgtgcttgtgggaagcagaggaggagggggctgggcagggaccccggatgggatgcacggcctagaactccgggcctgaatcacaccacctgcttcttccaggacccagagcatctgggcagacactcagtcggcggctagggcctctggctctgctgcagctctggggccccctagctggaggggtgtgcccgacactacccctctgcccatggggatgggacggacatattctgccagggcccaaggggagggcagggaggaagtgccagacagcctcatgtccagcaaggctttcccagggcctgctggccacatgtccccgaagccaggtgggccccctcaccctgtccacctgcaccctggcaccctccggtggcaggcagagaccagcaggacacaggcaggggcgtggagaatggggcagaggtgccagctgtccaggacgggaggggcctgggggccagcagagaggcaggatggcatgggacagatggcgtgggacagacagtgtgggacagatgacaggaggcctgctgaggcaggaggatggtggctggggctgccctctggatgccctgtaagagggacccttggcacagcagggcccggaaggagtagggcctgtccttgctgtgcaaaggacctcagggccctctctgggcaacggcagagaagcagcctcccgctcatcctgtggtgtggaagggacaggatacgggaagggctgctggatccaaacctggctctcaggactccccggaagcagcccaggtggacaaggctgggcctggctgagggggcggaggggcgcaggtggtgcccctttccatccatcccacctaggcacctcgggaggctgcaggcagcagacacagagcggaaccctcgggtccaccagccccttcacaggtcatggccaagtcacgacactgatggtgatgaccctggctggcggaggctggtctagccctaggaccagagcccaccacgtctgcagggtccagaaccagagccaggagggctgaggaagtgcagctgcccctctttggctccaccctgggcttcccatggggtccatctgtagctgggtgagtcctgacaagtctgaggccaggggcacagccgcggcttccgtcacgagggcctctcacccaaatcccagctctcacggtaaacacaaccactccacaaacattccagaagctgcctgtgcgcctgcctgtggggggtcctgtcccatgggagggagccagggggtggaggaccctggcctcatgtggagcaaggagcagggccacgtggctggacaggcagcgtcagccgccccatggaggcagatttctaaaggaaaaacttgaatgcacggccaggacgctttgctgaaatccaaagtccccagccgggcactttttaatctcctgtcttttctgattgcaaaacaccataagcagtgtcaacagggcagaaaggtccagataacacctcaggtgactctcaggctggggggaggagccccgcctgcatgacagggagctttggggtgggtcagagtcacaggatctctggatgcagtgggctgcttaggccaacaactgcctggaagtctactcctgcacagggcctaggcttccccacggctggccgggaaggcggggcacatggaagctctaaactgaagggaaactgaggctcagatcacgggtccaggaaagccctgagtcaggagggtaaacaactcgaagcccagcaatgggttcttaggtcctggcggcagtgctcaaccttcacggcctcagtttttccatctgtaaaatgggaccctcccactgctgtagctctggggagtggagccatatggaacacagcccagttttgcctggggacagctaagcattttcatttaggttccccagagtcaaccaagaaaaatggtttgtggtttgttggttttagaacatgcaagaatagcctgggcagagaggacagggccaggagtatgggggacacggattcctaggaggcgccaaatcagaaggtgacctgcaacagcagccggggcagaaagtcctaccggactgtgctgacacaaaagaaaaagcagaaactgaactatcgtttaaaaaacaacaacaacaacaacaaccaggaagcccacaagaataccccgaacaatgaaatcatctaggaatgtaaaaacaagactgttctccagtgcagaccagactcagatcccagttccccaaactcccgccagcaaagcagaaagaccatgggatggtgggtgcctggatatcatccgccagcctgactttatcttccagcttgtagaagactgtaactgcatttcttgtttgaaaatgatctgctttctggagggggaagtatacacccagccagccagctccatcctgcccagcgaggctcgggtatggagctgaagtctattttcgtgctcctctcagttccctatctttttctgccttaaaaaaatccccctagagtttctacacacataagttattcagatgcaagcttttctggaatccagggacgaaagccatggctttgataaatcatctccctcccgctcctctgcgtccacttcatccatcctctgaatgcaaaccgacaatggagaattcggtcatacgttggctcaatcgagaacaggcacgcaggatccctccttcctggctgtctggggaccctaccatctttggccgagtgagtcgatgataatacaagacatctgggagacaggatgcatctccaaacaacgtgctggcgtctcactccccacatgtgttctgagggctctgtttctggctccttctgggtagctttgggcctgggctacctgccaccactggcccacccagaccctccctgggccccatggcagggacccgccagcccagaggcagaaggcctccaagatgggtcggccagtgacggaaggcttgggaacagttttctgggggaaatgctgcaatgtttatatgagagccactttggacttggtttgcagtttcatttgaatctcctgagtagtggcacggctcttagctgttcaatccaacagtttacacgcgctcatattcggggctgcagaagcactgcagactccgatgtgcagctgccctggtcagtgtcccaggccaggctgggggattgctgagcagcaggaagcacttgcttctcctcagtgtgagaccgaaagggaggcgtatgggtcactcttcccttcatctgccccagtgggcggcccctgcagacacggtggcgagctgtggtctccagggtgcatgggccggctgcctgctcccagccaggccttccgtggagtgccaagctccaagcgtggccagcagggacaaaggccaccactcggagtccctgaggctccccgtgccatggcctaacccaccaaggggacctctctccagtgcgttcctgggcatctctgcccccttttcgtgtgacggccactcctccagggcctcggcagacaggaaagctgcccatgccgccagcccatgacagcagcagcttctggtccccagagccagcaatccctggtgcacgcggtgggtgacgggagcagctgcgtcctgtgggcctcctgggtgtctggagggaactggcattgccattttatgcatgacatggacagaggcacggcaccagtgaggggccccgggtcccagaagagcactgtggggtgcctcgtccagaggtgggtgagacacaaggacagctgccaggaaagcacagtggggtgaggcccgggcgtcagggcagtggccttggcaggcgggagggagagtcacacgcgcagcacatgctgtattttgctttttttggtgaccagtgtctcatgatgtctgggagcacccaggatgtctggacaagtgctgttcaaactgtgggtcatgacatcagctgaggagggtgcagccacgaagcacaaacaagagacaaaccgaaaacgcgtgggcaggtgtctgctcataaccaggcctgtccatgtgtatgaggacgggtgagaatggagagcacgctcctaactgggatgggatgggacggccatgcctgtgggtctggaccctcctgagggcgttctgtggccccaagagcatgtctttaagaccgcagagtgctcagggcagggctggctggtgacaacaagtctccctcggaggaaacagcaaggtggtgggggagagctgggctgggacaggcagcagagagcaggcctgggggcaacgctctaccctggagctcaccaaagcattgggccccaggtggagtggggcaagggggtccccaggagcttgtcacccatggggtccgcagcgcgatggtggcagacagactcaggctgagtagacagcaggagtaggctggccgcatcccaggctgcagggcccatgtgaggccaaggtggctgctgaggtcctgggtgagcgggcaccccatggcctgcagggtcgaggtctcgccattatctagccagggaaggaggggaagagggcactggtggctgctgagtgtgagggctgggacaggtctctcctcctagccaggctggccacccaccccccatgcccaggagcaacacaaaagaccaggcccagcaggggtgaggcctggcccatcgtcctgagacaacactgccctcttctggccagttctggaaggacaggcttgctgcccaccagctgcatcccgactgggacaaccaaggcctggggcatcctgggacacgtgctctagaaactctgcgaggggccacagtagattaaggcccccctccaacccccaccacctgatcgggaagtgagggaggcaggaggagtgtcccagctgctttcccaaccagagccctccacctctgccctgtggggtgagcctctccaggacctggggcggcctcaggcccggagtgctgcaagggatggtccctctctgggcgcactgcttcccagaatcgtggaccatgcgccccctgccctagctgcgaagcttgctggcctgcagtggctctggtgcccacagcccaggctgtttgtggaaggagggggcagcacatgggggctcagaagacgaccaggagaagcagggggatgagtcctggccacctctgtgctcacacaaacctgttcggggctggagtgagtggggaggggtcttctggggcctcccacttaggaatggcctccagtgatctcaggcacctcaatctgtgtgaacatgttgaaagtgttaattagcaagtgtgctgcgcttttgtaaccctgttcttgaaggtctgcctgaggggtttaaaaaggaaaacaaaaaaagcagcgaatggcccctctggtacagtgacttggagatggggttcatggcgaaccccaggatcacagcgggaaaagactctgagaacaacagcaaaacccccggaggcttgacggctacaggccccacatggggccgcttggctctgaaccaggctgagggtgtatgcagccaccacaaagtcccgtccctcacccctgcgtgcatgcgagtgggtgtggtggcatcacacccagagaagcgggaaggggcccgggggtggctggctgggggtgagggacggccctcaggaagtctgtctcagtccttggctgacaagcctgacctgaagcaggaaccagggtgtctggttcataggccctcttggaccatgactgtggccaacagtggactcagcctagctccagggaagctgctggaagggtaaggacggagcagtaggaggggggcctagccagccccaaaccccgcttgatgtacgcatcatggaggacacttttgggtcgaagacacggaacaggacaaccaggggacgggagctgtctgagaataaaccaggcctggcctgagctctgcctgtggctcccacctccagcctgtgctgcagaaccagctgctggaagtgggcatcagggcctggcctgcccagctcggtgaggacaccgggcctgctgctcttgcccgaagagggcccacgctgtgccaggtggccactgcgagagagggaggcaggggcttacactgtgatcattgcaacgcagcacagcctcggtcagttccctgtgtgtgtatccatgtgtgtgcgtgttgggggagtgctcatatctgggactgtggagagagggatggaaaaggctggcctcctcttagtaccccccacccttctgcagtacagctgtataatctggctgccctggaccagctctgattccccacaaaatcccattcctagaagctaaaatatctctggggtgtcttcccccagtcaaaggactaaaacccagagcaggccattgcagcaggcgcactgctctgggaggcgctcggcttcgggggaattctacgctgggctcatgctttagtttcataccttaggatgaagcatcgtggctttcatgttgggataacagactgatttattatttaccgaacgcagtaggcgctcggcagatcaatttcaatacaacaatggactataaatgccaccagcaatctggcagtagcagtaatcaacaaaacatgttgttctaaatgctgcataataaattgactacaataaactcataattactctactggctacatttcaaagttagcactagaaaaatcaaatcaccaatttggacttggcattaacatcctcggatcactcctgcctctacagctgcagctgggagatgcaggtgccatgtgctgtcccggagggccgaggccacagcatctgggattatgccaggaccctctccggggcagataaagagggtcataaaggagcagtcacttcttctggggtgtgctgagcccacagaggagaaaagctcatggccacgtggctctggcacagggctctccagccacccagaagtgccccctggactgtggggacccactgatgtggcctctgccgtgagactgggttcccatgtcctgtcctccaggcccagccagaatgcgctacagggttaaagagctttagaaaaggtttcagggctgggcaccgtggctcacatctgtaatcccagcacttttgggaggccgaggcaagaggatcacttaagtccaggaattccagaccagcctgggcaacatggtgagaccctgtctttttaatattaaaaataaaaaaattagctgggcatggtggcttgtacctgtagtctcagctactcgggaggctgaggtgggaggatctcttaagcctaggagtttgaggctgcagtgagctatgattgtgccactgcactctagcctgggagacagagcaagaccgtctcttaaaaagtttcaggacaccaggtggtgtctggagccactggtgggtccacggtgtgggggcagggctgccaccccctctcctgctctagtcccctgctgagccaagtctgagtttgccaattctttccccaagtgcctctggcctcacacctgggcctggtgccctccttgtgtctgagttccttggcccacacatggggtgaggtgcctacatcgcaggatcagggcgaggagtgggtgagaaaatccacagagacccagaagaagggcccagtcaccttgtggccccaggcatgtaggaggaaagctgagctccgctctgaccctcccagccccgagcacggtggctacgcaggggggactggggactcgcccaccatttgtggggctcactgtggtgccagagtgaaccaggatccgtggagccagtgctgtcgggtaggccagggagtccactaaggcccagcgcgcagtgggtggcggttccactggcctgcctccgcttgcaccctcaacctgccgtgttcctaacacagccctactgtggcggcatatgctggccccacccaaggtctgagctgagctcctgccagcatggcctgagctggaacagctcatcagctatggacctgggtgagcggggagcccgggcagtctcagtaggccatgtgcccaagggcagggaggaccccgagactgagtgtgttcctgcaaatactcggccctgacagctcaacgctcggcagctctctgggcagctggttgtctgtccataggtctgggcatgtgtgttcctgtccttcagtgggcatggctggggactctggggggtgggctcccacgactacctgctgtagggtgaggcggggtccaggccggtgagcagccatcatgggaactcccgctggaggagctggcacattggggtggctcctcgatgggaaggcggaggcagcccagctgggcgccacgcaggcctcagaggacatgccatgctgctggggggcagagggctctgcaggaggcttgttcgggtgcatctgccatagaagaaagggcaccaaagaactgggagggacaaggcacatcctctgctagtcagtgaccacagtgaaatgtctggaggccaagacagggcctgcgtggctgtggctgagccccagggctccagcactggggtagctctcaggagctctgcactgcctgggctggccctggctgacatctgacgtgcagggcacaggcaaagaacgcggagggactgagcagaggccaggctgcaagtactcacacacctcctccctgccccggggcagcggcccagctgctctgccctgcacaccgaggggctgtgggtaggactgcaagtcctccaatgagagaaaagactacccgaggggcggaggccgcagggcctgcccacatctccttgtcgtggcttctatgaagaactgtgagcacggcacatcgtgctcaggaaagccctgcacgcagccacgggtcagcactgctgacttgctgaacgcagggccgcagaggccacgggctcctgcagcaggaggatggcaggtttcagagcgtgggaggctccctgcggtcttcccagctccagaccaagaggcctgccctcctggcaccaagacagaaagatgcgagcgtggtgccccctgaacggagaggacagcctggacagaggctggggatggttcaggccccctcagagagcccacaatcccatggcccacaggaaaccatcgggggcccctctcctgcaccctctctctcagtgctccctggggggtgcaggcttttggccctggagaaggcaccacgcaggccgatagccttggcagagaagtctgggccaagaagcccagggacttgctgtggtcagccctctcaggacagggacccagaggcttctgggccatcttgaagttgagtccaaccttggcctggctgttcacacacagagccagggccgctggccctacttaccacatatccccattctggatcgttcggtcgttgggagctccggcgtgtccgtagtgtagcacggctgagttctcaccactgcaaagagccgggggagggtgatcaaagcccattcttctgcagcaggctctgaaggagggggtggatgctcgatcccctgcccatgagcagcactgtccccacctccagcacaggcccaggcgtggctggaccaggtccacagccagaggtaaggccgggggacatggtggccctgtcaccccgcagtcacatggctggcaaccagcctcagtctgcaggcagagcctcctggctgaaggcgtcgttaggcggctgccctctgggctgggatgtgggcatcatgtggaacacatgtaaaacttagcaatgggccgggtgtggtggctcacgcctgtcatgccagcactttgggaggccaagaaaggcagatcacttgagcccacaagttcgagaccagcctgggcaacatggcgaaaccctacctctacagaaaatgcaaaaaaaattagctgggttaggtggctcacagctgtaatcccagttactcaggaggctgagctaggaggatcacctgagcctgggaagtggagactgcaatgagctatgatcatgccaccgcactccagcctgggcaaaagagggagaccctgtctttaaattaaaaaaagagcaaaaaaggggaacagcagttcctgggcctggagaagggccctacggaacccctcctttcctggtggccaaaggggagagggcctctatggaaagggccccggctgtcctggagctgccctggcgtcctgaccaggctggagagagaggaaaccaagaggatcctcgctcctctgcctgagaaggcttccctaatgagcgatgcctttaagaaaaaaaggacttttaagtctgtccaaaggggggaaggaaacccccacctgggtgtaatatttatggccctgctcaggagtcttgggaatcataaaagtagaaataatggttttctctccatccaccagagaagaacatttccaaggactgagatttcacatgtattattcatgtgccggggacgtgcgcattggcagagctgcctggctccatcctggccgggcaggggccagacccgaggggcagagagcagggagactggctgggagagcgcaggagacgagggggccacgcccacagccaggacgcatgtgggggcagacacaccccaagggacacatgccgctgtgcatggcccacacagcatggcaatgatcccatatcactgtcatttctaccatgtgtgtgcctccaagcacacccagccaggtgttgatggcacacacccaagcgcacacacccacacagagccctgcccctcggcaccatgtgccacgagcaggcacaccaacagtgacatgcacacccacatacagcagcactggtccccacgcagccacacccacatagacacaccaccaccactttctgcactgacccttccacactccacccctgctgcacacagaagctgcccagcctgagctcacagcccggtccccacatgctgtgtgtgtgcccgtgtggaggagtggccttcctgtgcttagctgctgtgctgaccagctggggacaggagggaggggacgccaagcagcccctctgcagtgggcaggccatgctccctccttcacccagtgccaggtcctgcaggcagaggccacctcagctccgggagtcttgggagggaggagcgacttccaagcttgggccgggcgctggtgtgggcgtgtgagtgagcaagtgtggctgagctgggggatggtggagccccccactcactaactgccctacctcctcccactggtcacccccaggggagccagggtgccccgcttacctgccgcagatgcaggtgtaggagctgtggcgcatgccgccccgggagtagcagtagtgctcgaagaggctgcagggggagagacgcgtcagggttggggcactagagcaggcacaccccactccacgagccccatgaaccccaagggaaggccctcggcccatggtctcccctgccgtggccccacaatggtccaaactctcagtgtgagtctgtgaggcttacagcctgggggtcagtcataggctgcagaatctcagaggccagtgtggagtgacagagaagctgggggcccagcagggcgcagccacctgccagaggagctcgccagcctccactgactgccatggcgagtggcttcccaggcacatcaggacagatgggactcctggagcctgcgccctgtgggaagccgggctggggcagaggccacacatttctgcagagctggaggaagtgattccctgtgactccgtgcccagaggccaccacccaccctgccaggaggggctggatctacggcctgcgctcacccggggagagggcacaggagctatgggcagaaggggcaagggacaggcctcctgcaggtggggcagggcagggtggtctccagggatgtgggagaggcaaggcctggggcacacatcctgcttctccctccttggaacgagctgcctgctggctgggcccactctacaagctcccaccctgagcgggtagggccacagccaagtctggagagaaagacaagccctggccccaggctaagcccagaacctgcaccggggaggcctctaggatggcggatggtagcacagtcactgcatggatctttgagctccaagggactgagccattctgccttggtcttcctctactgaacccagctggtgaggggtgtggtcgtggggagctgccctcaccccctccctgaggcctcggcaacagctttcctgccggaccacagctggtccacctgccaccacgtgagacaggcccaggtggcccccacccgcccacccccgaccagggcagtcgttgcggccgcccaagggcacgccacatggcggtcctgccctgcacgttccaggcctgccttagagaacgtccatacgagggagtttcatcttctaggcactgtcaacacaaattatgtataattgtcatgattggatattaagcagttgttatgcaggaacggctgtggtagattcaatgggctttcagacttgccttccaaacctcacaggataattgggtatctgcgagtgaaatatttcctgaaaagaaaggatttcaggagctgccagggaagcaagaaagccacatgctcctctcctcagccgcccccgtattcgtggtgcaagcgctcaggaggccgcttccacctcgctcctgggagtctcagcgctgagtttcgccacagtccaggcacgttcctaccaaggcaggcaagggcagtgccccacatggcaagccctgtgcgccaggccagacaggcagcctcagaagccacttcacacctctgtggcgccctcccagaaagcccgagaagaggcctgacccacgccgtggaacaggggtgctcccttggctttgtgagatgtggtcctgcaccaacagaagcgaacctcagaggtcacatggtcattctcgacgtgatggcgacagcggacctctgtgggacaagtgacctgcagacaaccacgggctgcgctgggactggccggcttcagaaaagacaggcagagggacagagatgccatccgcatgtgcagaggaactcacatattctacaagaaaggagcggcaggccgggcgcagtggctcacacttgtcatcccagcactttgggaggccaaggttggaggactgcttgaggccgggagttcaagaccagcctgggcaacacagcaagaccccagctctcaaaaaatcaatcaatcaatcaatacaagaaaaaaacatcagaaaggggaggcagtgaggaaacttggctctctcgcctgcagcaagcttccccctgcataacccactcagtggagacaactgtctttgaatgcctttgctgctttttaagaaaaaaatagtgccttcaagaaggcacagctcacagaagcatcaaactaaagaaaggctgacccagttttcacctgcaaagtgcagcccgacactggtcacctttgccggccacgttgacaactccacacactgttccataggaaggagttgaaaagaggaggagcaccacgtgctggatattcacgcccgcctaaaaaaagctgaaatgcttcacagtggacttcagtcctgaattttgttttaaatgaccttttctgacgcaacttgaggacacactggtgctttggtggcaataacaggtgggcaaaacgagcccacgttttctgcagactttaggcttggggtgtggacgcacaagggcacccaagttctgggcagctgtggcggcacagggggcctgtggaagcgtgtgagcccggcgcggcacagttctgatcttcaagcggtgagcactgaggggtggacattccaaactggggcccatgcttgatgcggacgcaacgtgtgcccccgcacagctgggccagagcttggcgagtggtgctgggatgaccaggagcaagtgtgggctatgaggacaggctaacagcctgtcccgtggatgaccgacatgccatggcagtggcagcatcacaactcctccaagtgcgaggcaggaggggtccagccaagtcatccctggagcaggctagctactacccacccaaaataattaacacctggaacaggctctccagcagagggcagcagccagcaagacaggcaggagtgtcaccgccccactgcgaccatctccataggctccttccataaatttatgactcacatcgtgcagccccggaccagctgggtctaacagcccctgctccctcctgctcacctggaaggcggatggggtggtacacacaccccagccaggctcaagcccagcgcgcacctcctccccagcagcagggaggggcttcctgattggctgagaggaggccgtggtctgcctaagtcccagccaacgacatcccggctgctgtgtgggccccgttgtttttccttatgtggccattcctctaacaccctcacctataaatttctcccaggcaagactcgggtagaagaggcttgtatccaggcataagtgagagagcccttaagcaacctgggggaactgcatgagtggtgaataacgaggtggatggagttactgcagtgtcagtggggcaggcacatctgtcagtgccaggagatgacaaatggggcaggagcagcaagttcccagacccagatctgcaggaatggggtccccagagacggcgtcgctgggcctcccactgggacccacaaatccagcccgtggagcgctcccgggcacacggcccagctcctgccctcagaagtttatcacctaacatgaagacgagtcacagtcctataaaaatgctgcagctgcccagacagcggtagaagggctgcctggcagcaagtgtcggccaagctatgtgcctcgagcatgggtggggtagcgccgaagaggttagtgaggcagtgtaaggggtggccctggccacatcattccctttccccggctgggcctcaatggatctcaggtactcaagaggtggagaggggaggctgggccggaaacagaagcttgggagtgaaaatgcgcagagctggtggagccccctcagctgggcagagggcttaggaaagcaggtagttgggacatggggttacaaacctgaggtggggagggtgtgttccgcaccccggtccctgtgctgggctccctgctctgggccccacatacccagccttctgggactcaacaccaacctcaagggcaaatcttggctctgctgctggccagctgaatggcctctccgtgcctcagtttcctcatctgtaaaatggggatgatagcggtgcctccctcccagggctgctatgccagtcgaatgatttaacatacatggagtatacacaatggtgcctggtacccaaggagctctgtgtacagtgacctagccatcgtggtcactgttcagaggcctggagggaggctggagaatggggatccctcctcaggcagcaggagaggaggtcgtgggcatcctgtgccaggctttgagaaacagcctcttgactattcctttaaaaccaaacagaatctgcataggtccacggcccggacacccactcccgcaccctccaggcagccaagttctctacagaagtccttcctgggcccacacactcccagcatctccaggatgttcaccagcaaaaacgcggaggtgtgtcctctgcaccagctaccgggacacgtgcgcacagacaggcttctggctggacagagggggcctgtgcccaccatcccttcacagctgcccctcgccctcacggagctgacccagggtccccgccttcccggggtgcgcccaggactggggcacataagagggagagagccacagagagtgagaagtacctcatgatgtttggggccaagcagttgtgctgtgtatagtcgtctcagcactaagttgcttataattcacatttattttaagtaattgctgcgatattttctgggtacacatgaccataattgtgtcattaacgtgatacaccacttactaagggaaaatccttttcagagtaagggccatacagtcctgcaggggatgccctgagacacctcaggccgagcagagcgtgccttatggtccccaaagtgggagcagctactatggaggacttggagccaaaaccggatgtttctaccagtggagccctggcatagctccttttgcatggaaccagaagcacgtactacattcttcttgaattcccatggaaggaggggagctgctccacgcccttcttctggggtgaccagtgggtcatcagaaggcacaggcgaaggcgcccaagccctacccttggaatcgccgcctgggtggcaccagcgacctatccaggaccccaactcccaggcaggtcctggctcttttagcactgttccccgtaggtcttccaaagagcaggtactgggacttggcagtgaactgggggactgctgcgtgcctccccttccccaggccccagcatgacgacaaacacagacaaagctaggaatgagcaccctctgaggctccgagtgcctgaaatgagcaagaggcattcacgtgatgtgtcaccaagaagggactgacctgaagcctcggactaaagccagaaatgcatgattaataaaactggtgctagcggagagctggtcagcatcaccgtgtagccggcaccaacatggcagcgtcagacacaggccgtctgcagcagatgcggtgctcggcttcagcagcttgctctgctgcccggagctcctcactccctcttcctgccgctcctacaccagtcctggcccacagacagagactgtttgacctggggcaacaccttcccaccagggcttccagaaggccagccagcatggtcacagggtatatggggccaggcttcttgggcttgcatggaccatctccatgtgggcaagcagatgaagtcacactcctggagccccactgctgcccagatcactctccctgactactcagctcctgccagggagccccacaaggcactgcactgtggggatgggtgggcagactgattcaatccaggccctgctgcccactcagtctgaggcttgaggcaggttgtgtagctgctccagtaagaaaaactgaacagtcaactgcagcatttagcatgataacaaccctttgggggctgagggatcttcccactgcacagaggatgctgcagtcagaacaatgacgggctggggtcaggaaacccactgaatccgtgttcgggctcggagtccacgcagggtctccgactgcaaagcttatggttttgacccggatgcctctgaaacctcaggtctgtcagtaggtgggggctggaacagtgctgacctcggggcttgctgtgaaggctgaagaagatgcagggaaaagcttcaactccataaacactggcagtgggtgatgccatggctaacgccttccggagccctgaccttgcacccatgcacaaggccagaactgagcagaaaagggtctgcaaggacaactggcccaccaagtcctgggcgaaggagccccaggccagccggtggaaagcaggagctggggtctgagagaggcctgggatgctgaggccccgcccagaaggggggatccgccaatcacaggcaagggcagcggccaagacagcagcggtcacagcaggaggaagagacacaacagacaggagcagctcactctctctctgagagctgccttatcaaggcacaagataattagcattttaattggataattgggaattctaaattgcctatcttgtattaagcataactgaggacataacatgacattcaattaacaaatcttcccctttattttcaacgtgcttgattaggttgagtttcggagttcctcggatcagttacggataaaacattctatctccttctccgtccccaagcctggctcatcagactgtaatatacttatgttttatatgtacatggagaagtcttagaaattctctgcacaaagaaaaaaagtcactgatcgtgttaacacccagaggtcttctctatccaatattttgttgaacattcttccaggcattttttttaaaggtataaacacagattaatatttaataattattttaaaaataattagctgtggccgggcgtggtggctgacgcctgtaatcccaacactttgggaggccaaggtgcgtgaatcacctgaggtcaggagttcgagaccagcctggccaacatggtaaaacccgtctctactaaaaacacaaaaattagccaggcatggtggcaggtgcctgtaatcccagctacttgggaggctgagacaggagaattgcttgaacctgggaggcggaggttgtagtgagccgagatcgcaccagtgcactccagcctgggcgacaaagccagactctgtctcaaaataaataaataaataaataaataaaaatgattagctgtaattaaaaaaaaaactcacctttttacagaagtgggacatacatacagaaaagaactcaaatcctacagacacagcacaatggcccagcacaacttgggcacgcctgtgtgcctggcccccctcctggtcagtctctcttccccaggggcagcctgactcctatcaccatagattagtttgcctattttttaacttcatgtaaatggaatcaaacaatatggtctcttgcgttggctgcttccgctgccacaatgtttgtggacccgtctaggtgggcagcagtccctggttggttctcactgctggccggtgttctactgcgggggtgggcccccgtgtgtttctccattcttctgtgggtgagcgttcgggttgtttccagatcacagctattatgggtagtacagccatgagttcttgtacagtcttttggggcccatgcatgcatctctggttgagcaaacagccaggagtggaaatgctgtgtcacagggtttttggggggtcagctttagtagacaaagcccaacaggttttctgagtagtcacatctttgtggtcactgtcctgaaacttcctcctctccatacctgtgaatggggcccaaactgggctgaaacaagtctgcaaggacaaacagcctagcccggtccagcgcaggggctgggctgacccactgaaggttcttgttaaagcaaagaacattttccttatcaacagatacatgtatgtactttttatttttgtttttcatttttatttttagagaaagggtttcactctgttgctcaggctggagtgaagtggtgcaatcacagctcactgcaggctcaaagtcctgggctcaagtgattctcccccttcagtttcctgagtagctgggactacagacatgcaccaccatgcccagctaattttttttatatgttttgtggagatgggagtctcgctacgttgcccaggctggtttggaactcctgggctcaagcgatcctcccacctcggcctcccaaaggtccggtattacaggtgtgagccactgtgcctggcctatttttatatttaatgctgtcactatgtccagaatctgaccacttctccgcaccaccacaactccctccctggtgcaggccaaggttctctctcccctgggagatggcgatggtggctggggatggtgaatggtgatggtggtctggctggcccccctgcttcagcccttgtcccctacagagtgtgctccacaaacggatccttccacaacttaagtagaatcacaggactcctctgctcacaccaaccccggcttcccatcggcagcccacctcccccttactcccctgtcttgtcttgtcttcttagtcgaactccgcgctgctcctggaactgccaggcaagttcccaccaggccactggaacagctttttctctctgcctggaatgtccaccccagaaagccacagcatgctctctctcccccttcaggtctctcctccccttcacagggaggcatcctgagtccctggataaaggtagctccctcccctgtaaccctcaccaccatctgacatgtttatctagctatcccatcaatcaatcaatcaatcatctgcctatatctacctacttatcatccatctacccatccatccatctatccatcactctagatctacctacctatcatctacctacctataatctatctacccatccatctatcactctatcatctacctatcatccatctacccatccacctatccatctatcatctatttacttacctatcatccatctacccatccatccatccatcactctatatctacctatctacctaagtgcaatccaactacccatccatccatccatccctctatcatctatctacctacctcctacgtacctatcatccatctacccatccatccacccatccatccattccatctaccatccatctacccatctatccatccatccctctatcaatcatctatttctgtcaacctacctacttatcattgatccatccctccctccctctatctatccatccatccatccttctatatctatctatctatctatccatctatccatccatccatctctctatatctatccacccatccatctattcctctatcaatcatctatttctgtatctacctacgtatcatctatccatttatcactctatctactcatccaatactctgtcaattatctgtttctatgtctacctacctacctatcgtctatccatccagccatcatcctatctatccatccatcatctatcaaggtgatgatcatctatatcagcctacatacttacctacttatcatccatccatccatccatccatccatccatctatccaaccatctctagcctcccattaggcttgagctttatctttttgttcactgtagtatccctcaagagaccagaacagtgcttggcacatcagaagtctttggtatacctctgttgagtgactgaataagtgaatggctgtatgagcagcaccacagcctctaatttacttaaccaacttcctgctgttagagatggaggcttcttctgcctctctgtatgatggccacgcatggccttgtgcctcttcactgtcctcgggctaaattcctagaagggagattattgaccaaatgcacatttccaattctcagggcatgttctgcaaaaaggacccctgaacactcataaggattttggggtcctgagcagcacactgcaaggctcgtctgcccacaggaatgggaacctggtgggtaaaacacaaaagtatttcactgtttcactgatgaactgacaaattttaatatgcttatatgtctacttcctcacatttcttcctttctgaatggcttgttccttttttaaaaactgcgaatgttcatcattttcttattgatccttaagggatttatacaggaagaacacaggcagtggatctgactatcatttatgtaacaagtttcccctttgctccttaattttctttatggcatttctggacagataatttacatttttattggctagatctgttacatttttttctttatggcttcttcctttaagaagtcgttccctacccctatgattatataaactctatcatcttttgtgggcttcctgtttgcacatttacttaatcaatgaacctagaatttattgtgatgtaggtcatgaggcagaatgccatttgattattttctttgctttcactaactgccccttgtgcgctggcttggagcaccatcttgttgaaagataaatcctttacataataagggtggttgggggctgcgcctgtcacctgctcctgtgctgggacttcccactgccctcactggggctttcagggcaagtccaccccctccccaagcagctggccctgtagtgaccccctccagtaagtaccttctctactgattcccaggaagaaggacaggacaccagaggcagaacttgactggtgcctgggaggctgacaacacagaaccgaaagaaattcaaagctcgcagtacccgccttgagggaaattcgcaatctgtgactctagacctgtgtttggcaccttgagccagcgagggagctccggctttggaaggcctgggaagagctgtgtaaacacaagcaccattggccaactgttctctgacttattctgggatccacacctgttcgcgtctgacccaatctcactaatccatgctgactgtagagatgacacctttcttggccctagaacaaaaactcccccttttaaaaaggaccagaaggccagtgtggtggtgcatgtgtgatggtgtactcaggaggatgaggcgggaggatcgctggagtccaggagtttaagcccagcctggacaatctagtgagacccggtattcgtccattttcaagctgctgatgaagacatacccgagactgagtaattataaaggaaaagaggtttaatggactcacagttccatgtggcttgggaggcctcacaatcatggtggaagacaagaaggagcaagtcacatcttacatggtggcagggaagagagaaaatgcgaaccagtggaaggggtttccccttataaaaccatcagatctcataagacttatttactaccatgagaacagtatgggggaaagcacccccatgattcaatatccacacagccaaaccatatcagaccccagctctttaaaaaaacaaaaaaacaaacaacaacaacaataaaaaccaggttaccctcagatacatccagagaggctcaaaccacatgaccaggaaacaaaaagaattgccagaggccaggtgcagtggctcacacctgtaatcccagcactttgggaggccgaggcgggtggatcacttgaggtcaggagttcaaggccagcatgaccaacatagtgaaaccctgtctctactcaaaatataaaaattagccagtcgtggtggcacacatctgtaatgcgccactgcactccagcctgggcgacagagtgagattcagtctcaaaacaaacaaacaaacaaacaaacaaaaaggcttgccagagtggcagatgatcctagttcaacacaacccagaggccacattgtccctctaaggaacgctggcaccctgtctccatcctccccaggaaggtgtgggggaagcaagccaggtatgcagggagctttctggaggggcgagcaggggcaaggggagggaaggggctgcttttaagttcacatttcccaaagcacaatacgagtccacgggatgacattatgtagtaccccactagcatatttccttcatgcactaggtatttatcttgaagcgctaatgtctgttaatggcaaattagattgggtttcattcatgacgaggataaaaagcatcttaaaacatatatttaaaggaaaaaaaatgagtcaattgaaagaaaacgattaagcagataatagtagaggtgagacaagaacttgaccaaaactgccagggtgtctcatggaatgactaactctgggagatcccgccttaaggcttctttgaggaaaagcctggtttttcgttcttgggcaaggcctttggttcagaagctccccaagtccccagatggcagcctcaaactcctgggctcaagcaatcctcctgcctcagcctcctgagtagctaggactactggtgtgcacaaccacacctggctaatttattttattttattttatatttgtagagacagcatcttgctatgttgcccaggctgctctcgaactcctggcctcaagtgatcctcccacctcggcctcccaaaatgctgggattacaggtgtgagccactgtgccaggcccaggttcaatatttagggaacacatgtttggcagaggatctcaggtctcatgtcactgcactccagcctgggcaacagtgggagtcacccagatcccaccttgtagagtgaggacagaatccccaagtcaccccttctagaaaaagcaagtgctttgctttggattccctctagggcatttttctgttttgtcttgaaagagtccagcactactttatttctaaacatcaaattgctttttcagccttacaatctgaaaatacttcacaaatgtgtcgtttcagatctaactttctctggaaagtgctgtttcctatcaatgtctttctaaagcactgtcgcacctgggcccagctctgggcagcccctgcaactcactcagttcatcctgagggtctagtacccagttccctccctatcgtcctctgctgagggctctggagaagagaggagaagcagtctgtccacatggactcacagccactctcggtactgtgagcacaggacactggatacagggacctggtcacccgggaggcagcgccaagccagtggtcactgcgcagcaggtggccttggctaccccattaggctggagggaaccaggaggagctgggtcactgaggaaacaggaggagctgggtcactgcagccccagatccccagcacctgcaggaagcgaggaccacagatgcctgtgaaagacgtctcctctctgagaaggttcttccaagcatccaggaaccacaaggcccaggacgcagcgaaatgtgccatggagggaggcccagacaccatctgtcagggccagcctggacaggccctaggtgggcagggcccctccaccgcgtgcggctgtgttttatggcagcgaaccggctgttaggcgtgaactgccgacaacccctcttctaatgagcctttccatcctcactcacgactccaaacgttattttagtcacacttggctgaaggaacaacaggaacgctatttatcactttgaaagtctttatctacttaagatgatgaatgggggtggcagtcacgccgcccctacagagagcagccttgagaagaggagtgccttggccagggatgcactccaagcatggagctggggaggcggaggctgtcgtggctcatggcatctctagcatgttctgcacctgtgccccatcggggacctctcagtgcggatgccaccatccaggtcctcagcaccctctcgtgccacagagcacagaggtaggagatgggggaagtgggacagccccaggagccccccatcggtccccacctgcagcaggatgtccactttggctccacagaggatgggaggggcgatttaagaaccaactcacatgtcctaaacctttgctgctgacatcccagagacacagggcaagttccaaaaaatcctccaatcggaggatgccaggaataactcttgcaaattcaactttggggtagcttaaacctatttatcaatagctaattaataaagtctaagtctttggatgacaggatgattaaactggtttttaaataatccatttttaattaaaatgctaccctcttttggcttctggatatattcaaaaggaagccttaacagatcttgtttttaaatatacattatacgaagccaataattagaagaatttgtgcttttaattatatcttaattattctttgcctatcgatgcaaagttaaatatcctttctttatgacaccaacactactccccaaagccagtagattgctagcaggaattgtgtgtgtgaagcctgctcccggagatccgtgcagcagtgacggtgcctgtaggcaacccatacccccgtcctggcaggcggcaatctgatcatggcaaagcactggctctgggcagcactctcctggcccccaccttgtaagagacacgcttgaagacagaagtggtcgttatgtgatgagggtctgggcccccctcctgcatagccaggagccaggaagttccttgactttactcgccagcctgcacacactctgaagcatctcgccagcgccacccactgaaatttagaaaattcgcacagtgccaaggagggcttggaggatgcagaagagggagtcacgcccgtggatgccgggtttcctgatgtgctttgctgggtccccgcagggagcccaggcatcacacacctgtccagcataccccgagctccctcttccaggacccacagcaacacctatcccaagcccacccacttctagcaccttctatcggacaccttccacactgaccctcaaccacctgccagtctttaacaggtcccctcctggcccaccttcccaccaggaggtcatggctagaggggtctcagtggactcctggcagctgctgcccttcaggagctgggaggatgtccacgctccacctcctgctcaccgccagttaccatccaaaaccaccgtgggccaggctgacgcccctctccagaaatctccctgggttccccaaggggcttctcccacctctcaccaccaaaagccctctgtaggcaagtccctccccacacttctacactgcagaactttcagcctggcaccctcccgttccctcccagtcttgaagggcactcctagaggcaggcccatgtcacccatacccaaggctggccacagtgatgagcacacagtaggtcctcagtaaacatgtgaagaaagggtaacggatggcaggaacagcaggcctgaacatgcccaacaatccaaagaacattcacacatacatgcacatatgcatatacgcacacatccacaggcagccgaaaccctgtctgcccaggcagccccgagtggagatctagccctgtgttcactctgcttcctctttctgggcacatatcttagcctccctgcagctaggctgggaccataggactgactctcatcccaagaggaatatgaaatgacatgtgctgcttccaggccatggcttttaagagtgggtgtgaattcttcatgttctctctcttccttctcagagggggcagagttgggcagtggaagcagccctgcatccctgctggaggagagccactgggccagccacagatggcagcatgagcaagaaatgagcctttaccgtgctaagccaccgagatctgggtttctgttgttaccaccccaaaggctaccctatactgactaatacacctgggaatttagaatacagcaaaaatggaattttacaatggggggcaaagacattactccaaagacaacaggtcacttagtaattacgcgggggcagaaaagccagaatccttgtttatatattattcttaaatgcagtttagctcaattaacgtattaaatataaaagacgaaaccatgtggatacacagatatctattaaactatacacagcagtgtttgaaatatttcataattatgcaaaaactgttatttaaaagaaagtcatcagactataaagatagaaaaaacatgctgataactggattatattgaggtagtagaaaaagcaatttcgcaaaggcataaactatacaggaaaggaccaacatgacaactgatatttacaatttctgtacatcaaattgggaaaaatatttccaacacacagaacaatagtacaaagagcccaattacagagcaataagtcacccacaaatgtcccgattgcaaatgggcaaaggactgaaaacccacaaagataaatgcccaagaaatacttacaagagaagtttaagctcgtcagtaatcaaatcagcaaaaataaagacggggtattacttttccctaatcagaatgataaaggtgaataatggaaataacacaattaatcttgaggcctgggtgggcacaccggcactcatggtttgggaggaggggtgtcctgcacgctggctgagaacatggcttctggagagaggccacctggctcctctaagacccatctgtctactgtggggtctctataatgcagagaggatgccacactcctctccgctccccctcacgggattaaatgagaacatccccgggaaggacatggtatctgctcaccagacactaacccagccccagccgtgaagggagaacaacttttctagatggcactgggctttgggcatcaacatttttccagcaattccatttgcaggagtttaccccaaggacacggtcagtttgacacccgagagacggcgaggtagggttgacggtcgaagtgtcgttcacactgggaaccacctggcttccgggggcagtctgggtaagtggattatgatgcagccccagtgtgccccagttcactgccaggaagagacttctgctgcaaaaactctgcccagtgtgagcccagcagatcaaagcccgtctgtctgtgccccagagagaccggaagcctgtttgctacagcaataaggttttgtgtgcctctgcatcaaagggtttttttcctatcttgtttataatgttctgtactgactggatttcctactggcatatgtatctttttatcagagtaaagctattttcattttgaaaacacttttgggaagaaataaaagctacctgtcaaagacctgctcccctcgccccagcctcgccccactggccccagggggcttcttgtcctgatgtgttctgcccagtggacacagcgcacactccccaagcacagctgccaccgaggacgacactgggaagctgccaccagaggtcgcaagtgcacgccgtctgccacgcacacagagctccttgaaaaaccttcagcctggctgaaggaaccacagtgtatctctgttttgataccattgttgtggacaaagtaaaaaataagcaatccagccaggtgctgtggctcagcactttgggaggctgaggcaggaggactgcttgagcccaggaggtcgaggcagtgagctatgatcgcaccactgcaccccagcctgggcaacagagcaagatcctatgaaggaagggaggaagggagagaggaacagagaaagggagagaggaaggaaggaaagaaggaaggaaggaaggaagggagggagggagggagggagagagggagggagggaaggagggcaattcaagcccaattccttcccgaaggaaggaagagagggacgaaaagaaagaaaagcaattcaagcccaattcctccctgactctatcaggaaactctaccatgggttgaaatcacccaaaatctgaatgtccaggtccccgccggaggccagggctgggggcccatcttcatcatcccaaaactcatgtgggaaatttccccaagaggagacagaaaacaaagcaaagatttcctctcttcattccgcccaagacaaagcatctgaaattccactctcgatgtttccttcattatctcccactttctacctctcctttttgccacagggggaaaaattcttcctgggaaggacatcctcggagacactcccctcccaattaacacccatctggcagcacctctgcctgaagatgggtagcaaatgctagtggagggaccactctttcctgcttcctggcctcatgatcaaaatgggaagattaggcaggtcgtggtggctcaagcctgtaatcccagcactttaggaggctgaggcaggtggatcacctgaggtcaggagttcaagaccagcctggccagtatggcaaaaccctgtctctactaaaaatacaaaaattaggcaggtgtggtggcaaatgcctgtaattccagcttctcgggaggctgaggcaggagaatcgcttgaacctgggaggcggaggctgcagtgagctgagatggcgacactgcactccagcctgggtaacagagcaagacaccacctcaaaaaaaaaaaaaaaaaagggaagattaaacccagagtgaccattacgagtctaagagtcataggctgaagctaagaagtcttcccaggtaagggccactctgggaagaaagtgcagccctatcccttcctccacccagagctcctgagctgctccactgcaccggcaggtttggaagcaagctctgtcggcaaggctctctggtatgcagcctggagaatccaagcccctagaaggcctgccaagtcctgcttcaggagcccacttagccttcttctctggaatcagattctttggcaaaacctctgtctgcacacggaggtatcccttttgcacagggagctagagaagtcagagactggttggaaaacagccttgcttgtctcctctggctaaacactccccacacggggcaccccaccctggggaccacccacccaagcaaaaggagcccaccccaccccaggggaacaccgacagctcaggtttccactgcagacaggatggggcagaacccgcagctctgaagagccgattgaaaaagcaaatttccctctggtgctctcactggaaaaaaacatgatagctctctcccctgggagcaggaggaagcctctttgtccaggaggactgtgctgttccttggaaacgagcctgctgccatgaacagatccagcaggtatgggcaaatcacctagaatgcataaaacattacgttcgccaaatccccctggacagaaatctcggattcagcaaacagctcagatctgaatggatttccactcacagctttgaaatcccccaattaaaggcacaagcgcatggcaaagttggaagctttggcgcttccgggctcccagtacccacagcctggatggagatggtggcagtgacatggcctgggtcacatgcacacgccttccagaggcacctcggcctcctcggctatagcagctagcgggtgtggctggcctggagcgacaggctccctcactgccatgctgcctgcagctgggttcccttgagtgaaaacactttaagggaattgtttctatccctccattcctgaacaagccagtggtccccagggccccaggagctacacacccatttgcatgttgtccctaatcaactgcaatccatgtcaatcagggccttactggtctcgggcacagaacatgctgggtgatgcctcaaagtgccagcctccccagcaacttcactaaggaagaggtttctttataaaatgtctgcagtctgatggctggctctcctctctttcagtgtgagctgctgttttctccttaaactgcagagccagagctctcttctccctgccaagggggcacgcccactccacaaacacacaaggtacaccaaagcccttgagacactcttggaataatgatgcccactctgtacctccaggggacttaactaatttataaggcaattttaataataaccatatattaattttacatccccttttttacctatttcagtggctatgaactgttaggaattaggtaatatattacaatgggctcctggggtctttttattaactaatgccccatatttaaaaaccttcttgtcaaatgagaaacattaagaagcgctgtcccttttataattgcttctaatagactcgatattcaggtcctggcctgaacagagagcccaggcgatacttccttaaattgcatttaacttttcattttctttctgtcatcggccaaccgaataattctgcaagtgcacaaatggtcattttaccgtgtcggtctgtagctctggagatgtctgtaaatctgcaagttaggaggaccactcaggtcaagagatgcacagcgtttctgcccggagtctggccgcaggagcaatgcttggccattttggtgtgtgtgtgcaagcctatttatcaaaatatatgccagtaaaccacacccatcttaaatacccagattgatgacatctcacaaacgtgccccgtgggtgaagaccccaggacatttcttgtctcctagagggttcgctcaccaccccttctcttcccctctcctcctctgtcaccagttttgcttgctgggaactttatgtcagtgggatggtacgtgcctttctgagcctggcttcttttgctagacatcactttcagcgctgttcgtgtccctgactgtggcaacaatctgctcgttttcactgcccgacagttctccctgtatggacacccacagtttacccacccgccatacacaggcttggcatctccccagctctagactcctcccccacctcatgtgtctccggtgcacatggggcaggcaaagggggagtgtggggcgccaggcatggaatgcttggttttgtgtggacgctgccagctgtgtaacggcgatggttctagcatctctgttttctgcttttttatcccccctggcagagaagaaactttgaagctcatcactttgtgggcctaggctggaggcatcggggcacctcagtaggcccaggggctactgggcattcctccactgcaccatccctggcagggcaggcgggaatggggttctcctaatgtcaggattccccgcaggacgagggcgcatctggcctcccttggtctcgggggtgaacttcacagaaatggaaagtttatcgtgaatgaggaaagggcagtaaaacccaaccccatttactgggtggggagaaagctgccacccagggtgtccaaatcagctgggaaaggtcacgccctttgggtggtcactgggccttgggaacggggccagaacccagccaggtggagcagcagaagcctggcacatcacacatacggtccagccctcctcggtccctgaccctccctgttctgggagtgaaggactgagacagggcactcaggtgttaaggttggggggtggtggggtggagggggcaggtacaaacccctgaggacggcctggagggaaggcagctgggtagacagcagcctccatgcccagggactcgggaaagatcaaagtgtgagccggaatgcgatgccagaggaagacgagggatggaagaggcagagaaccttgggcgctggggaggccaaatgaggtggctgagacggtagctccctcatccatccggcatctccaggcagaggagagcaaaggcctggccacccgcggctgcccgaaagccaccaggatgggatcctttgttttcatttccaaacccaaaggcccctcggctgggccggcgtctgatcccgactcaaagccacagggagcctcagctgggacgcaacctgagggcttggaaaatggaggacccagagccagttttagcagttgatgaataataaatgtaattaacatgatggaaaacagaagctggaggcccggctgaggccccagagagtgactcatcagctgcctccctgtcacttccggctgcccgggcccctcggcagggacaggtgccaggaggtgaggggcgccgagcccagacgaaggacaactggggcaggtctggctggggacaacagcccctccagaaccaacccccctcgttcggtcccagcagggcctgccctggtgctggggtccctgggccctgcagcacgcctctctggcctcaggtgctgcgcttgtaaagtgggagtgacagccacgctttggctgttgtcctctgggcactgtgtgagaatctgctgatgctcgtatggccgttagttctcaatcacgacaggactgggtgtcagaacctcccagggccatgggcagaggccgtgcagcccaacccacgctcccatggcgtccctggattggtcactgggatgctcaggtgagtctgaggccagggggtgccctccaggctctcagcaggtcctcggccttcccagggctgtaaacactggtggaaggtgggggcatgggagaggcatactggcctccaagaagcggtgagcagggaagggtgtgggcagctgctggaggagaatatgggtctgaggttagcgcagcccagggctccctctgacatctctgcccccatcttggtttcagggcactgcttttggcctagaagagcagaggagaaagaagcagaggagtgggaggaggagagcggggagaaaagaagggagaagggaggagaaggaagatggaggaagaggaaggagagggagaaagaggaggaagaggagaaggaagaggaaagagaagagggagagggagagggagaggagggagagaaggagaggcgagcaggaagaagaggaggagtgagaagagaaagaagcatgggaggaagagaaggaatgagggtactcaccaggcagccttcccagcaggccccatgccctgcctaagaggcaggcgggagccgtcctcagcatctcccaatggccgagtacaggggtgcttctgcctcatcatgatgggcctggtctgagggctccagtcctgcctgggctgcaaggctgcatggctgcatgggctatgagccaagttcctgcctggcaggccgcactcgagagacccaccccactcccctgcaggggcagaggggctgggagaagaagatgtttaggtcctgccaggaaggtcctctcaccacaaattccacctttatgggaaaatcaatgttattacctcctccatcttcccacacttgctgctggtctaaagcaatcacctcatgggcactgagccagaactgagccagcgctctggggtcactggcctgcccacccctgccttccgggagggccaggaagggaattggttggagagagtcagcatgcctagctctctgggtgcgaagagaggcccctggggccggttcattgggtccgagcaccagccatgtgatgcctcgctcacagcactagcaaggcaggcccctagtccacagggaggagggagatcttgcttaactacaagagcgttaaagtccgatgaggcagaagccacagggtttgatggaagacttcctggaggaggaggaaagaaaaagtgggaaatccagagaagctggcacggaagaggagcagcaaccaggcagagcagccagtgctccaggggccacgggagaagcaaaacaagtgggggtctctgagaacacggcccaggagcctaaagaagagacacaccacccccaaccaccgggctccggccctcggaaaagctgtgttgcctggctctgcacactactctgaatgttagtgtctcaaaacagtcaactttttcctttcaagagtcttctaaacgatagtttaactacctccatcaattggctggcaattccacgaacaaatggttctctgcttgtctcgaagttcaactacttttatttgtccccaagtatttggcaggaaccagttgcatcaataaagaaatgccaattttcaacagccacacgagatgcaggggttcagatggattttgtgtcggcagacagggcgcctggaggagctgttattaacagccagaggagacacgggggcaggcctgggagacagcactccagaatcagactagattaagaagatactgtaggcaccaagcctctaagcatcataaataatgctaaaattttagactgtggttgaactctctgctgtcacaatcgtttagatcatgatgcgtttgatgttttatagcaagatgacaaatatctttctcaactgctaagtgcagagagcccgttggaataaatccaaccaaactgcccaccacaggtaagtaggtggtgtcattaggaggagacttgggggggcggtggtgtcagaaatgcctcaggcagtgatttccaaaggcacgccccgaccgtgcagttcaggccatttttctcaaccctcgccagtttctggcacataatctcattgttggaagaggcagggtccaaactctgaataacacatggagtctgacaccctggctctcccctcagcaacaatgaagtcacagcagagccagagaaagggacagaaaaaacaatgcaggaaggacaatgtggtgaaatgtctaaccgtgaaacaggagccggtgcatgagagccacgggcaattctcctgggctcctggaagtagccctccaatcacaccagctggctccctgcccagacacaggctgcagggatgtccaggaacccagctgggatctcagagggcagacccagggtgctgggtttctagcatggaccctcagctgggcacagagagaagagagccacctgcttgctgggcccagaacgactccccacagttctcccagggtacaggctgtgcccactctgcagggaaaacaatgcccatcttacaatcctgccctgcagggggccccagaccaacacagctggctatctcttctctgagccagaccagggtgactcttgtggttgccagaaaatgccaactgcgggacatcaagagaagaggcaggtccaagggtctctctcccctgccctttgccttatgaggtctgatgccaagacctacgtcagggcactctatgcccccagtcttgccaacggtgagtgtttccactacccaggactggagtggccctgaggtgatggggggcgggcagggttctgctggaagccgacagcccaaccctggcaggggcagctgtccaggaggaaaatattctccccaagctttctcctcctcggagctgaactgtgacacctcagtaccaaccaatggcaaccctgggacaaaggagtgcttcctgcccttttgagacggagtctcattctgtcgcccaggctggagtgcagtggcacgatctcagctcactgcaacctctgcctcccgggttcattcaagagattctcctgcctcagcctcctgagtagctgggattacaggcacgcaccaccatgcccagttaatttttgtatttttagtagagatggggttttgccatgttggccaggttggtctcgaactcctaagctcaagtgatccacctgccttggcctcccaaagtgctgggacataagagacaggtggcgtgccttctagtcaaacaggggcctatgctcaaggccaggccagtggcacagttctcctccctggcagtgcagaagtggctgcccaaggacaggacatggagtcgaggttggaggggctgcttgagacgtcatggactgtttaccccacgtgcttcccctgaggagggaaaagtgcgacgtggacagggctcccataacctgggcacatctcacatgcatcacagccctgagggtgccccactagcaccttagtcctgtgcctcctggccttcctgccccctgcctccctctgggctgggcacctgagccgaggggtcctggctgttggtggccctgacttctggcaggaccctgaggagcagcaccagagcctgcagatcctgtcccagaggggccagacctcaggcataggcgggtccgagtaaagactcctcccctttgtgcacatgggcctgggagtgcgtgggcctaggccagggcgggctggcctctggtgtgggctggctgtgaggttcattgagcctccccagctgctctcactagcagggctgcccggcaatgcctctggggcccaggtcatttgctttagctccttgggagctctcagcaaaggagacaccccaggtgggaaggatccggctgagggatgcccaccacaggggtttcctctagtgtctgtgggtcacacagcccagcaccgtcctgaagaggctgtccccagctcgtgtggggtggctggcacccccgactgtcagcctgtcctgtgattaaatgagatcacaacctacagggtgctgccacccttaaggctgataaatgccatttataaactccctggagcaaatgccaaactttccaaggtggggttccaagaaaggttcttgtttttgtagagatggggtcttcctgtgttgcccaggctgggctcgaacccccggcctcaagtgatctccctgccgtggactaccaaagtactgggattacaggtgtgagccaagtgtctgccagagaggttcttaaatgatttgacactggcttttcctcaagcgtttctaaaccttctaaatgacaaccactgggacctgcgcaagacgagtgatcctggctggaaatgaacctctgaacctctccccagatgctcttctgttcatccctctgctgcctcaacttccccaggcacaaggggtctggactcttctccctgtcttccccacctcactcaatagcagctccatccttctggctgctcaaattcagacccctggagtcatcctggactcttcccacaacacccagccctgatgggctgctgagtcctgctggctctgccttcacaacctacccagggcctgcctgctccttccccatccactccaaccccagggctacaggagcctcctcctgggctcgctgctcctgacctggcccctccatctctgctttggacagtagccaaacagctggaccgtggccctcctctgctcggcccctcacctctctggccccacctcccaccttcagtcctctcctctgcccgagtctcctggctgtttctgttccctgacaccccagagctcagtccctcgcccactttgggtctcacttgactgtccgctctgtgcaaggctttcaacatcatcctactcaacactgtcaatcactcccaggactccctctactgccgtccccgcttttatttttccacagtcctggtcactattgaatgcactatgtattttacttctttatttgactgatttcccctctagagcttcacagatgggattccttctgttgtgtctccccagctcctagaagagtgcctggcacctgttgttactcagcacgtgtgtaatccggtgaggggcactggcaggctggaaatgacgaacactcaccagccaggtgacagggcaggtccatgggcagcctgacttcccaggatgggtggtgcatgatgggcacccatcagcctgcttggccgggagcagggagaggatcgggagacccaagctgtactccaggcaaaccctctgaatggtcaaattggagttgtctgaaatggacaaccctacaggtaatgtttagatggttctggccccacctatggcatctggaaacgatgtctgatcctgaagggatgatgagcctggttctactatctccaccaagcccagggagctcagccctggctctccaaggcctcctgagatggcaccttcagaaacacgccctggcatttaacatctttcgggtgaggctggcctttggccctgggaccacctgggaacggttgccacatgcacctcattacaacaccaacacgtgccccttatcagccagcccagtagtgcagacctgattcctcgataaccactgggctatcaggctcactggggttggtgaccacatccccaggaaatacggccgcctgcaagagtgcacagtcccggggaggccgccaccttgctcagacctgcacgtctttgcgcccagccaggctgaatccctggagggctgagtgaggagcccacccagtcctccttccccaccaccagggtaggaggcagccctgttccttcccttcactcaggagcatttatgagcgcctgctgtatgcctgactctgccacagagaaaacagtgttggggctgcagcaatggcccctggcttcctggctgaggccgaccttgacccagaggtggctgggggatctgagccccttcccaggcagtctctttccacttcatcaggcagaaacttcttcctcactagagctggcctgactctggtaacatgtcatttgtcatcataattcataatgcaataggtatttgtcctttttatgggtattttaaaactagaacttctctgcaagacaactgtgcctttccagtgccctgcactgagacagtaactaccgggttggaagaagcaggtctccttctgtggggcagagatcaccatggaaaagtggagcacaggccctggggccaaagatcagggttcaaagttggcctcccccactagcttgtggtgtgatcttggacaggttactgagcctctttgttcctcacctgtaaaaggggcttaataatagtccctgggcctggcacagtggctcatgcctgtaatcccagcactttaggaggccgaggtgggtggattacctgaggtcaggagttcgagaccagcctgaccaacatggtgaaaccccatctctactaaaaatatgaaaaattagccgggcatggtggagggtggggggcacctgtaatcccagctacttgggaggctgaggcagaagaattgcttgaacccgggaggcggaggttgcagtgagctgagattgctccattgcacttcaggctgggtgacagagtgagactctgtctcaaaaaaaaaaaagcctgggcgcggtggctcacgcctataatctcagcactttgggaggctgaggcgggtagatcatgaggtcaggagatcaagaccatcctggctaacacagtgaaaacccatctctactaaaaataaaataaaaaaaaaaaattagccgggcgtggtggcacacacctgtagtcccagctactcgggaggctgaggcaggagaatagcttgaacctgggatgcagaggttgcagtgagccgagattgtgccactgcactccagcctgggcaacagagcgagactccatctcaataaataaataaattaattaaataaataaaaatttaaaaataaataaataaaataatggtccccttactcagagggttgctctgagaattaaaccgatcttacctgtcacttaattatagacacgtgcagggcccacaccagaggctggtatgtggtcaggcctcggggaacgtccaccggggctgtccactggctctccccacagaactgtgctccacgggggctgggcctttcctccaccgctgcctccccagggcccagaacagcatctggcacacagtaggtgcatcataaatgtttgctgacaaaaccaatttcctaacatttttattacccaccaaagaaactcggtacccatctgcagtcactcctccctgctttctcccccacggtcctggaagctcattgccccatctctgtggacttgcctgttcttgacattttgcacaaatggaatcacacagcgtgtggctctctgacttctgtcactgaacaccatgttttcaagatctatcgattctgtcatatgtccctgtgcttcattttaaaaattactgaatactattccctcgtatggctagactgcacaccacactttatttatccgtgtaggagttggtggacatttggattcttttccactttggggagaatgtgagattgtaatttgccactcttgatacatgactgaacaagttaataaaaagatatttaaatagaaaaccaaaaattattattcatttaaatttattcataagattatatgcttatttatgattctatttcctacataattgctgtttataggtatgaacataattgccatgtacacaataccatgtgccatgataaatggcaaatttctttaaggatttaaatttaaaaagaaaacgacataaaaacaagtcaaagataggaaattttttgaaaacccaaataaagaaaagccttttaaactcttattccaaaaaaaaaaaaagtttgctgaacaaatgaatgggctgaaagaggagtgatctgacaggcaggtgcagggtgagggggtgcgcgtaatgggtgtaccatacgcacatgcgcatgcacacaagcacacagtgtgtcctcaggcagggagggtgagaagagtgtgtaatgggtgtacatatcacacacttgcgaacatgcgcgtgcacacacacacacagtatcctcaggcagggtgagaagagtgtgtaatgggtgtacgtaccacatgcacttgcatgcatacaagtgcacgcgcgtgcgcgcgcacacacacacacagtgtgtcctcaggcagggagggtgagaagagtgtgtaatgggtgtatatatcacacgcacttacgttcgtacatgggtgcgcgcacacatacaaagtgtgtcctcaggcgggtagggcgagaagagtgtaatgcatgtacatatcacacgcacatgcacacacacacgctgtatgtcctctggcaggcagggagaggggtgcgtgcaataagcgcatacaccacatacatgcatgcatgctctcaaggctgggacatggaacccagccaggctgggacagaaagcgcagcgccagcaccctggggatctctctccattcaaaatcatggacttcataaaagcataggctgtgggcagagcctcagaggtttaagcaggaaacagcgactgtgaggctgggatggaaaaggcagcgactgatacagccccggctgtgtcccggtaaggggccaggcagcggatgcatgccatgtggggcctgacttagtctagacactggctcaatgccactgggtggtggggactcagggcccctcctcctccccttccaccccctgcatccaatccacaggtgagcgctctcagcttcacctccaaactcaccctccagccccctccctcccatggccaagcctaccagtctgcccccatggtagcctcctcactgtcctccccacagccacctccgtccactcaccccccaaagccaagccccagctgggccaggcactccccagctcccagaaaccacttagtgtctcatggagacctggctgtgtggcccactcctctcttacccgccacaccccatccaccatgtctctctccacgtggcaagtgccggagatcctcacccctctcggcctcagctcaagggtcaccccattttcctggacaacattttatcacagtgtgtaatcctcccacttgtctgtctcctactttgggatgttggctgtgtgtccaggctgaggccagcccagcccttcagaaagctggaggtcaccacagtgaagtgcaacgcaggctccaggaccaacgccaaggttcaaatcctgcctccccctttagcccacagtgtgatgctggatggattactcagcctcctcaatggtcccatacacagagggttgcttcgaggattaaatggatcttgtccctcatttaactacacacatgcagagggcccagaccagaggctgacacatggtcagggctcaggaaatgtccactgggctgcctgctgcctcgctgctgaatcagcatgtatgaacctacagataaggcaccaggcctcgtttctccagagaccaaatgcactattttaatcagctcaacagtgttcccccaaatttatacatcaaagccccaatttacagtgcctcagaatgtgactatttggagacggtgctttaaacaggtgattaggctaaactgaggacattagggcaggcctaatccactctgactgttgtcctgatatgaggacatctgagcatatgagagagaccccagggatgcgtgcacacagaggaaaggccgcatgaggacatggcaagaaggcggcaagcccaggagagaggcctcagagagtagcagccctgccgatgccttgatcttggacttccagccaccagaagggtgagaaaacacatttctgttgcttaggccaccaaggctgtggtcttttgtggggcagccctagcacactcacacaggcaccttcaggccagagggtggaagaaaggaccccagatccaccagtgagtgtgtgaaccaccagggcctgcactgcccatgacctgagctctgaactcgagtcccaccaggctcaaagccaggacctcagaggacatcagacaggtgtgatgagtcccttcccccaagccagctctggccacagcctgctgcccaccaggagcggcctgaattattccccgtggcagaagagagaaatccacgacctctagcctgcctgcccctgcccccaccaccaaggaagggccgcctgtccaaaccacctggaccccgcagcctgttcgggattcatttctttcctcttcaaagcattacagattgattgccaagtcttgccgtaaatcaaaagacagtcactactcattacctacttagaattccccgagttcttcctgggaagccatttctcatctgtttgatctcggagccaccagcactatctccaggcacgccacccatcacggcagccgccagacacttttttcttctgggctcctttctcagcacctagatgaatttctacctttctccagctttaagaagagctgccaagataaatgattcaaagactccagctcatgctgaaaatatatggactgcttaaagcctattatgaatcagccaacactggggagagacgcactggctgcatcctcaccggacgggtcatcctggctgctaagacctagacccacccgggcacgtggacactctctggagtcttttcacccgtgggatcatgacacttgcccagcttcaaccagcaccaggtgcccatgccatccccaagcctctgcgacctctcagcacagggtggccgagagccccacagtcacatgctggcctagcagaagtgaggggtcccctgtttgcacagtgcatccaggaggaacttcggtccccagccttgaagctgggaccccttttgcaaaagcagcatgctctcagccacggctgctcaccacccagaggggagggcccagcgggcatcaggaccccgcaccgagggtggtgaggcctttctgccacctctgctgatagggtcccaggaccacggctttccgatgtgcctcccactgtccagtctatgcgccagtctccacagccatcagcaggccccacgaagggcatctagcccctcttatcttgctgggatggacagtaagaaagtaaaacagcaccagcaaagcccagccaggctccgactcaaccagccacccagacattggctgtgtgggggactagaccgccagggccctccagcaatgaactgcggtcaccttgggctggagaagtagctatggtgcacttcgccctagctgggatgcccaggagggccacctgtgccaccgtgctgcttctgaaggttgtgacatgggaagagttctatccccaggtgcagacatggaggtcagcaatcaccactcaccaatgaggggaccccaagtgctgtcacaggtgcatccacaaggcttgtggcacactcatggagggtggccccaggggaacactgctgcaccagtgccggatgactgtgggtgaggagggacacagactcatggaccctggggctctgcctccacaaaacgggcttttctaacaagagggtggaattcacatgaaggaagctggctggttctgtgggcagcagtgacaatgaccccagatccatttcccgctgtccccctgccaagttcctgcaggtgcaggagcccgggatgcatggcagtgacaatagcatttgtgcaggcagggcaggggcgtgctagcccaggccaagtctgaggcctgtcactgacatgggatggagcctgtgcccaccagcagcctggctcctgggcatctaggcctgttcaaaacctgtaacacggaagccaacagaaatccacagccagagggagctgcgagaggacggtggctgagtgggtggggccaggccagtttccctcctgctcagccacccccaagatgcttcctcaccctactctggggcagctgaagaaggcagctgtggccaggcccatggctccctcctggacagctgccagaggaagcacgaagacccacactgcccatcctccatgccacagacagagtccaaaccctcagcctgaaccacaaaggcagaggatggccttgtgcgggaggttcctgaggacgcaaactcagcttcacagccccggaacacagagcctgctgtcggagtatctaacagggatggggaggagcctcaactttggttttatcataaattacctccaggcttcaagagcagacatgcctgccggcaggtatggagacagcccttcctggatgaaaccattcatgtcatccacagaactcagagctaggaggagaaaaactcacggcccggaataattactcccgcagggagcgtctttcgcaccagcaggtgataggtctggatgaggattttctaaaaaccggcaccaaacctcacagcataatcactactgcctgcctgttctgggagccaaacctcaataactgctcctgcggggctgctcctcactagatgcgcccaggacttggagccacgccttctcacgggcagaaccagacaggacacagccacctccgaggtgggcgtctggtccacctgcccagctaaacaccctcccatctaccacgggctccttccggcatggaagaacaggaaaggctcctttagagtgggggaccagctccagaggcctggaggcacccacaggagtgaagctggccaggtagtggcatgcaaaacagaaaaaaaagtctttttttttccccagagctctcctatttttcttgaaatacatgaccctttcgactatcttttttttctcttttgatagagatgctggtatgagaaggctttctcatttatgaaagaaccaacagcatgaaagccatgaaaagagtcggcttcagtgctcggggaggtgacggggagcggtggggcctgtggcgtgcaccctgaacgaaagctatgtagcaagcaccacgctgctgctctgtggaaattccagcccacggttaccagctactctgattttcaggaaaagccaaaaaaatctgatttttcaaatttggttgacttcaatgaaccaaaataaagtgttaaaatacctattgcctgggccaaacggaaactgcgtgtgtactggatgtggcccagaggccaccagtatataaactctggcctttctcttgctagaaaattcttcctggagaatgagaggtggggacccagggtttccccacactccccaaccaagaccctgacgggacagaggcccccagaggctgcagtccactctcacaggggcctcgggggaaggcaggcagcaaatgggggtgtggccaaagccaactccaggtagctggcccactgtagagaagacatcttccatgtccaccgaggtgactcggtactgtctggaccacctggtgcaactcatagccccctcctcagctcctctggggtcgcccatcttgcacagtgaacctacaagcaacctaaaccgttcctccccctttcttctgggcctgagcaatttcagcagagccccgcatggtggggtcaatcagacagctcttggccagctgtgcagaaagagccagagaggtctcctgggtgaaaaatgagaggaaacctaaaaagatccaccagcccatgttttctcaggatccatgaggagagctcaccggagaagcctgcgccaaaacaggaagggaccaagccacaaaatgcacacaagaaaacagcagcagaacgagtgtgcagggtcacagcaggagaatgggagacaggcttgagtttctcactggtgcgcaagtggacatcatgagaggaagctaacagccccggatcacatccaggagacctagtacgtgaggaggaggaatttcaaagatgaccctgagatgcagaaagctttcactgctcagatgaaagaagtcggtcatagactatcgcaggtgctcacagggaccaccccaggcggtgtcccaatgtgcatggctccgatcccagcgggtgccacgttaccttctgaaactgataaggaagccacagagaaaccagggaatgaaatctgtccggggtgacatgatcaataattatatcacaggtctcaggtagcaggacccaaggggatgaatgcttgcctctgggagtgaccagggaggtaacagacaggaagcagagcatgtgatgcccccgcttgggtgcaggagtggccactgccactggcctgtccactgtgtgcagaccagccttgctggtggccaagctgcctctgtctccgcagatctgtcacatgcaccacctggtctctgtgttaggtgtgactgcttcttcttgactttttatcagtctaggtcagaacacacccgatgtgaactttatggcctgagttgctcgtccctccagaccccccgtgctgcctactggctgaagaacttggaggctaagcaagccccggcttgtgccccttcccaaggagcctgccttctcctggtcctcccagacagctggcaggattctaagccctgaagtgcagcccctgcccagaaaggcagtgagacagatcctcaggaaatactgttacttccaagaatcaatagtcctataagcatccagggcaagaaaatgaaaagttccctggaaagaaggaggaatatgatttgctaaagatctctggcaacaaaggagggaatggttttatggaacaaagagtcaatacccactgaagccaccattcacgcaggagacaacaaaagaaccctccaacaagcaaggcactgaaagtactgaatcaaaacttaaagcactcacacgagcaaagggaaaacatggtacaaaattgaggtccacattggattgagtgagacagtgctcactaaataaccgttggtaaaatgatggtaagacaatgcaaatgttgaaaataaaggaaaaagaagttatataataaaaaactagaaggtaggggaaagggagattataaagtaaaactgaggcaggaggcgggacttgactctggaggcggggctcggacaccagaccaaatggagaactagccaaaacaggtcccaggtaaaagcagctttccatcagacacgcccaccagtgcgccatgtcagtttaccattgtcatggcaacaccagggagttaccacccctttccatagcaatgacttgatgaaccaaaagttactaacccctccctaaaaatgtctgcataaactgccccttactctgcatgtaattaaaagtgggtataaatatgactgcaaaaccgccctgagctgcggctctcagcacactgcctgtaggtagccctgctctgcaggggtagtcacggagctgtcacaatgcctgaactgtaacaccgctgctttaataaagctgtttcttcctaccctactactggctcacccttgaattctttcctgggtgaagccaagaaccctcgtgggataagccccactttagggcttgcctgccttgcatcaaaactatgctaagtttctaattttttaaggaaaattttctagttttttaaggaaaattagaaacttaaaattgttaaattgttaaaattagaaaattaaaattgtttaacttttgaacataagtagaaaacagaaatacaggtctttttttcttgatttaaaggtgattctacatttaacatggcatacatataaaagtgagcaaaggaaatttcaccaaccttccaaagatagaaaaacttttttaaagccacaaaggaaaaaacagaaaccagaaaacacaaaataaggctgtagaaaagagaacagatgctgattatcactgtgaattcaaacagctctcctaacacggggaggctctccatttgaacaatgagtatgctgcaccttataaacaacctattttaaaaagttaaaaatacagggataagcaaagatatgccaggaaaatgtaacaacaacaacaaacatagcaacaccagtgtcaggcaaagtcagattcaagacatagattaaataggttaaaaggggtttcttgaaagctataaaaagcaaaatatataataaagacataacaatcatcaacttttatgcctcaaacaatttatcatggaaatgagtaagacaaaatctatcatgaatcacaaagaattataaaaccatctctctaaatcttagagcaaatatacaaaaataggggagggggcagaggactggaattagataataaacctgattcatgtacaccaaagtatatattctaaagataaaaactaaacactttccagtattccataaaatactgaccaaaatatttttaaataagccacgaagaaaaacttcaaaattaaaaaccaaaaagattcacaccagctgcattctctagctccaatggtgacagaactagcagctaaaaaccaaaaggtcaccaagaaaaattcaaccacatctactgggaaatgaaaagaaatacactaggttagttcttaggttcaaaaacaaatcactctagacataccaggatatagctaaggcagtattcaaaaataaactagccaaaatctatttattactaaagaggaaaaaataaaaaataaactaagattcaactaaacaagttaaaagacagatgcgtcaaaacaaggttcaggaagagaggagaaaggaattaataataaaactggaaatcaatgagtttgaccaacagtagaactgaaaaataaatttaagagctgattttatgaaaaggccaataaagaagataaaactctagcaattataatccatagagaaaaaacacaagttacattaggaatgagaaagaaaaaacagctacagatataaaggagatattttaaaaacataagattttaaaaatatatgagaataaaattggttacttggttacaatgtaaaatctttgatgaaaactaagactttataggaaaacatacttactgactctaaaagtgatgaatttggactaaaacaatcccataggaaaatctgaaaagttaccaaagaaatcttccccagagaaacaacagggtctgagagattcaaaggacttcatgccttcaagaaacagccaagccctatgctttccaagttgtttcagaaaacagaaaaacatgggggtgcttcccaaaacatgatctcaaaaaccttggtctcaaaatatggctaagagagttaaaggaaaaaaatatatagctcaatttcctattttgagcctgtataaaatgctagtgaaaaaataacaacaatggccaggcatggtggctcacgcctataatcccggcacttcgggaggccgtggcaggaggatcgcttgagtccaggagttggagaggcaatataatgagatcccaagtccacagaaaaataaaaaattagccaggcatggtggcacgtgcttctagtcccagctactccagaggctgaggggggaaggtcacttaagactgggaggttgaggttgcagtgaactgtgattgcaccactgccttccagcctgggcagtagagcaaaacactgtcataaaaaaataaataaataaataaataaataaaaaagcaacaacaagcaccataaggatgcttagtggatgtccatctgctccatgtgttatgcatacaggcatgcctcatcttaccgtgccttgctttctttttttagaaattgaaggtttgtggcaaccctgcgtttagcaagcctactggtgccatttttccaacagcatgtgttcactttgtgtgtgtcagcattttttagcaataaagtctttttaaattatggcatgtacattgattttttgagacataatgttattgcactcttaagagactacagtatactgcaaacataacttttatatgcactaggaaacacgaaaatttccaatatttgctttattgcagtagtctggagctgaagccgcaatatctctgaggtatacctgtatatcaattcattggatcctcctaatcctcctatgaagtgctattatttttttccagatgaggacactgaggtagtgttatcaatgtgcccaagctggtaatcagcagagctgggacccaaaccaagaacactagtctctggggaccatgctctacccactctactatactgcctcctaagtcggcttcttaaagtcctgataaaccacaataaagtagtgtgtactgggatgcctcactggctctgcaccaggacgtctggtcataaaattcatctaaggtgcacccagcacccaatcttggtttctaataccatcctccaataaaaggaaccgggctccttagtgaaatggctaactctgaggttggagcagggaacagacaagatgagcccggtgcaacccgcaatgccagaaaggaagggaatgctccaaaactaaaatgacggggtgcatcagaaagacacaggagtcaaacgaaagagccctcgatgcccaaagctggaaggatttgagcatcacagaatactggattataaagtataaaataaatatccatgggtctatacaagttttttaaaaaagaggccaggcgcagtggctcacacctgtaatcccagcactttgggaggctgaggtgggaggatcacttgagggcaagagtttgagaccagcctggccaacatggcaaaaccctgtctctactaaaaatacaaaaattagctgggcatggtggtgggcacctgtaaccccagctactcgagcggctgaagcaggagaatcatttgagcccaggacgtggaggtcgcagtgagccgagattgtaccactgcactccagcctcggtgatggagcgagactctgtctccaaaaaagaaaaaaaaaagaaagaaagtacaatttcaagtttaaaaaaaaaaggttgaacaaataaataaatgagggagaagagacaaatgtgtacagaaggatcacaaatagcataattcccatgccttaagtgtgggtggcacacagtgactgctttccaagagtacagaagagtgggtaggggagtgactttacagtggagaaacctgacaagcactaccttagccaggtgatcaaggtcaacatcatcagtgataagtcatgctgatgtgatgtgatgacaatggcacttctgtgctctccttcccagtaactcataactcctgtctcgctgaaagaaaaactaaaattgaaaggcattcttcaaagtacctagccatactcctcgaaagtgtcaaggtcatcaaaaccaaggcaattctaagaaactgtcacagcccagaggaggctaaggagatgtgacaatggaacgtgatatggtctcccagatgggatcctggaacaggaggagggcattaggtaaaagctaaggccgctggaataaagcatggacttaagataataattaagtatcaataacgtgcatccatggtaacaaatgttctaaagtaatgttaataactttactaatacataatagggaaaatgggtgccaggtacatggaactctctaatgttcctgtgacttttccgtaatccaaaactatcctaaaataaaaagtttactgattaaacacacacgtggaaaaggccaagggagatgctgaaaaggcagctgataaaattcgacatcctttcctgataaaatctagtaagccaggaagacaatgctacttccttaaactcgtgataaatatttatctgaaatcaacagtcagcatcaggtttttggcttttttttctctttttttttttaagagatggagtctcactctgtcgcccagatgggagtgcagtggtgtgatcatagctaactgccgccttggcttcctgggctcaagcaatcctcctgcctcagccttccaagtagctgggactataggggtgcgtcaccacactcagctaattaaaaacattttttttttttttttgtagaggcagaggtctcctatgttgcccaggctggtcttgaactcctggcctcaagcaatcctcctgccttggactcccaaagtgctgggactacaggcatgagtgtgtaattaccatgcctggcaatatcaggtttaatggtgaaacactagaggaaaatccataaagatgtccacagggagcacagttccttatgatttctaatatgattctccaggagcaatgcgcccagcatttgaaaagacaatgcctatttatgttagttttgccccaaaatctctagtccttcatcgaccaggttacacatttgcagaaagctcttctctctggttctctgtccagctttctggctggacaccaagttggttttctccacatgcccattcctcagttactcctagaggcaaaatgagccatccctgctttaagccacagggtcccacagcctgaccccgctgagagccccagtttcattctcggatccctggctctgtcgaatctctggtggagagactctccacactcgcctgtccccaactccctccctcatgccaagtggtgtagacacagcaggatggacgggcacacaggacctgccctgccagcacagggtaggctctggactaaggaattctccacccaagacagccctggctcttgggaagggctcagcttaaatccccctaggcatggccagccagggtgcaggactcaaggactgccctcctagggcttggacacgcagatggtgtttcctgactgctctcatgataggctggggcccgtctccaacagccaagcaagtgctagcagcaaacctactccaagccacctgaggcaaagagggtgtttctccagcccagacctgtgtctgaaggggccctcttctctgaatgggctgtgccagtgccctcacccatcaacacagccttcagagaaaggatgtgtctgctcagcgggtgcagggtcctgcccacggacacacagctggtccccagggcccatcacatccattcttacctgggggctccggtctcagaggccgcctggacccagacttgttccaaacagtcctcaaaactgcagcaccctttgtgggggtggctaaatggatggcagtctcactgatgcccacatttgtccaggctgagagcagattaggtcagactgtgcctggatgatggagactgcatctccaggacctcccggaggaagacggggacctcctagtgacttccctctccagtgaaacctgcgtcctctgcatgccctgtgaggggccccagccctggtcagagacacacaaggtgtctcaccatccacccagagtgcccggcaacacagcctcgtgtagccccacacgggaggaggaccatgtgggcacaggcatccgagatacagttcttcaggagtcgctgcacaggagggactcggatgaaaagcagagggtgccaggccgggcatagtggcttatgcctagaatcccagcactgtgggagaccaaggcagcaggaatgctagagctctggagttctagaccagcctgggcaacaaggcaaaactctatctctacgaaaaataaaaaattagctgggcaaggtagtgagcacctgtggtgccagttatttggggggctgaggcgggaggatcacttgagcccgggaggcagagattgcagcaagcagagatcgccccagaggggcgtcctctctgcggccccacgccccctgcagtcctgagcactgtgggctggcagggatgaggggggctgcccacagactctcccacctcctggctgtccttactggagtcaaagtttctagtcttttttatttacttattttgagatggagtctcgctctgttgcccaggctggaatgcagaggctcactgcaacctccacctcccaggttcaagtgattctcctgcctcagcctcccaagtagctgggactacaggcgcccgacacctagcccagctaattttttgtatttttagtagagacgcggtttcaccgcgttagccaggatggtctcgatctcctgactttgtgatctgcctgtctcggcctcccaaagtgctggaattacaggcatgagccaccacacccaacacccaaccagtttctagtcttaaaacaagaaaacaaacaaacaagcaaacaaaaagagaaaaaaatctgtcctgtttaacaagaatgcagcaaggattttgcaacctgctcccaggctggattcacggagagctccaaccccgcccccagcaccctcggctcgggtggctctgtatgggttggggggcgggtatgtatgtggtatgtcaatgggtgtggtacataccgtgtatgtgaggcatgtggtgggtggcgtgtgtatggtgtgtagtgtgtgtatggggatggtgggtacatgttgtgtgtggtgtgtagcatatgtggtatgtatggtgtggtgtgtgcatatggctgtggtgcatgtgtgtggtgtgaatgtgtatggctgtggtgtgtgcagggtattggtgtatgtggtgtgtggctgtatgtggcatgcgatgtgtggtgtgtaggtgaatgtggcatcagatgtgtggtgagtgtggtgtgtaggtgcatgtggcatgcgatgtgtggtgtgtgtggtgtgtaggtgcatgtggcatgagacgtgtggtatgtaggtgtgtgtggcaagtgatgtatggtgtgtgtggtgtgtatggcgtgtcatatgtatgcagtatgtggtatatgtgtggtgtgtgtatggtatgtggtatgtgggggttgtgtgtggaggtgtgtatgtgtggcgtacatggcgcatgatgtgtatgtgtggtgtgtgtgtggtgtggggtgtgtgtgtggtatgtggaacgagtgtggtgtgtgtgtggtgagtatggtgtgggcggtgtgtatgtgtgatgtgtgtggcgtgtgtgttgtgtgtggtatgtggcatgtgtggtgtgtatggtggaggtctgtggtgtgtggtgtgtggtatgtggcatgtgtatgtgctatgcagcatgtgtgttgtgtgaggtgtacgtagtgtgtatggtatgtgtgggggtgtgtgaggtgtgtgtggtatagggcatgtgtgtggtgtatgtggagtgcgcaggatgtgtggtatgtggtgtgtatggtgtggcgtgtgtgtcatgtgtgtggcatctggggcatgtgtctggttgggggagaccctcaggtcgtgtcccctctccccagcccatctgtactcgaggggcgctgggcacacagaatcacaacttgctccatgtggccaaagagtaagaaaagcaccaaggccttgaatgagaaggagcacagctgggcaagcccctcactcacaagggactgacggggacaggagctgcgattgagggctgtcgcctgtggcaggagcgcccagaaaagcccaggcctgtggagaagggtctccagtgggtcttggcctggaaggggacgccaccacacggtacccgtcacactacacagatcctctccctttcccatgattctcatgaccccccagaaacaaaagggccccaaatgccccattcacagctcagagagaaagagcataatttcaatcaaggtctcaggctgtcatacacatcgcgttattaatctccttgtggcaaatgtgagctgggactcgcttacacagccaatggagcatgctctaaattagcgtttgcaggtaatggatccggccgccagccccacgccagctggctacaagctgggtacgccactaacatgaaataataggaggcggaaaaacggatggcctgattgggcctgctgttagagcccaatttacccaacacggacgtcttattggtttaacacaatttactacacctcaattgcggaaaatgattttcattcctctgaaccctcaactcccaggcgccgcatgagggaggagtcttcataaatgccatccgctcgctcactttttttttttaacatgccttcaagattttataacaaatcatagataataaaacaaaaacagatgaggcttagaactggaggtccaggccaccatcgcttgagtcctggggtgggtggtgtgtccaccttcgagaaaaccagccctgactcctgccccgagtcctgaactgcagagctccctgccttcatgcccagtgtccctgtgcaaggctgaagccagccaggcccccagcagaaagtccagcaggtcttaaggatgcccaccttgctcacagggtgctgtcaacacatatagaagagcggctggtttcctttgaacccagtgagtcagcgattcacacagcagtgcagctgccccccagccttccctggtagcagttgagcctgtgttcaaagaggcacacccccgggtaaccaaaaacacgggctttagaagagatttttattccccgactagttaagaaaagaattctcaagttcccagtgacacagaagatggcagaaaaatcacttaaaaccttttcttctcttttccacccacatacatttcccgacacctacagtgggtcagacaccgcgcagataaatgagacatggtccccaagaaggcgcctccaggctctccaggacaaggaccacaaaactgcatcacatagtgatcctgccctggagagggagctcgaggcggaagaagtgtcagcccacctccctggctgcagatgtccccaggggcttcaacctggacactggcaatcggggcgcctcctcaaatctggccagggatactccatgatgtgacactttccccagacacccatcttcccaccatcttcagagggggtgacccctctctcccaactcggtcccctcaggaacagcctccatctcttgttcttcctgtctcagtccccgtacccacccccctgctctaagctctcaggggcccacagatcagatagcttccctggtgggcacggtttcccctccctatgtcctgtggcctgcagcaggtgggtgcacatggcaggtgcacagcatgggcagcaggtacacacgctgacccgatgccactcagcaccctgtgggaggctgctcctggctgagagcttcccggtgcactcggctgtggcctctggcttcgagctcatctctccaagagccactctggtccacgcaggaggcggcagcaaggccaacccagggtcttgggatgggggtggagggaaggtggagcagtttgtagacaggggtgacatctccccagagctcaggttcacgacaccctgcttccaacagcagccaagtacaacatgtggactctgtgtggatcctgacttgaacaaaccaatgctaaaaagagtttaggatcaatatggactagatattcatgacatgaaggagttacggttcgtttgtgataatgaatgtgatattggcatggtggttatgtaaaagtagaaaaaagttctcaccaactggaatacctactgaggtatttacaggtgctatgacacgatgtctaggatttggctttaaaatgctctagcaaacaaaactaaacacaaaaacctggtggggactttggggttcattatacttttctattattttggatactgaaatttcctgtttaaaaaaaaaaaaagacctccattacctggaaggcatgagggctaaggaacggcgggtattccaggtcccctggcccctgacccatagcccatgcagccctgtccccaggttgggcagggtcgggctctgggacgctgtggggagggaggctcagggcccctcccagtagccaccttgggagcaggactgcctgcagcacggggctcaagcagccagcatgcagaggacggcagggttccacactgggctcagctattcctgccccaatttctcagttatttttatttgaagcatcagctatgggtcactgtgattcaactcaagctgggacaggtttccggggcagtgccaatctgagggacccactgtccagcccacctcgctggaggagccccacaacacacttcccatcccagatcctcggagcgggcagggggtcctgggaatgctgggccacagacaccgcactgcagaaggagaccacgcagacgcaagtgctgggatagctctgcgagcccttctcagcctccccggctgacggagctgggcttctgattaacgtgtgttacacggcccctcccaggatgccaagcacctgggtcaggccattttaacctcctcctgggcggggtaaggagagaagcacaggcactgactgctcagaactccttccagggcaagaccttaaaaagacactcgtcccctaagcacagccacagcgaactgaagcatccaagcagcccactacgggccccatccgacctcggccctgcaccccactgatggcaggcaggccagcctgggagggtgatatggagccagcacccccagggccggggctctgaacagagcaggccctgaggacatctggggtggacttgggccctgcaaggggggtaagggataccagaaaccaagctctcacaaggacaggcaggaaaggaaagcccagagtgaggacatggggatggcagcctcttcagtgtcacctccccagagcttccaggtggtaccaacactggtgggaggtctcggaatgggggcctcctgccccaggacacgggtgggaagggagccactgaggcagtttgggtctgacccaaaggtttccttgtaccatgggtggcagcacactgacttctgggtcctggagcggggctgagctggccaggccacacccgccacggctgggcagccgccggaagctccccgggtgccactggctcgctgcagccctaataggagcagaaggccaatggagctctccagagctctttatgggccatttaaccatccctcaacccagtcgcccgagcacagcagacataatggcagtgtttacacataaaaacggcaagctgttttactggcggctttcagagtcataagagcagcaatttggtaaagtttcctgcaaatggcagaaacaaagtccgagagtagaatggtggggcactaaaccaccctgaaaagtcatcgaaaaccattacatcaaacactctgccaagagccagggaggcgggcgcagtcagaagaaaaataatctttgcttgtgatcctgaagccctgttcataatctccgctcacggtgtgtgtgccactgcggcgtctcatctgttactcactcagggaacataaattactgttttttaccttttaattttacccggagaaacatggtggcttacctttccaactcatattctttcattcccacttttacagccttcattacctggaggacggatattaagcaaagacatttgtattaagcagatcagtaacacagcgtgataaataacatacagcacttcttcaaaagcacctcttctttaaaaaggaaaaaaagaatgatatgtgcatgcagtggtacagacatgtgacaaattagaactttttaaaagctccaaaatccatacagtttatttaaactgctatgaagcacttccatttggaagccgataaatgccatgcctcaagttacagctcagaggccaccagcagcccgaggacagtgaggatttaaccacgaggtgcttggtgaatacttaatgccacgaaagctatgacgatcactaaaaggcctcctttgtttaactttcataaaacacggagagcattatctcgtacaacagagtacgctgcccatcaattacccttgtctgtttcctaacacaaaactgcaatgttcctgagcagacggtgggccatcctcatctttcaagacatgtgtttccttatttggtctcattcctccagtaaagcgggaaggtttggaagagaaattttcagaaaatggatgatggtaatcagtgtgtttgaaccacagttaaggacaaaagattctttaaaatgagctgagaactgctgggatatgaagaaggagcactctaccctcccagaattgggactttttgttggataatttcctgaggattagtgtccacgactgcatgatgggcaggtgccctaagctgaggaattggggcagagccccttctgtccctgccctgtgcccaccagggaacagaaaagagaacaatcactgtgtaaaacttcctacctctcacttggccctcagggattagagcccacctggaaacccttcatcctcacgcagttctctcgccacacagcaacactgctttccccactcaaccagagccggtgcctgacttacctcacggtgggcctcgctggagattttattggtatagcgcagaacctccagctccatatccgtcttaaacactcggcttcagagacagaagaacaaagcagcaaatcagtgactttcaggaggcactggctggacccctccagggagagctcagggcctaccacaccctgcacagcccagaaggcgtgttgtgcaaggccagagtggggccaccaaggcccaggagtgacaagctccatggaacagtctagaagaaaacctctagcagggagcagagctgctgcccaccttccctaacaccagccagcgggcagactgtttccagggataagatctggaagccgctgcggtgggagaagaagcctggttgctgcagcttgtcacaggctgcctccctcaacctcagtttccccatgcatggaagggggatgaaatctacatggcatggctactgggccataatcctaagcctgctgcctcccagggctctgtcctgttggctgaagaggcctcgtttcctccccacccccacccacctgcccacgggtgggtgacagggtcaggtgaagggacagaagccattccagtttcgtgtgtgctggtacaaatgtggaaacagctggacagcagacacagcaggagaccaggagcagagaagagggaggcagccacagatgagagggtggtctacgtgggcaggggagtcacaatcgagggaccctgctgtcccttcctggctgggctgtgcctcctgcaactggactcctgaggcttccaggtcctcccaacaaacttgtgttaatttgcccaaatgtggttaggtttctggtggttgcaatcaatctcacccgcgagtaagacccacagagaggagccaaataagtattcgttttctacctccacccatttaaaaaaaccctgggtccgcgggcacagaaagggcagccatgctgaggcattcagagcaccggcctgggagaaaggccctgggctccagttcagctccaccccttcccagcggtgtggccaagatccctactctgtgcctcggtttccccatctgaaaaacggagatatgaacactgttttcatcataggtttgcagtgagaacggagttggcatttttaaagcactaaggacagtgcctggcacacagtaagtgctgtgtacacttgttccagaaaccaagcgaaatgcaaagcctgcagacaccacgtcatccatacttcccaccccaaagccaggtggaatgctctgatgtccttaggtaggacatcttgattctcatcaaaacattactccccagtattcatgacaggcccacaaagctagagaaatctcagcaggcaaacgcagcttcccttcactttaaattgccatttactggggacccgccgcatggtgggtcctgtaagttgcagtggatgctgggtgcactgcccaactcatcccctgaggccacacccctctactggtctccttgattcgatggagggagccaagactcagctccctcgcttcagctggggacatctctgggggccactccagcaccaaaactccccatgggagcagctgagatgcccttgtgacagcatcgcagcccaagcctgctcccttactctgacacacacgctgatcctgagagcactcctcaatacgcttcctgcctacttggctcacagactcagcttcccatggaacccaacctagaacaggtactaccttcccattttacagatagcgacactgagacttaactgagacaatgtcaaagagcgcatgacccactctgttacactcaccccctttttgttgcactccatgcaaaaattatagaaccctacacccagacaaactactaaccaaatacagaaggaaactagtcctttttagacattcaaaaactcagaaattggggaagtacttaaggatgtactccagcagagagagaagggtagaagggtggggagagggagaaagcacaagccaataaagagaaggaggtgatataatgggatatttttaaaaactggagtcaatccaaaagtataattagacactggacagcaagcctagaaagcaatcagtagaaattagaactccaagtatgtggctctgagaaaaacatccacaaaaagaatggcatggattcctttctgcagataaaatcaataggaagcttaaagctcttagtgatatggtgaagaagatatgtttcttctctcaataagaaagacgaaaggcaaattaaaactctaggaacaacaaaacaaaacagatatatgtatgaaggctgcatttattcacatggtaccaaagtaacaccaggtagattactctccaggtcaagggggaaaatgtaacccagtgatcagtcttagcatcactgattgtgggtcaactaagtataatttgtgtctgaatgcagtgcaataagaaatacacatcacctgggatgtattctggcaaatgttttaaacttctatggctttagatctaacttccagtttgcaggaaatatggggatagaagaacaagctaaccaccaacacaagcgaacaaccatacaaatccagaattgggatgctgtggtacaactggtccagcctttcagtatctggggggaaaaccatcacaatacccaggtaagagatagaactatattggccacgtccaggatgtcttatggacaactggaggaattcctgtttatgtgaactttctaactttcagcaatgcatgtatatatgttgcttttgtactaatgaaaaaaaaaaaagaaataaaaatttttttctaataaaaaaaccattctttaaacagagaataaactaaaatatggagtgattttgtatagctggtggttatataagaaaaacagtctaggccgggcgcggtggctcaagcctgtaatcccagcactttgggaggccgaggcgggcagatcacgaggtcaggagatcaagactatcctggctaacacggtgaaaccccatctctactaaaaatacaaaaaattagctgggcatggtggcgggcgcctgtagtcccagctactcgggaggctgaggcaggagaatggtgtgaacccaggaggcggagcttgcagtgagccgagatcacgccactgcactccagcctgggtgacagagcaagactccgtctcaaaaaaaaaaaaaaagaaagaaagaaagaaaaagaaaaacagtttatgtgctcttgatgctaggagcctcctcttgagggaggccctgggcttgtgacatccgacccaaagagaaggcactcccgccctgatacattccttagttctgcatagaccacggtcacagtcatcatagaaacacagttttatggcttttttttttaaccttttagagttaatgtctcccccaaacaggtaagatttactgctcacataaatgcaatggaaatattacaaaccctaacaaggaaacagcaacagaagtcgggaggtaaagacgggttggagaaaagatgtgtagagagagcagggccccatctgtgcagcctcagctcacccagggcaaaggcaagatggggtggaaagttcacggagcaagaactaaaggaggctcaaatgtaggacaagaaggcaaatggaacccatggaagaaccagcaataaacatatgatgaaaagatgggtggaggtgacagaaatggcccaaagaattcgctttggggaggggtggtgtggagagagatgagctggcaggagtcgctggtttcatgataacctagctttcccgtactgattttgtactagtggctttttaaaccaagggtacatattgctttgatagcactttaaaaaccttaatgaggtgctgtccataatggtaaatgtccattcattcatttcacatcactaataagtaagtgttagctggatgtaccaggcaccggtgatggagtggagtgaaagggccacgtcctcccctaatggagcgcagagaccatggagagacggatacagcgcgagtaaacacacaatgatggagtggaaggagggctgctaagagcaggagccggggtgctatgtgagggaatgatggagaggcacgagccctttcggtttggggctggccacccggtgagggaggtctgtaatactgagagacctggagaatggaggtgggcaacccagctgagtccctctgcacaaggcagagagttcccggtgcaccccctggccagctccttttcctttactaaagatgacttacctgcaccaaagctcccaaaggcccacccgtgactctcacaaaggtatcaatgcaaacactctcaagatcagcaaagctggagtgtctgaggatgcagaccagcacccacccctctgttgggagcaaagctggggtgtctgaggacgcagaccagcactcgctcctctgtcaaagggcacctctcctgcatctcctcttcctcctcctcggcctggccaagagcccacctgagctggcctccatcgaggcagcccagacagaggccccgaggcaggcgaggatggcgggaatgcgaggggcctggtggctcccccactcccatcagaggcagcaagcccttgggaacttcaagggagcagcccatgccagccagccgctgactcacacggtctccgtgacgctgcacagctgggacagccagccatttgtcactgggaaacgaggcgggcaccctgcagcgcagcgacaccttcccgagaccacagaaccttctggggaatgtggaaaaaacaaacccacaagcccagggagactttctcgaatgaacgccctttctctcggcggaggcagccctaaagcctgacagcatgctgttaatcatcatgaaggtgtctctgatgccgccgtatggcgggtgcagtcccattatctgggaccaggcacttgctcctgtccccagagggtgacagttcagagccatgggcaggacaggggccagcagctcaggctcccgaggtccgaacccacttgtggtccctcaggtgtcattcccactgccaccctctatgacgccagcccggggaacccgctgtcagggagcaggtctctcttctctcaaatgcagtgatgatcactgggtgacagcatgggtgagggccaggatctcccgccctccaaccccttactttctcctggagccgccctctgccttcattcggcttagatccctggcccttctctatggccactactgttgccagtgctgtagactcctcagccctgtgcccacccatccccacaggctcggcctgtgcctgctccaggagcactgagcactgccaggggaagtcatgcactggcaatggccaagcaagccccagtcacctcagcgaggccccagctctgccgtgagctgcaggggaacccgcaggagggctattctcaacttcccgcaccttccgaagatatctacccccaacttctgccccccacgggagccgccacagatgaatgaattccactcctacttcttggagcgcgcagcagccagcagatgggtccactctcacctctcctcctccaaactcccaggactccccatctgtcctctcctccctcccttttaagggaaggtgcatcctcttcccaagctcacacgcccacctggggatcccagctccaacctccaccagctcctgctagaagctccatggccaccgaaacagcttcctctacaagtgaagaatcctcccctcacttgcctccttctcctcttccagtcaagcctcccctacgctgcctgccaggccctaaccgtccttgccttgggggaggagggaaagcagcttttgcgttctattttgaacttcctccccatctcctcccctctcctctcccctctttgcttctctcttcacccccatcatgctgccagccctcccctccccttctcgcagaaggcgtggttccctctgcctctccctgctttccctctgcacccacctgtgggtcctgggtgccctggagctcagtgtgcgagaacccccaccgtgcccccatctcaatgaggctctgccatcttcctgctgcttcagcagagacccgggcgtcatcctagacgccctctcccatcacatccatccgctgcttcccacatccaattcacggccaagggctgccactccccctccacgacctccctcaggcccccccatttctctctatccagccccagcctctctggcctggacaagccctccagcctctaggcctccagcccacctgccctgatagcagctggggatctttaggaaatgcaaaccttatcaggcttcccctcgtttccagtggcctttaggtttccagtggcctcaggatgaaggtaaacctctagtagagcacaactcacgtaggtgcaggccatctccaccactcaccccatgtgctctcccagcctcctccctcctctgcctggaacttgttcctgcccacctctagcacccacccgaaacacacttttctaggggtcggagacgacccccttctaccctcccaccctgggctaaatcccttctctgtgttccctgggtagtctagacgaatcctcagaaacctctaacacttagaattcttttaatttaagtctcttctgaaaggccatatatagtcctggaagacagggtcccagcaccggcacagacacacagtaactatgtgtcatcaaagctacctgtccttccaccgaagccagacaacagctcatttccaacaaggagagctgatggcctcatttcaaagagaaaaggaggcctctccacccaaccttccccaccccatggcagcatgggatgttgccaaaccgggcacagcaggggcaaagcctcctcaggctccagcagcccaaaatccctctgccactgcctcgtcccagtcccacaggtaggaagagcagcccagggtggaccacaggagcccacactcccaggctctccactctgcctcccactgcagctggggcatcctcctatggtgatgagcaggaagaggtcgtaatctgccaaaggagaaaggaccacatcctcctcccagcagaggtgataatcatctctgccatcgaggcccagggacctacttgcttttctaatcttactttgggggaagtggaaaaaaaaaatcaaactgaaccagggcaaattattctacaaaggcagttctctgatgaaaccagcctggctgggctttggcctggcccaattgaatctatgcttaaatagacgtctgctgtgtgctggcttaaccaattatccgtagggcactctgggcctgaagtctcacccaggcgccaggcatagagggatgcaccccagcctggcctggttatctcacagcacaaacaccagaaactgtttttaagataactgtagaaaagaacaggattttccagcattccgcgcagtttctccctgtcttcaggaggaatgcaccaccctgaatatgatgagcccatttccagtgttcttgagcatgaacagatgaggacaaaagggtgccccagcctccgtgggtccaccggcccctggagtgagagatgcatggtcacactcagtcccagccttgtctgccccaggggatgtgtggggtggttgttagaagtatgatctacaaggctgacagccccatgagaggacaaaggccacctcctccaggaagcaacagagaatcatggctcaggacaggatgacaaagatgccacctaagaagtttgagcaggccaggcatggtggctctcacttgtaatcccggcaccttgggaggccaaggctagaggatctaaggccaaggctgagcacaggaattcgaggccagcctgggcatcacagtgataacctgtgtctacaaaacatttaaaaatcagccagatggccaggcacagtggctcatgcctgtaatcccggcactttgggaggccgaggcaggtggatcacctgaggtcggaagttcaagaccagcctgaccaacatgcaggaaccccgtctctactaaaaatacaaaagtagccgggcatggtggcacatgcctgtaatcccagctactcgggaggctgaggcagaagagtcgcttgaacctgggaggcggaagttgcagtgagccaagattgagccattgcactccagcctgggcaacaagaacaaaactccatctcaaaaaaaaaaaaaaaaatcagctaggcatgggagtgtgcacctgtagtctcagctactcgggaggctgaggcgggaggatgacctgagcctgggagtccgaggttgtagtgagccatgattacaacactgcattccagcctgggcaagagcataagaccctgtctctaaaaagagaacttggggcagaagtcagctcaggctctttggccaggaaaaaacgtgccaggaaatgtgggcactgcacagcctcacagagagtccccagctcatggccacgctgtgggcatcaacatgcctggaggctgctcaaacagacagggaggctgggaggcaaagtctcctaccccatgtaggcctactctcctgctacagaccaaaaatcacaaaaagtagatgaggcaaagatgtacttgtgcaaccttatttttttccttaaacattcacaagtcacagcactgcctctgagcattaaaccctgaattaagatatcaattaactgagatctaaacactccactgattaaaatagtagtgagacaaggatgaaggatttccaaaatcagcctctaagcatcaaagtggcaccgtgttgaacaaaactcatttaaagggccaggaattccatctctcctggagatggatgtgcagggaatgattctattggagccaggtgggcgggaattcaacaccactgaacccgcaacaactatccctcccacactccatgacccagtgatgcaaaggataaaatcccacaaggggaaggacagaaagaaaagagctggttggaattacatatcctctggggaatcaatcaataagtcctctccaagaaaccaaagccatgaagaaaatgatggtttagctcagctgcgagctgagtgtgcctgaaacctagccagggacgggcagacgtggggcagaggtccacctccacgctggaccagggcctggccacgcctttccttctgtctgatgctcccacatccatctcctgcctcctggcgcgcagtgactcaagttctcactctcccctaggagtcccacttcccatgtggctttcttgctggcgtagggttaaatgcctattcatgaggacacaaagatgagcaatgctactggaatccttttcacagacacaccgagaatttaggtcatcatctacgtatcttttctaatttgggacatgttacccaggatgtagaatcctgggacacgtctacctgtgaaccaaccacagcttcccatctcctgtgcacacagagaggccggggagcagaaatagacatgttacccaccgcctgattaatgcatgcaggacacttttcgttctgtgtaattaacagctctaaaaccggcagatgactcaatttaacacagtctcgcttaaaacccaagaaggcacacggcaattgctgacacgcctgctctcccctgacgcttccagaggtacttaaccgaaacccaaggcactgagctatcaggtggtatgaaagcatctccttttatttcccaccttgccttcagatcaatttaatcatctgcaaaacagtaaagcagaaccacagcctaaattatggaagtaagatgcctgctcttttgaagtttcaacttttgaccttcacattcaaactgcactacccagcacaagaaaagaaattatccagttatgatctcatgtttgtggggaagagtatgattatagaggaatttacaggcaatcaaaaaggcgctccttgagagaatggaaaacaataaaacagtcacaggaaggaaatgaatgacagccgaacaaaaatgagaaagcgagtttgcctgtgctaggagaggctgcttgctgccttccaatcaagacaggctcctgaggaaccctgtgtccccagccaagctgctagcagaagctggggtgcatgtgggtgccaaggaagccaagcatctgccccctggttctccaccctactataccctggccccagcacaagaccattccaagggtgctggaccgtacgttcagtgggaccagcagtgagctgggaggatgactgacactcaggcagccccactccacgggtgccccctcagagctgcaaggagcagtgcaagagcctgggatcaacagtctgggctcaactggcattttcttgggcaagtcactaacttccctgtacctcagtttcttcatctgtagcatggaaataactagaacacttacctaatacaccacaaatatctttaaatacagtgacatgtgttaagtgcttagcacaacaccttgtacacatggagtctcaacaggtgacagtcagtgttatcaagatgtgccaggctgcagcctggctaacatgatgaaaccccatctctactaaaaatgcaaaaagtagccgggcatggtggtgcgcacctgtagtggggaggcgggggctgaggcacaagaatcacgtgaacccgggaggcggaggttgcagtgagccaagatcatgccattgtactccagcctgggtgacagagcaagacttcatctcaaaaaaaaagtgccaggctgggtgcggtggctcacgcctataatcccaacactttgggaggctgaggtaggaggatctcttaaggccaggagttcgaggccagcctgggcaacacaggagaccccatctctacaaaaaacagaaaaattagctggatgtggtggcgtgtacctggagtcacagctacttggaaggctgaggtgggaggatcgcctgagcccaggaggtcaaggctgcagcaagctacgatcatgccactgtactccagcctgagagacaaagtgagatcctgtctcttaaaaaaaaaaaaaaaaagacatgccagtccttcacttatactctcattcaatctttgagcctactttgcaggtgaggaaactgaggctgggtgaatcttcacatccgtaccatgagttaggtttcaccacatctccgttttacagatcaagaagctgaggctcagaaaagtcaagtgacttcctgagcagggaggagatagggctagaattcacatgtgcccgagttgatggtttcctgttatccccataaccctcccacagagagagggtggtgaaggcattcaagacctaagggcaaaagatgagtccctgagtcgtaatctaacatcatggaaagcccacccattcctgttaataaaggacccgcccgctgccccacacagcatccttccttcagtgccccagggagtgtgatgatcatgactacagtggacccaccgagagtgactgggacccaggctattaaaacatacccctgagcagcagggacaatgtgacatttctaaaatggttctactgccatcaactttctgctgcttgctttaataaagttgggaggtatgcttaggaacgcgggctcgacctcaaagcctcgaaaatgtcacttgaattaaagcatgcttctttgaaagtgacgaattaatgacttatcccttaggagatggcaggagtacaggacccagccatggtctccaaggcacccaagctgtaagtgaccacaagggaatgtcccatgtgaggcagtataagtggacatggcccattctaagtacccaggatttattcttctgccaaatgggggctacagataggacaggctctctggtttctcttcagatcctatgaatcatttgccttttacggacaagtcaggcatttgttactttatttttttgagacaaggtctcgctctgtcactcaggctggagtatggtagcataatcatggctcactgcagcctcgacctcctgggctcaagcgatcctcctgcctcagcctcccaagaagctaggactataggagtccaatgccgtgttaggctaattttttaaaattttgtttttgtagagatgggatctctctatgttgctcaggctggtctcaaactcccggcctcaagtgattctctcgtgtttgtctcccaaagtgctgggattacaggcgtgagccaccagcttggctttgttactttataaaaacaagaggtggctgtgaacttgaagaacaccagccctgtcttcacagagtgtggctgtgaggggcgtcggacccactggcctctaaccccgagggtcagtattagcgcctgtcatcggccctcagttctccacccccagctcagccctctctcccactggcacctacctcagactcaacacaccccaagtcccagatctgccccggtatctggccctcccagttgtccccatctcagtgacacaccacctagctatgcgggacaaaaacctggagtcaccttcaactctgcccttcactcacgcatcataaccggtccctcccaggagctttccctcttgactgcggcttcaccactcagatctgtcctgccacagccctccactgccagctggacccctgcaacagcctcctaacttgccacctgttcccacacttgccctacagctgggtctctagtctgaggccaaaatgatttcttattttttattttattttttttgagacagagtcttgctctgtcgcccaggctggagtacagtggcgtgatctcagctcactgcaacctccgcttcccaggttcacaccattctcctgcctcagtctccctaagagctgggactacaggtgcccgccaccatgccctgctaatttttggtatttttagtagagacggggtttcactgtgttagccaggatggtctcgatctcctgacctcatgatccacccacctcggcctcccaaagtgctgggattataggcctgagccacctcacccggctcgaaatgattttttaaatgcaaacccaattctaccattctcctgcttaaacccttcaagggtttcctgtgtttcccattcctctcaagaaaaagtcaaaacggacaccaaggcccacccagccactgcctgtctctccaactgttctcgggctctgctccctggctccgcactggccacacagagccaccaccctttctcttgtttctgtgaacgagtggtccttttgccagggtcactctctcctactccttctttttccacagccgatgcccattcatctttcaggatacctccttggtcccaagctctaagacgaggcgagtcagagctcccagctagacaggaaagaaaatgtgatcatacagacttagggtcatatgtgagaaggctacacatctccttggcaagtgatgatgtggcaaaggcctggccttgcctctcttctacattctcagtacgtgcagccatccatcaaagaaaaaatgccttgctgctgtcaaagagcaatgcgatggcttaggaagaaaactggtggcacactgggatgcgagggccacctccagggcccacagaggtggcgcccagcataagacagctcactttgtaggcagctagtagaagccagttgtgcagcaggtaagggctaacagtatcaccatgggaaggaagaaggtgacagaagaatgcgtagaacagaatgccacctttgtcaagacacatgcgtgacatgtttacctttctggcaatgggattatgtgttatgtttatttctgcccttttcaccatctacctcgtgctggagctatctaagtttggtttacttatggtaggagtttttgtaagattgcaaataagggaaataagtttaactgatgtttaagtgactcacgtcctttcaaaaaaagtacggccagtcaaccaacaacaaagaacaagcaaaacagaaaaggctatgggagaaggttctgggaatctgctttctgaggggctctctgagacggtgtgggcaggaacaacagggcattccatccccatgagccgagcacaacaaacaggcaaggtgaccacaggccgtactcaccactcaacgatctctgggtgaagaatggtattgttgacttcgaacctgtagggcgaaaagaaatcaagcccattaatccaacggtctgtcatgtcccagcaagaactacctcattcaagacatgcacacgtgatgcattaaagagggtcccacactttaatttcatgacttcctgacccacaaaaggcctgttgatcccttccttcagcagacctggcagcctgggccatgtcctccaaatgcagtcagttggagagcaagctttatggctacaaaacaccagccctgatccccactaggcagacagcatagtctcttgtgtcaagtatatcaaaatacacacaataggagtaccagaaggaaagaatgcagagaaagcaaaaacctcaccaatttgatgaaaaacattaatctacatatccataaagctccatgaactccaagtaggataaattcaaagatatccacacctagacacatgataatcaaactgtcaaaaaagtatcttgaaagcagcaagagaaaagtattaataattcatcacttacaagggatcctcaattagattattagctgatttctcatcaaaacctatggtggagagaaggcagtgggatgacatttaaagtgctgaaagattaaaaaaaaaagtccaccaagaattccatatccagcaaagccattattaataaatgagggagaactacaacatcccagataagcaaaacccaagagaatttattactagcagacctaccctgaaagaaaaaccaaagggaattgtttcaaataaaatgaaaaggtactgcagagtaacctgaatccacgtgaagagaaagagagcactggcaatggtaaccatacagataaatataaagacagtataaatgtattttttgtttgtaactccttttctctcctgacttaaaagacaactgaataaagcgataattgtaaatctgtattgataagtacaaaatgaataaagacgcaatccacatgccataacagcacaaaagagaatgaggaaaaggagacatataggggcaagcttttgcatgctatttaaattaagctgacattaatgcaaactagattttcaagtttaagtagtcaattgtaatccccataatcattaagaaaacagctaaaacatacagaaaaggaaatgagaaaccaaaatgtgacaataaaaaaaaaatcaaacacaaaaaaatgtaatggagaaagtgaggaacaaaaatgttataagacatatagaaaactaattttaaaatggtagagtttttccttatcaataattactttagatgtaaatggattaaattctccaattacaaggcaaggattggcgaatgaattctttttttttttttaattttaagttcaggggtacatgtgcaggtttcttacataggtaaacttgtgtaatggggctttgttgtacagattattctgccacctaggtattaagtctagtgcccattagttattttgctatttttcctgatcctcttcctcctcccaccctccaccttccaataggccccagtgtgtgttgtcgccctctatgtgtccatgtgttctcatcatttagctcccacttgtaagtgagaacatgtggcatttggttttctgttcctgcattagtttgctgaggataacagcctccagctccatccatgttcttgcaaaggacatgatctcattcttttttatggttgcatagtattccatggtgcataccataccacattttctttatccagtctaccactgatgggcatttaggttgattccatgtgtttgctattgtgaatagtgctgcagcgaacatacacatgcatgtgttgttagaacaatttatattcctttgggtgtatactcagtaacgggattgctgggttgaatggtatttctgtttttaggtctttgcggaattgccacgctgtcttccacaatggtttaactaatttacactcccaccaccagtgtgtaagtgttcctttttctctgcaaccttgccagcatctgttactttttgactttttaataaaagccagacagaatgattttttaaaatatgatccaattatatgctctaaagagacacactttagattcaaagacacaaataggttgaaagtaaaatgatgagaaacgatatgctacacaaacagaaacgaaagtggaactagaatggctatactaacatcagacaaaataagccctaagatacaaagttttactaaagacaaagaagggcattttataacgataattaggtcaatccacaaagaagataaaacaattacaaatatatgcacataacagagccctaagatgtatgtatcaaaaactaacaaaattggagagagaaactgacaatagttggagacgtcaataatctactttcggtaatgaataaaacaattagacagaagattaaaaaggaaacagaagacctgaacaaaaacgcggtggctcacgcctgtaatcgcagcactttgggaggccaaggcgggtggatcacgaggtcaggagatccagaccatcctggccaatatggtgaaaacccgtctctactgaaaacacaaaaattagcagagcatggtggtgagcgcctgtaatcccagctactcaggaggctgaggcaagagaatcgcttgaaccgaggaggcggagattgcagtgagccaagatcgcaccactgcactccagcctggcgacacagcaagactccgtttcaaaaaatatatatatatagcgtgtgtgtgtgtgtgtgtgtgtgtgtgtatatcaaaaacctaacacgtagctctaaaatactcagccaatagcagcagaacagccattttctcaagtgcacatggatcattctccaggatacactttatgttaggtcacaaaacaagttccaatacatttcaaaagactgaaatcacactaagcatgccctctgaccacaatggaatgaaataagaaatcagtaacataaggaaaatagaaaaattgacaaatatgtagaaattaaacagtagactcctaaataaccaatggatcacatatcaaaccttacaaaggaatgaaaaagggggaaattactactgactttacagaaataaaaaagtttataagggaatattataaataacatacagtaacaaattggataacctatttgaaacaaatccctaaagacacaaactattaaattgatataagaaatagaaaatctaggctgggcgcagtggctcatgcctgcagtcccagcactttgggaggctaaggcgggcagatcacctgaggtcaggagttcgagaccagcctggccaacattgcaaaaccccatctctacgaaaatacaaaaattagccgggcgtggtggcttgtgcctgtagtcccagctactcaggaggctgaggcaggagaattgcttgaacccaggaggctgagcatgcagtgagccgagatcgtgccattgcactccagcctgggtgacaagagtgaaactccatctcaaaaacaaaaaaaagaaagaaatagaaaatctaaacagaccttaacaagagatcaaatttgtaataaaaaacttctcataaagaaaagcccaggaccaaatgtcttctatgaaatgaatagaaattctatcaaatgtttaaagaattaacaccaatcttcataaactcttaccagaaaagggccaggtgcagtggctcatgcctgtaatcccagcactctgggaggcagaggtgggagaatggcttgaggtcaggagttcaagaccaacatggcaaaaccccatctctactaaaaataaaaaaaattagcccagcgtgatggtgcacacgtgtaatcccagctacttaggaggctgaggcaggagaatcacatggacccaggaggcggaggtgcagtgagctgagatcacaccactgcactccagcctgggagatagagagactccatctcaaaacaaacaaataaacaacaacaacaacaacaaaaacagaaaaggaggcaatacttttcaaccactctacaaggtcagtattaccttgatgctaagctagacaaagacaccttaagaaaacaaaattacacacccaaattccttgcgaatagagacaaaaatttttcaacaaaacactagcaaacagaatccagcaacatataaaaaggatatatatacatcatgaccaagtgggattttttcccaggaatacaagattccttcaacatacaaaaagaaatcaatgtaacacatcaatcatattaatagaacacataataaaaccatatgcttgtataaatagatggagaaaaataaactgataaaatcaaacaccttttcataataaatactcaatgaactagggagggaagggaacttcttcaacttgataaagagcatctacaaaaaactccctcaactaacatcatagcatactgaatggtaaaagactaaaagctttcccctaagatgaggaacaatgcaagcatgtctgctgtctccaattctattcaactctgtactggaggttctagccaaggcaaacaggcaagaaaagacatgaaaggcatccagacgaccctgcaattccacttctaggtatatacccaagggaactgaaagcatatgttcacacaagaagtctgacatctatgctcatagcagcattactcagaacagccaaaagttggaagcaacccaggtgtccaccaactgatgaatggacaaacgaaatgtggtacgtatccatagaaaaaaatatttttcagccataaaacaaagtagtagtgacagaataagcaagcagggaaatcaggaaagatatagaagatataaacaagaaattaaccaacttgacgtaattgacatatacagaacactatggcccataactgcagaatacatgctttctttaagtgtatgtgaacatttatcataatggtcacgtgctggaagtttcaacatattttaaagggctgagatgcagagaacattcattaatcacagtagaattaaatgagaaatcaaaaaatatccatggctcaaagataaaaatacaatgaaattagaaaataacaatatgaaatatcataacctgtgagaaatgcagctaaagcagtgcttacaggaaaactcatagctctaaacatacacagcagaaaagaacactgaaaatcagcgatctaaacttccatcctaagaatgacccttgaagaaagcaatgaaataaaaaggaaccatataagaaaaatctacaaagccaaaagctgctcttcgataagatgaacatcattgaaaaggtgaccccaggagacaaaaggatcaggtcagagcacatctctgacacaagagaaccctgtgtgacacagagctcaagctggagaacaaggtagcctagcacaagctataggcctcagcagagaagcctcggcaagacttcaactctctggattccaagacctgctccttagccaggtgtggtggctcacacctgtaatcccaacagtttgggaggccaaggcagaaagatcacttgagcccaggagttcaagaccagcctgggcaatgtggcgagactttgtctctacaaaaaatttaaaaattatctgggtgtgttggcgcacacctatagtcccaactattcagaaggctaaggtgggaagatcgcttgagcccaggaggttgaggctatagtgattcatgattgcaccactgtactccagcagcctgggcaagagtgactcttgcccagtctctttaaaaaagcctgtctctttaaaaaagaaaaaaagacctgccccatcttagggaaggatagcacacacaagcacacgcagggtcgtgacctcctgtcctcctgccagccagggaccctccatggcttcgttaatggtgttgaaaacacctatgtaatgccatggttgtgaggccagcagcccttctagctgagccaactgaacaggggcagggacaggggagagaagagagaagggggtaacagcagactgagaggattccagatgtctgaagctttcaggatccttaactatacaaacagaactatatgattcaaagtcaacctaaatgttgtggaatcaaagccttacttatgaaatatcaaagagactacgggcagccagtgtggttcaaagtgaagaacagggcagcaggtgacataaatcaaaactacaaaatagactctggctcccactgcaccaaatgccactttgaccctaggaaaagcagtggccaatctactcagcagccaaacacaccaccaccatttcatcttactcaacgtacgtacgcatacacacgtgcacatgcacacaagcagcaaagtgacccagcacagagtgactcagcacatagacacagatgcacacacgcagacacacagagacaggcatacgcttggaaaagaggcacacacggacacatacagccatgtgcacaacaggggcatgctcggacacacatagatagaccccactgtatatgcacacacacagatgtaggcaggcatgaacaggaacacatacacacaaacacacactaaggcacaagcttaggggaatgtagacacacatatacacacacatactcagacaggcaaatacttaagacacacaaaaagatccacaccctgatatacacacatacaggtaaacacagacacagatcaatgtgtatacacagatagacacacacacacacactcagacacaaaaatatactcagagaaacacaatcagacacacacggaagaatccaaaagacaaggttaacaggttgaaccctgggtaataaaattcatatagttctcatttttgcctccatgctggttagcattttctacaatgagcatgtattaatcgtgtaaaagtatcaacgaaatcccactgggcctgtgagggtaggcgtgccctggaagcagagtgtaatttcctgatgagctctaaatgtgggctgggagatgagagggccaaagcccctgtcccaggccactggcttctttccgggcatatctcacccaaagatgaggcagcccctccactctgctccctgccaaagggttgggtcaggttctcacctcttgagggtccctcccctcaccgagaactccatgggtcacaattagaaagccaatcctggctgggcgcgctgactcacacctgtaatcccagcactttgggaggccgaggcaggtgaatcacctaaggtcaggagctcgagaccagcctggccaacatggtgaacgctgtctctactaaaaatacaaaaattagccacgtgtggtggtgcgcacctgtaatcccagctacctgggaggctgaggcggaagaatcattgcaatctgggaggtggaggttgcaatgagctgagatcgtgccactgcactccagcctgggcaacagagcaagactctgtctaaaaaaaaaaaaaaaaaagaagccaatcctaaatattaacttgatatccaagttaacagtaaccagaaaaccacggtcctcaaaccacagattggtattttgctgtaatcgtcaagttttaataatgtccctctacttcctgggttttaaaattcacatcttcggatattaatattcctgcattaacaacccccaaattcagaatttcatctttaactgcttgcttaaatggaatcaattcgttaccaattgtcttcaaatatgcagggtgatctaagtaaatgccgaaagataagaaatacacttagcctgaataagtgtatttcttacactgatgtaagaaatgtaaaatactgaccatatacaatggcaggaaacggagcccctgtcactcgctgccccggcccagggctcctgggtacagcttctgtctgtctgggaggcgactgccttgtgccaagaaggcaccctcgttaaggcatggaaacttgatggacaggcatccctcagctcaggccacccagcccctgccaacaatcccccaacagaccatctctccttcatggtcagtctcctgctctcaggaaaacctgccctaacgtctacctccttagatgttttcagagatctaccatgtctgactttgctcccagccttcaggagccaagtgttccagggagcctatcttgccatccgcaggaagaagtctcaagtctcttgctgcagggttcccctccccatctcagcccccactagcccccaaaccaaccccccatcatgcccccgccaggacctggcaatgagcacccgaccccatgcccacacccacccctcctgccagagcccgcagcaaagcctgctcttcccaaatcttccttgggactgctccaatcaagccacacacggaactgctgcctgggccggaccccaaactcacaagcccctacagaccatcccggcctacacccttcacgctactgtcatcacaccgagccacatcactgggtgagcccaggggcctcagtccacagggtctctctggccgtgtgcatgcccaccaccctcagcccacctctgccctgtcccctctgctccttgtcctctgctgtccccacacctcgagaccccacacactcttactgcaggcagcaggcggcctggccctgatctggggaggtggagggaggtctgagaccaaggctgagcccaaatgggacagaccccaggccaggcaccccgagtagccacacctggaggggtcctggcccaaccatccagctggaccagggtcccaagggtataggctgggtggacaggtggggaccactgtctaccacaagctcctcttccctgcaggccaggggataaggggagctgggggggcccatcaggtcaaaccaagaggccaaacctgaacttctgttagaggaggaggtcaatcgaagcccaaggtgcaaggtgctgcagagacatttaaaagggtcaaaaaggacaatgccgggaacaagcagcttcatcagagcagtgagaggcaactggggcggaagcagctgcgtattggagaggaggacgacagcaagattcatcttgcttgggaaacaggctattaatatcccagctagcagctggaggtgcacccggcaggcaggggaatgcggttgctgagcggcagcggctcttggggacgtggtctctgcccagcccggcacaaaagtgctggcagcctgggtgagtggaaggcagggggatgagctgcacctggaccccaggaatgcagacaagactgtccacagggaagcggctgggagcagctggaggcaaaggctggggccccatgtcaaggcccacggcatgcagggtagggggcaccagccagagctcctgcctcagtgaaacagccctggtggcagtgaggtggaaggccccgaggggagagacatgggtggatggccccctgcaggggacaaggaagggagggaggagaacaagcaggccagagatggccacgagggttctcacccgctgcgcattgcaacagccaagtcagagactcggccagcagcccaaggcgtaggtgcggaaactgacgcaccagcacccggggtggggggcagtgtctcagcccagcccccagctgaggggccgggtgagcaccccccagtcagccccagcctggcctggatcagagattggagaggtaccagcccggtgcctggggagatggtgcaaaagtaaggcagtccctggctctccaaaaagtgtcccagtggtgacagggtggggtggggagtttgcagagcacaggctcctctgggctcttggcagaggccacagggactggggggcaacaggtgacagagactgggatgagaggtcacacctaggaatcctcctggggggtagaacgagacctttgcttcctgacactcactgacagtgatgagggccctggggaagcccagggccccacctgccttcctcggggaacctcaaggagcagctggcagagctctgcttcagaggccacatcttgagctcctggctgggaaccacacccaccacacagctgccagacgtggtccaggggggctcagcattctctctagaggaggagcaagcaaagctctcaccgctgagaaggccctcgactcactgacatctgggaaactgggaattggtgatcctggagcccacctggcccaccacgcagatggggagactgaggcacagaggagcaatgggatttgctggggtttgcatgcgggcaactgtcactgagcaccagctctgtgccaggctccaggtgagcatgatctcctccagtgcccaccacaagcccaggcagcaccaggttacacgtggaggagctgagggtccccctgctgcagagacccaaacagaggccatagagaggttccatggcatggtcgaggaaaggtgtgcaggacactggagacccagcaccaggtagtgctggggggattcagggagtcccgggactgggacaggcagcagctggctgtgcccgtagcccctctgagggcctgggggcctggggagagagagcagctccatggccagcatttcaacaagctgggctaattgctgccaggcgtgggaggcggggccgctttggggaaactcccaggaggacacgaagatctgtgcagtgaaaaagcaaacctactacccgcccctccacccgccccactgctcttagcatagggggaggtgggaggtgatacatattcatgagctcataatccctcatcacccctacatcacacacagagattccagcagcttgggctcatacataattataaggcggttcctccatcactgccttggtccaccagaggacaacagaagacatgggggctgtaggggatgcatgataggggaggggctggggatccaggtcccaaagttggggctgggagctgcccactgtccacgtgcagcagcctcgagcgcaggggccttgtctgctatggcatcagccagcaatgcaggccacagacccccagggccagtcaccagccagtccagggacccaagcacatccagtgggcagggctctcccgccctctccaggctctcccgggggctgtgggtgaggggtgacaagcaggggaggggcgtctttccctgtgcccaaggtctgtcctcctgcctggagagaaaaggggaaccgcttcccaagcagggtttggaggctcagcctggcgcttggttaagagtgagaagaggttaaagggatcctgcctgggattaggacagcaggggacacaggggagctgctgagagccgggttggaaggggttaatggctgggactaagagagggggcttgggacaggcacggtgtctcacatctgtaatcccagcagtgtgggaagctgaggtgggtggatgacctgaggtcacgagttcgagacaagcctggccaacatggcaaaaccccatctctactgaaaatacaaaaattagccgggtgtagtggcgggtgcctgtaatcccagctactcaggaggctgaggcaggagaatcacttgaatccgggagatggaggttgcagtgagccaagatcgggccattgcactccagcctgggtgacagagcaagactccatctcaaaaaaaataaaaaaataaaagaaagggggtggtggcttgatgcacagaccacaggggctcacagcagatgtttagagggaaaacaacccacctgtgcctgcccctgcccttgcccctgcccctgccctggccagggctgcctgagcactttccttatggagcaaacagacacggggcacctttccttcaagaaaaatcaaggtgatttttggcaaattatgcttctaaacatttcctcaaaatgcccaaactccttaaaaagaagtttgcatagttcatgtcttatttgtagaccgggaaagacctgctagtgaaggtgggagtgggggatggtggggaaagagtccctgggggcccaggactcacttgctgatgccgtcaaaggaggcctccctgcagacactgccgctgtccgtgttgacgccacgctggggagagagaacacagacatgacacacggggccgcatggcgcccccacagcctgcacccctgaggcctccagctaggctcaggacaggtaagaacaggatcccctcctgccttcccccaacagatgagccacccagccaggtagctccaggcccggccccaacacaaggacagacctctttgctaccacttgccaagtggaggaagtgggggccccccaaactctgcagcatcccagctgcacagcaaggccttctccatggaggtcagagcactctgctgaaaccagccaggctgcccaggcacaggcgaggacccgggaccactcccaatataaatctgctctccccagcctggtccatcttccctctcctgcacacactccccactaactgtataacatccgaaagagtcctgtcgaacccagcccttctggggaggtgtgcaggacctgactgtggcaggactgctgtgaagcagggagacatccctctcttaactccaaggagactccaaatgggacttggacaggaatggagacaaaacaagggacttggagaaaaatgggccctctccagaaaggcaaggcattttatttcatttattttacttatttttttttgagacagtgtcttgctctgtcacccaggctggagtgtggtggcaccatctcggctcacctcagcctccacctcccaagttcaagtgattctcctgcttcagcctctcgagtagctgggattacaggtgcgcaccaccatgcccagctaattttatatttttagtagagacatggttttgccacgttggccaggcttgtctcgaactcttgacctcaagtgatccgcgtacctcggccttccaaagtgctgggattacaggcatgagccactatgcccagcctgggcaaggcattttaaatcaccatttctttacccagaacttcagcttgatgtctaattgtatatctaaattgaacacattggatcatctatgaccataatcatctcacataagtttcccttatagccatcaagacagtaaagcaaaaaaaaggggccaagtgctaaaggaaataactattttggtaaaaatcaattaagaaaagagaaaggctgggcacggtggctcacgcctgtaatcccagcactttgggaggccgaggtgggcagatcacctgaggttgggagtttgagactgatcaacatggcgaaaccccgtctctaacaaaaaacacaatattagctgggtgtggtggtgcatgcctgtaatcccagctactcaggaggctgaggcaggagaattgcttgaacccgggaggtggaggctgcggtgagccaagatcgctccactgcactctagccgggcaacaagagcaaaactccatgtttgaaatgtttgttcttcagtgccataaagaaatagcacttgaacataaatttaatttatttagtaaggccattttcacttcctgcagaaagggtacactctccagcagttttgccacgagagttcaccaaacaaaggagacagggtcgtttataacctggcgtgtccaccctactgctgtgtccggtttccactgcctggaacgggaccccacattctgtatttgtcccgattggctagcaacttagaactttttaaaagaggcaaaggtagagggggagaaaggaaggaggaagtaacttgtggaatgctgagaaaggtaaaaacacttttaaataaggaagaggaacaggctatgaccttatgtttgcttggaccagtataagcacatcagggcaaatatttaggttaaattgtgggagctaaaaacataaagtatattgatttctttattacagctagcagatatttaagaatgttagcacaggtctttgaataaattttgcttctaagagaagttactgtttatttctaattagacggggaggaaagtctttgaagagaaacctctactttactttttatattccatttcaaaaaaaaaaaaaaaaaaagacaagagggaagggtcactttggggggaaggcttgtggacatgcctcttatatgaaactcccaagctcaaagaagtgtaagaaagcacacttctctgagaaattccagagaattctttgggggcacaccacagctcaagtgcccccaaaaccctgccggcgtacccagagcccacctcgcaccccccaccctagcccaggccctcggtcagtcactgcgccccacacccctgctaccttgagggcagacgcccggtggtgtggttttcagacccctttaacaggggagacagagggtgggaataaactttcttttttcctttttaaattttttatttttagttttcatgggtagatattaggtgtatacatttatggggtacctgaaatattctgatacaggtatgcaatgtggaataatcacatcaggatacatgagctatccatcacctcaagcatttatcctttctgttacaatccaattgcactcttctggttatttttaaatgtacaataaattattgttgactgtagtcaccctgttgtgctatcaaataccagatctgatttgttctacctagctatattttggtacccattaaactgactttctacatccacaaattccaggagctcagcctgacacaaatacatcttctagccaggtttaaccttaggagtgggtgtggcgccaggcccacatcctcacgacaggacacagcaggtcccagggagactcaaggatggggtcccataaacagctattcagactgagcaggtatcgctacttatcactgatgaccattcctcttggtttatttttttctttttttgagacagggtcctgtctgtggcccagactggagcacagtggcgcgatcatacctcactgcagcctcaaactcctgggctcaagcacgcctcccacctcagcctcccaagtagctgggaccacaagcacatgccaccaggcctggctaactttttaatttgttgtaaagacagggtcttgccatgttgcccaggctggcctggaactcctggctccaagcgatcctcccaccttgcctctcaaggcacttggataacaggcgtgagcccctggacccaacccctctccgttttttaatcctcccctatgggcccgacctctgcaggagaggtggcccccataaaaaccctccccagagccaagcactgccccacccctggacaccagccacttaccaaagtgaggaggacagagggcttctgtgacgtcaggacgctggcaatctagaaggtcggaaagaaaaacccactttagaggcaccactaagcctaatgaagatgacatgccaccattccttcataatgacagtgcacatttatcaagcagatcattagaacaggcgacgtgggcgctgccctcaccctgcaggtgaagaaacccagcttcccctggttgaaggacttctgaaagccacacagccatcgaggggcagagaggataaacctacacctggctcgcttcccaccgcaccgccctgcttccaggcaccacacagatccctggctccaagcagccagccctacccaccctccaaggccagcccctctgcccatctgcaaagtccctgctcaaagacccgtcccccgggaaccctttaggctccaggcctaccagcctctggttcctagggcagaagactccctccctgctccccattcaacccctagacccaagggagttggccttccccaatcccaccctctggcccccaccccacagcccactctctgtccctccaccatgacccacttggacctcctgccactgcaagccagttacttcccggcccaagcccttgcatctgcatgccgggccagctcctctctccacgcctctgctccagctcttatctctccctgagtgccttcttcccatcttagtgcctcatcaatgtgcactcaggatgaaagccccagccccctgggcaggttcgttcactccctcctctactgccccactgacagtcaccattcccccagcaaagtgccatgtgccaaccagcctgctgggagcaatttcttcctctgccagcccctcctcctcagtctggcctgcatcttggctactgcagaccctcttgtttctgagcaccccctgggcagagaacagtctcatctccacagccctcgcctctccccacacccctatcctaactctttacacccgaaacgcagggggagagtgaggagaacttgttgttgttttaacagcttgattgagtgatcactgacatactctatgctgcctgtatttaacatagacattttgataagttttgacatatgtatacatataccttttttaatactgagatgcctcccaagaaaacctggaacgtattgaaaactataaaaagataaaatgcacgtacaatcctatctccagagacattttagctttgctcataaaaacagagatctgtaatgacatttggatcatatgaaattacatgcttcacttatttcctgtcattatatgttcttcaaacatgcaatttttagcagtcactaccgctggggacagtaaacgtccagtaggtcgctgaagacggcctgtgccagtcatcttacacacagcatctcatttaaccacacggggagacagtgcggcaaacatgcaggtttcgcaaatgagaatggcttacagattagagaacttgcctgagtctggttaaaaaataacagcgcagcccagatttgaacctatggctgtagaatactctcttaatggacactactcattcctctacggacacttaaattacatctaatacactttgggaggacagggcaggcagatcacgaggtcaggagatcgagaccatcctggctaaaacagtgaaaccccatctctattaaaaatacaaaaaaaattagctggatgtggtggcgggtgcctgtagtcccagctactcaggaggctgaggcaggagaatggcatgaacccaggaggcggagcttgcagtgagccaagactgcgccactgcactccagcctgggcaacagagcaagactccgtctcaaaaaaaaaattacatctaataattagcaattataaataacgctgtgatgaacatcctcgcatacaagtatttccttaaaattaaatgccagccagccacagtggatcatgcttgtaatcgcagcacttttggaagctgaggcaggtggatcgcgaggtcaggagttcgagaccagcctggccaaatggtgaaacccccatctctactaaaaattagccgggtgtggtggcacgtgcctgtagtcccagctactcaggaggctgaggcagaagaatcgcttgaacccaggaggcggcagctgcagtgagccgagatcatgccattgcactccagcctgttgggtgacagagcgagactctgtctcaaaaaaaaaaaaaaaaattaaatgcctttaaaactgttgggtcaaaagccacagactttgtcaaggtttaccatgctcctggcccaatgatcctccagacatgtatcaacaatctcccgggatcctccctcatgttactgagtgactgcttggagaatggctgtgtcctttggcctcagtgttgcaaaaaaacaaaaggctcagctgggtgtggtggctcatgcctgtaatcccagcactttgggaaggctgaggcgggtggatcacttgaggtcaggagttcaagaccagcctggccaacatgatgaaaccccgtctctattaaaaatacaaaaaaattagccgggcttggtgactgtaatcccagctactcgggaggctgaggtaggagaaccgcttgaacctgggaggcagaggtttcagtgagtcgtgactgcgccactgcaccccagcctggggggcaagaatgcaactcagtatcaaaaacaaaaaacaaaaaaaaacacccaaaaggttcagctgtgtccctacacaccctcagcccctcctgaaggaaggggagacttattaaaaggaacaggggtacacatgccggccctaggtgtgttgttacgttgatgtgaatgttctgcattcagctgcacagaaggagcccgtcaattacagcagctgaatcagaaagccaggaggcacttggggattgtatctgctatcgtcttgggagggaggagcaggataacaaatgtgtgggctgatggtttttctccgggcgacgactctcaggacatgctggttaggaataatggaggaggggagagcagccgtctccttgcagcccggtgctcagacaatccaggcctgactctgagagcaggctgtgcatctcctagtcctggcagggcaacatcttttattgatcacaactgcttgagtgggccctggttacttctgcggctgcaaaaacctctcccgacctggcagctccacccgcccttccccatggagacccattagtgctacgctctcatcagcacaccctgactccgtgcctcaaatattaagggaacacgacgcgctgtgcgttgctggctcccgatgtatccccagcacacaagacagcacggctctgtcaactcagggcctcgtttccacggagtggtggccactggggacctctcacaccctgcgctgttaaatgaccctgccttgcttcatgccagagccagcatcgatttctccggcagcccccggcctctctggcagatggagctggatggtcacgggcagaattcatcagagccctgtgggtgtacatcctcccctggggacaatcagaggcttcccacggacacctcctgcactttcctaaccagggcccagaccaggcccgagggccgcttttcgcagggtgataagctggacaaaaaagctggatatgcctttgccagcgctgggaaagcctgcaaggctccagagagctggctctgccctgcaatcactgaagcttttgaaaataaaccttctttcgtggcattctcctccaacagtattgcacgctggtggcctgcactgcttttacaatttcaaatttgtttctcaaatgtaaacatcaggaaacatcaccaacagtctggatgtgtggctactcctgaacaatcaggttcctggagccatgggctcgtggtcccacagcacagtggcccctgctgaccccatcgcttccgatgcctgtccctgtgctgctgcggttgtcctcttacatctgtcctgcctgtagcagacttggtgaccctcggaccttctcacatatgcctggcgccataaagggaagcaagtgcatggaacgcacgcttcacctgccagctctcagccggtgatcccgccagcctttgcacagggccttcacggcagagcctcggggccccactcaaggttctgctgaatgcctccttctcaggggaactgccttctcaataaactcaggatcctctgtggggaggagggaacctcggagccagctgtgccccatcagacacctgcatggcatacatgctatcacgtgaccagccatggcactggaggccttcctgccttttttcagaggagacaagcgttggctgtgatttgtcactgacagctaaggccaccccaagtgagatggggctgagcactgcagaaccagcctggggaccccttccctgcataaagggcttcctgtaacctcccatgatgcaacaggccctgggtacctcaagcaacctgggatacctcccagctcagggggttcagtccagcaagtcacactttttggcaggctcccttcagagccacagaaaatcaaaggcacagggagtccatgtcgcctccacaggagtgtcctacagcagccctcctttctgaggggaaagggaggcctggaggggaggcccctggcgtcacatcccagtaccactcccctccagctgtgggactgtggacgaggcctttctctctgagcctcagcctcatatctatgaacggggtgggggctacggcccagcacagtccctgccccgctgtgtccctcccgcagcgggagggccaaggggctccaagagagctctagtgttactggagcccacgtgggccgccccagcatgaagcgcttgctctgctgtcaacgtgagccttgttcccagtaaaaacagcagcagtaacagtaacatcaacaccaatctgcaatggcagtggcgttgacggggtgcggtggggtgctcccgaaccctaaagagattctagcctttgaactctactgaagcctcgacaatctgctttgtatacgaagacgaagaatgagccggtctctgtgctgtcattctgtgcaaccattaacaacttccctgccctaacactcaaggtggcctgtctcttactttgcttagagaccagttctccttcctcacccccagaaatcacagtagacacggagctgaattttcccccagttataaagacaaaaatgtcagacagtggctggggaggctgtggtccagaggtggctcggactcagcagctgagtccagggcagaggcaggtgccggtcccaccacggtccttgagacagggtcctggaggcaggtgcccatcctgccagggtccttgagacagagtcctggaggcaggtgcccattccaccaggatccttgagacagggtcctggagacaggtgcccatcccgccacagtccttgagacagggtcctggaggcaggtgcccatcccaccagggtcctcgagacagggtcctggaggcaggtgcccatgccgccagagtccttgagacaggatcctggagtcaggtgcccgttccaccaggatccctgagacagggtcctggaggcaggtgcccatcccgccagggtccttgagacagggcccaccccaggctgcccctccaggtttcacatcgaagagacctgaagggtcaaggtttcaaaggacaacagtgttaagaaacagtttctggggcagggaacacatctgccaaggagagggtcggaaggaaaacgagaatgaaggagtaggtgcctcctgctccacttctgagacatacaaggcaagtggcagatggtctcattgggagcatgcaaataaacgttccgtctattttagatcctgtactcaacgggatcaatatgataggtcacatgtgtattgacagaatcttcagatgttaagagtcacccccaaaagcttgggattgaaataacataacataaagatccatcaaaagcctcctctctccacagtccaaccaggcagaagatgctgtagagacaggcccccgtggccctgtagaggtgggcagtgcccttcacagaggctcttccagggatctctgcccaggcaccaccaccctgcggtgactgttcactcatgtggtcacctcctgcactggactgtgccctgggctgttgaggtcagccctgggtctcggccacctctgatgccctacatgtccctgggactgggcagggaaagagtgcaagaggaacgtctggggaaaaagaactggacgttcaagacaaatacaagacagtcaagggcagggtgcacatcagaacacagtcagcgtccatggtgtccacaacttggtcctgagggctcagggaaggggcaccagtgtgggccagagtctacagcagatacagtggctgctacaaggctggtgcaaggcctcaaaagatggataggagaaagacagagaaatggaaaacatattccaggacagcagtaccgggggcagggctgggcacatggtactggcccacctgcagtcaaagagggctggccacccccgagctggatgggccgggctgggcccccacatgctgggcagagacaactggtctctcacagcactgtgtctggccatgatccctgggaacctgcttctcacccagtgccgtcatcttcaaccaggctgtgtcctgcccaggggaagggggaagctgcttggccgccagaactggctcccctggccacttccacactgcagccccggctcttagcatggccgacacataatctctgtctggggaaatgtggctacaggatggccctgtccaaagctgatgctgccaggtccaggttggactcccagtggcaggcattgacttctgggtgcttcacattctacacggcactgacctgcacaggacgtggggttgtgacagcgcccagggccagagcacagaggcctcctgtgtgccaggcagtggtttagtgtcagggcctttggtcaagtagaccacaggggctcccagctgtgctctcgcctctgtcccagccctgccccactggcaggaaggagagctggagtcgaggagtcagggcagcccctttgacctgcctgaacttggttggcacagattcaaaaccccaagaggacagccacatgcctacccaggccacacgacacctgctggacaaccccactgagaagtggattgaagtcaggggacctccaatgctactctacaagcctttcacagcctcgggcttttctgacagtggcatctgcagtcaaccagggctcgagacacacgaagaccccggcccagccttgtggtgacttagaccgtgtgccaccgctgcaggcaggcccgcctctcagagacacctcatgtaatctcagcggccacaacccaggtcaccagacacttctacccacagagtcaggggccttcccaggcaaagcaatggctccgtagagaagcctgaggcatgggttgctgcctactccttccaaatgggagcacctgcggcgcagggactggtggccaggtggtagtgtccctgacatccagcaaggttgtggcagtggaaggagaggaactccaggagtggaaggcatgctggaagccctgggctgctcagaggaggagccggctacccacctcatctacgtactggacgtcgtccacggcatacttctccttgaagtgctccttggaatggatcctcaaagaaaagcacaaggaatatcagggtcagggcttggtaatggctcagcatggccaccttcctgcctgccaagcccaggccatggagccccagtcccatccctatcacggtcagcacccagcacccagcacccggcaccgaacaggtcggcccaacacacacttggagggcaaaggccattaggccatggagtgacggctgaaccacagctgctttcctcagcaagccccgctcctccgtgaccctagccacctgcagccagcccctgcagacaaaacccctatcatcccctccactgccagagacagtccaccagggcagccagccagtgcacccgtccctctgtggcataaaacaatctgcctgccaggtcttcatggagcatctttaaaggaaagtttattttaaggtcagccgcagaatcccagcactttgggaggccaaggcagacagatcacaaggtcaggagatccagaccatcctggctaacacggtgaaaccccatctctactaaaaatacaaaaaattagggcgcggtggcgggtgcctgtactcccacctactcgggaggctgaggcaggagagtcacttgaacccaggaggcggaggttgcagggagtcaagatggtgccactgcactccagcctgagtgacagagcgagactccatctcaaataataataattattattattactattttattttatgttctagagacagcatctcgttctgtcacccaggctggagtgctgtggcacaatcatagctcactgcagcctcaaactcctggtctcaagcaatcttcctgcctcagcctcccgaagtgctgggattataggcattaggcactgtgcccagccaaaaattagcatttttagaaagtcagtatcagtattactcaatgtgatgagaaaaactcaagcttattcattacccctgaaaaatctgccagtgagaagacacagaatggatgaggttgggcagccctcgtccacctcctgatgggccctttggtcacagctgtgctaggcagacctccagcctgggtccagcaagccaccacccccaggctcttggtcaggagataagtcaatgtctctgttagtgacagagcttacgcaaggggaaaggaacacaaactgcacaggggagacactgagagccaagtccaatgacgcacacatactcggtcctatgtcatcccacacctgggccccacctcatcacacgggctctatccccagccgtgctccagccctccagctgtctgtgacctcacagtgttacagtcaccaggtgctgggtcccaaataggcctcagacaaaaaaacagcagatggtttctggatggtgtttcctgggctgtcaaggggtggtggtgaggcaggagaatagggtcgggaggcgttagggctttttcatgctgacttcctagaactaaattgaaaggaaaaccctaactttccacacctaagtaacaaaggaccagaggctgctccctttgcaaacccccccttttttttgaggcagatgggaaattgaaagtacctctgattgcaagtagagtcttggtttgcaaagaaacgcaactttgtaacttcactttagcctctgattggttgcagaagtgaagttacaaaggttgctttccacaaccaatcagactgatggcaggccaccacttcatttacaccaggcgagcaccaagtggccaatgggaaacctcctgggggtatctggacctgagaagattctgtcactaggccttgagactctgctcagccggctcccacactgtggagtgcactttcattttcaataaatctctgctttcattctttcgttgcttcattctttcctttgtgtgttttgtccaattctttgttcaaaatggcaacaacctggacaacttgcagtcaagaccctctacggataactggggggcgggggggggtgttgtgggtgccaaggataatgtgcctggagaaccccacggaacacggtggagggagagaaccttgggacttggaggtgatgaacttcacgagtgagctcctgaactggtgtcctatgtgccattctcagcctttgtgacactaaggaccagcatcacctgcaggaaacagaatctgctcctctctctgagtcctccaccacttccctccccacccaaaccaggaagtactggccacagggcccagggacggctgcagggagcaacaacaaggagcactgagggcccgggagacgctggtctcaccgtaatcaatggactgctcagtgcagcccacaatgccctttgctttctctcccttttggcttctctgaaatgatcacggggtatcaagctcctgctgttaattaaatttgcatgattcagtcacattcacttgtgcatttgagacaggactcaaaagttaaatggccaaggtctgacacctccattagcacggcctcgagcagttatggggcacgaattgatgacgagcgcctcgcctggacttcggaggccccagacgcagggcttattgtgcagctggctcaagggaagcctacagaccctttgctactgagcaaccacactctcagcaccgagttgaccccacagcccggcacaaaagcaggtgtcagaaatacaaaaggcagggccatcagcgaaatgcgtggctgggatcaacacatcaactcggactttctggctccataacaaacaccctgcgtccctcagttgttcccagctctgcctctagccccctcccttcattgcctccagctgtgacaggagtggaaggcaacctcacggcagagtggggaagtacaaaggatctgattttgaggccagcgccctacagaggggcatctcagccatcagtgtggcacctgaccttgtcacttccactcccgttatgggcctgaaacctcccaactcaccccaactgtgcggagggaagccaccaggaaatgcattcccgcccctcctgccaaaaagcgcctcccaagccagaggtctggttctcaacagaagagccattcgacagatacaacctgaaaagctgcaagcagcttttctggcaactgtgcattgcattctcttttaaagggcagagataattaagtttagatagtacttatttttcatgtttgggggctaattatagtaaaaaccatttaaacgtcatcctaagggatatgcgtgccagactcccacgtcaaaccagccaccgaaggcttggcagccatgatttggtggggttgatgagaaaagaagaggtgtggccacacaagccctgcaaagctggctggagaggcccctgaggggctctggactccctgaggccaggctggccagggcaggaggcagccactcagagggagggcctgcaccctgccctgtggggagtctggggtccagcaacggtacttcatgtcaggccccatcgcatgggaagtctggatggaaacaaccagactggaggccgggcaccgtggctcacgcctgtaatcccagcactttggaaggccaaggtgggcagatcacctgaggtcaggagttcaagaccagcctggccaacatggtaaaaccctatctctactaaaaatacaaaaaaattagctgggtgtggtggctgtaatcccagctactcaggaggctgaggcaagagaatcgcttgagctagggaggtggaggttgcagtgagccgagatcgtgccattgtactccagcctgggtgatgagatcaaaactctgtctcaaaaaaaaaaaagaaaaagaaattactggactggggaggatgggtcagcagagaagctgctgtcaccccacacacactcccctcaaatgccaaggatagctttgggaggagagaggagaagtcctcctacccaaaggggctctcgtcctccacaggggtcagcatccagggaccccagttgggccctggcatggatgagagaggcctttcccagtccccggagtcaaagcccatgactgcacactctgcagtgactgccagcaactgtgggggccacgggtgggaaggagacattaaattaatgccacacagtgcagacacgaggagccctctagaaaatgaaatttcaaaaagcaggtcttgctggctggctgaccacctgcatgcgattaatgaataagtaacagggccaaattacagccatcaccatccatttcccgcggcccggcctgccttcagctacaaacaatgctgcctcgccgactctcactctgctctccacagaaggcagcggcatttgctctgcggtggaagccggcagccatctgaggatgttagctggtcagagacaaaagcagacctcgccacagtgacgcaggtgcctatgcccaaagaccactcccggagcaagcttcctcacaggggccacagagggaacagcgctgcccgggaggctggagaccaggtccagtgaccaggcctgcccagggtcagtgcctcaaaccacccgggcagcagccgaaggagctcctcagccccttctcagaggcctgcacggcaaagagggcccccgacaccctgccaatcacaaggagcgtgggagggaggcaccagagaggctggggaagcctcgatcctggggacacttagtggggcagagctgggaaaaacacacaacacacaacacacaacacaccctcatcacaaacaccctacacaacacacacacctgcacacaacacggcacactcacacccaccacaccccatcacaaacaccctacacattatttactcacacacccacacacccacatacaccctcatcacaaacaccctacacactacacacacccacacacaacacagcatactcacacccaccacaccccatcacaaacaccctacacactacttacacacccacacataccctcatcacaaacaccctacacactacacacacacccaatacaccacactcacacccacaccccatcacaaacaccttacacatcactcacacaccctcatcataccctacacactacacacacaacacagcacactcccacccaccacacccccatcgcaaacaccttacacacccctcagacacccacacacaccctcattacaccctacacacacatccacacacaacacagcacattcacacccaccacaccctacacaacactcacacacccacacactctcatcacaaacaccctacacactacacacacacccacacacaagacagcacactcacacccactacaccccatcacaaaaaccctacacactactcacacacccactctcatcacaccctacacactacacacacacccacacacaacacaggacactcacacccaccacaccccatcacaaacaccttacacaccactcacacacacaccctcatcacaccctacacactacacacacccacacacaacacactcacacccaccacaccccatcacaaacaccctacacaacacacacccacacacacccatacacaccctcacatgcaccctacacaccacacacacagcacacacacacttccatcacaacctacacaccacacacactcccatcacaaacaccctacacaccacacatgcccactcacaacacagcacacacatgcccacacacactccctcacatgcaccctacacacctcacacacccacacacaacacagcacacacacactcccatcacaacctacataccacacaccacacacacacccatcacaaaaaacctacacaccacacacacaccccatcacaaacaccctacacaccacacacacaaaacacagcacacgcacacccacattcacccctcctcataaacaccctacacaccacacacccccatcacaaacaccctacacaccacaaacacagcacatgccccccccacacaacatactctacatgcatcacacacccccaacatatgtcctctccacatcacatccatacgtacccacccctccacatgcaccacaccacacacaggtgtgcactccatatgcacacacagccccccacacatacaccatgcatgtgcaaaccctcccaccatacccgcatccatctctcacacaagatgtgggtatggccctgggaaggctgagcgcccctccctgcatacccagagccggggacggaatgcgttacaaaggttccaggagggtcccccgacctggtcaaactggctccccaactctgggctccgaagctgcctggggcgctgactcacagaggcccacagccaaagccaccctccactaagcccaactccgatgaaaaatgatgggaaatgctctcacatcaaaaagacaccacacactattgttagcagagactctgaataaaaatgcattcagagctaccaccctccccatcccagaacaggcctggggtgaggagtgggccggcttcaggctgcccacggcccctggcgtctgcaaccctgacaacagcaagaccgtttccacaggaagcggcagatcctgcagacgggggtgtcgtttccctgggcgactttggattgcagtatctgccagatggattttcaaaaaccatcagatagggactcaaaaggaagctgaggagctgaaggtcaaatgtgaagtctggtgggttttgcttgcaaaggccaggtactcccgtcagcctcgctcctggtgccctattgattccaggagcggctggaagcagccatacgcaatcagatctggccactccccagctccagtcccacatagtcaaccccgccaccactgctctgttacaactgagccttctctcctgagggctcaggatgtggagactcagacagggtcactccaggacagtggaacggagaggcctgctcggggtggctgtggtagggagccaggacagcaggacacaaggctctacctctcagctatggggccagatgccccctcgggaccaaggctgcctgatctgacctgcccagcatgtacacagccttttccaacaggggagacccctgttggaaacccctggaaaccccaggtggggccctgtttagcccctgatcagaccctccctgaagctgtttctccttctctgtccatccccacatctcacagaggaggcatccgacctgactgctgagctacttctctgagcagtgggacatgtcaacaggctctgagccagcagtgagggccatgaggaggcgagagggcagccaggtcaaaactgcaggtgtcacccggagccaagggtaccctggcacaggggccctcgctcgtcctgagtcgtgccccttgcaagaaaggctgaggccacaactctgctctgggtagagaggggatgctgggagaatcctcctgcagaaagcagacctaaactcttcgtcactgctgtcccagttacaacggctggggaataaacgactccaacacttagtggagtgcaaaaccaccaatcatgttcatggactctgaaggtcgggaatttggaccgagccccgagaggacagcaaagctctgctccacatctaggacctcagcagatggaaggctgggcctcatgcacgctggcggctggtgctgctggcggctggggtccccctatggggagtctgcgcttcctcatgatgtggcggctgggttcccagggcaagtaccccatgggagagaaccaggtggaagccacagtgcagtttacagtctagcctcagacgtcacacagcaacactgccacatccgtcatgaggcccagacctgggacaggcagaagggaaatagatgtcacctgcagacagcgagtgtccagaaacactgctgtggccatttttggacaagacaatctgcctcctggaaccatccctgcctcatgtcagtgtcagagatacagtggccagcactgtaactccagtcctggggggcctccagagcagcatcacagagaaggaactggagccccaaacatgaccagacccacttgcaagccccacggcctctcagaagccacacttagccagcaggcaagctcagcctccaattgcagctccagcaagacctggctgcaggacctgcacaggtcacaccagcacgctgagccatctcctcttttgtaacagggcagtcataaggattccaccgggaatgggataaaggtcgacaataaagatcacgacaggatgggaaggcattgtcaggccagggcctccgaggggcagcccggcagaagccccaaaggcagttggcccgggtgtgtccactccgtgcccttcttcccaggggccgagccaggagaccacccccaggagaaacagtccccttttcttctgctgccaattgtgctccaggctgagtcctgcccagcaaagatcccagtcttgccaggctgggatcctgccaagtggcctaagagcagaatgattaccaacttgtaagcctgaacccctctccctgagacagcaggagcagcacacaccatggccaacgaaggcagaaacggagtctgcactgaagggagggtagcactggaagcaggggaagctccactgtggccccagtcctcagcagagagcccagtccctgtggcagccaggggccttgtcactcaaaccagccacagcctctgcagcccacctggtaatgagcattctggggcaccaggcagcaaaggctgcaatttatacattagcccagaataatcactctccaggcggagatgacacgcagtgaggcagccagcatttagcgggatcctctgatcacctcaaacctccctggttaagtacagtgtccgccctggcaccactgagcaggcagaacagctcctcggcggtggggagtacctggaacagcaggcaccatggagggtggaggagggtgcccagcagcccgagcctctgctctatctcacaggtgagccgggagggcaggacctgcgctgcgtccagaggaaggcagcaaataacacacccagcatatcagcgatgggcctcagagaggcggttccccgatccaaacccaacccaccaccctcaggcacgcacagggccatgccacacctgtcgatgccatgcaggagtgacggcctcgcagggccaaaccctcaggcattttcacagacggagaagctagaatttcaggattaacaaactgcacttctaaacaaacaaggcccccagttgacagggctctgatgagtggaggaacaccagggttcttggtctcgagttgaattagagaaaacgacatggacacacgtggagtggttttaaggagcggagagtttaataggcaagaaggaagggagaagacagaaggaagaagctcctccatatggagacagagggaggggggctccaaagccaaaagaggaggtccccaagtgcagtggacaccagccaagtatatatgcagaggctggaaggggcgatgtctgatttacatagggctcaggggattggtttgaccacgcatgttattcacatagcccactaaaaagctggctctcccaccctagtcttttaatatgcaaatgcagggagccatggatgttctacacatgtggggatatttggggatgttctacacatgtggggcggccatgttgccaggaacatgtgaggcaagggtaagaaggccttgggaattgccatgttgggtggacccagtttctaatggcctgcatttgcatatcaaaggttgccggcctggctctaggagctggggctttaccagaaaacttcccaaggaccccttttcctctctatctacctaaaacaatttctcaataactcctaccacacagtcatactccagctctaacatcccttcccagccaagggtgcagggctctggcgagaggcaggctgtgacagccctgaccgcatgcccttcctcctgcagctcttccctcctccccgtccccaggcccaacccagctctctcatcccacctcccctacccacccccagcccatggttggtagccatggtgccctggccaggctgctccttactttcccatccaggtggcatggctggcaggaagcctgggcacaaacagggtcgacttcccagtgtcaacatcgatgacaccatagcagcctggctcagtgacaccgaacgcccagtgaaagaaggactcctgtggcgggaacaagaactattgttagccagtggaacatgaggtgcaaggagggaccggtggctgcatcacagcaccctagagagccagctcagaccgacagcctcctgtaactgaccccagccccagacatcccttcccctcagcactcgactccccagctcatcctcccgtagtttggcagggggcagcctggcagctcctctaccctgctgggagccctccctgatgctgtgtcaggcatgtgcctgagtccacctgtatccccacccccgggcccacaacagggcgtccagcagcaccacacgtccagctcaaccctgcctctctgccacgtgcaggcaggcaagacgccccccggattctgacgcccaggccggatatctgcacagaaatggattcctccatttaagacttcttacttccctctcccacccccgggacggctgatgacttcagtgtttagggatgaatgctgcgctaaaaggacgtcataaaggtatggtggaggaggatctcttccaaaattagccttgcataccatcagaaagggagccaacagctgaatttaggaaatcggtttttaagccgcagagtatttaaacctggagaagcatcaagactagccagagaaaacttatttagacctccatgtttctcacagccatgggattgcaggcttgcagctgcgcgaacaatggagtggagagacgggacccttcaggcaggaggtgcttttagtaaagaaaaaacacagtctgcggtcgctcagcaatgggtctcagcccatctgtggcctgctggggcgacagggtccagctagggaagccacgccttcccatatcctctccacactcagctccccttcgcattcccatctctcctcttgccaggatgctgcatggacacattccctaggctctgcctgccccagagaggttctgaagttcctgctgtggtcaggctccagctctgggcatggcagcggggagaaaacagcactagatttagagttggaagacaaagttctaatcccagctccacctcttggcaagtcatttcccctctgagcctcagttttctcatctgcaaaatgggtataatgctaagatgtgtgaaagtgggcccagctcagagcctcacagtcttcctgggtgggtgtcctcatgttcctgtgcctggggactgagtgctgccagtgactctcagccatggccaccatggccaggctggtttcctgcagctgggccacccgctgccccacatcttcaagttctacatcttcaaggagcccctggaccacttcccaggcgaggaaacagaggctcagggagggccacaaggggcagcactggccaagctggggcctccaactcctgctcaggacagcagcaccatcacacacctgctcacttgtggccaagcggggaggctcacctggcggaagaggaccccggtgtcggtgcagtagcgctgagtctcctccccgccctgcaggaccacgatggagccggcctgcacagcagggttcttccgcagccgctcacacaggcgctgccggttcaaggcaaagagcgccagcggcaccttcagggtttcattccccagccaaaacgagggtctgcagaggcaagagcacacaccgccacacaggcctctgttagcatctccaagcatgcccacacctgaggtcggggtgaccggaggcccgagcctgccgtgggacccccatcagcacggggcaagctgcccaagctccacctacttatgacccagaaacagcccctcactgatccccctgaggaccacaggggcttgtctcccctccaccacccatgctgtcctgactccacccccctgctcctctgccccccaaccaactgcacagcaggccacagtgaccccacgctcccgaatctgcagcaggtccccagtcctcactggccacttggtgcccatgaccctgggggccactctctctgcggaaaccttctccaacagcagccggtccaggctccctaccaggcaggcccctggctcccggctcaacctccctgctagaggccagcttggcccaaccctggggcctcttccctaactggctccctccctcagctcagctgagcttacccagtccttcagctcaaaggaccatctgcatctgcagactgatgatgtccagctccagactcacagacccatcagccaccctcagcaggcagaagatgcacctgaaccaaagtcgctcctccccagcctcccccgacacaaagcacctgcacctggacagtcccaaaggccatcctggcctcctatctcatcccacctcctggccaccagcaaggtctaccctcattgcacatccccatccccagggccacctccccatgtcccgtctggacaactgcaggcaactctcaacggtgctcttggccgcaacttccccgtggcctggtctgcaccttctgccagaagggccctttcaaaatgccaatcccagcacacactccctgcccaaccccgtgccagctggcttctctgagtgcagacttcactccccagccacaagggatccagacccccagttcacccttggcttcctctactgtggcacgggcatcctcgctcttccctaaacccccagaacactccagcctttgccgctgcggcgccctgtggggaatgctcttcccaagggcatcccatgcccttttacccagcctctgcagaaatgcccctttcctacccaccccagcctctgcagaaatgcccctttcctacccaccccatcccccagctctcttcgtgtctctctagagcccccatcactcttcatttatttgtttgctggccctccaggtaacatgtaagctccctgagggcagggacagagcaggtgtcggtatctatggaatgaatgaaaaaacggatggtggtcccagcaagcaggctggaggccgggtgtggagagataatggggatgaggtggaggaggagtaagcaggggcagggtgtgcaggagggagcccctgcggctctccagccagggggcagtgggtgggcacggaggtcaaggaggcagggacatcccagagctggtgcgagcagagagctctgcctggggactgcagtgaagctgtggatgaaacctgccctcacagcacagcacggtgaagtggtctggggcacctcacactcacctcacatgggaccctcagaggccctgaccctcctgccagggtcacatgagcaggtcacacctcctgcacatcttggctccaatacgaccttttccggatggtcttccccggcctccctctttgaacctgcagctcttctccttgcccaatcccctactagtccctggcctgaggtttccccacttgccctccagatacacccccctgcactgtgcccagaggccaacctacccgacctcctcagcatgcacgctgcctcctgtctccaggcgcactgagccaacgacaggcacatgaggctggggtcaggaggagagggaggaagacagtggatccactcccctggctccctccctggggaccctggaactaaatggctgggggcacccctccatccagggccgctgctctgatgacagcgccctgccccacagcacagcccctgctgggtttctgaccaggttccccactcttctttccactgtcttcctccctctcctcctgcccctagcctcatgtgcctgccttcccttaacgttcgcacagctctgtgtatcgtcccctctctcaactctccttagtggccccctggagtaaactcctaacgtggggccaggtccctggctaacacaacacttagcacacagcaccttccaacctaaacgcagcgggtgctgcctggtgcttcctggtgttctccggcccgccgcctcgggtggaaacactgggagatggagctccaggttgcctcggtcactgccgtgccctcgcctggtgccttgcctgacacacagcaaacgctcaacacatatctgctgaatgacacacggggccacacacacagctgtgggatgagaagatgccacatcagccgcagcagggcaggaagcagccctggagtcccagcctgcccaggaagggtggagggtcagaagcagccgcacatgctgacatgactagagccccgcccgctcccccacgtgcccttcctaccctcccaggagggtgagcaggtggctgggtggacaccagcggccagagcttcctctgggctggggctgcttttctgccacgctcagccattgggatgaaagggcagagggaagtcggtgagagttcgtaaacatgaccacatcccagatggccatgctgtcaggagctaaaagtgcagtcaccagcaccttgtgctcggatatcccccatggcctcccacgccctttcccttcactcaggaaagcccatggtgggatgggcacagaggcaaaactcgtctctgcagaatccccaacagcttaggggcaatgacaccgagaccctgctatggacagcctcagccacagtcgtcgaatagcatgaccggccgaaaatgcccatcctcagccaccagcctgcatagcccagcccagcccacctctcccacactcccctctccctgcctggccacactccttaatcataacaggtgctggctccccatggcctgacaccatgcccccacctgtaatgctcacagaagggctggccttccccttgttcagaaccttctgagagacaaatttctcagggcacccagactgggatcccaagggctgagcagaaaacttgataagccaccttctccttgaacactcagctgccactgcaaagaaaatctacaaccatgcttatttctccatggggctccgccagaacagaacccaccctgtgcagggctctgagcataagaagggctagcctgagccacgaggcaaggcaatatgctacagtcattaattacaggacaccaagtaataaagttttatagagacatgccctttgatttcccatggcataaaccaagcccccagagagactgtcaggctcagagtcaacacagacgaattcttcctgcaaattcggcaaatgtagcaccaacaaaacatctctaacaggtttctgctgcagcttttgttaactggcacccagaatttaaaaggcaaaagccattatcatccccaggtcccagggtaaataagccatgctttgctgcagacagacaaggcacaagagctccagggcctcagagacccacagaacaagtctctgagccccagaggccaggacccccgctgccctggaaacaaccaagacccagtaagcagcccaggaccaagaacggagtgaccaagactgaggccagtcctcaaggagggtatgatgccactgcccccacaagccgtctctgtctccacacaacccacacccccgtatcagtactgggacaccctctcctcaacagccacgtgcagggctcttacctaaggcctagggacccccaaggattcatcctcaaattcaggggctccatctactagatgggaaaaagctgtacctttattttctctaacctccaattcgaatttacattttcttcagttattaacataagcaacaaactactcagtgtcagcaatgcatgttaatctgtcaccaacaaaaatcaaaggtattttaataccatgttattgctcttccagtatctcaaaatatcacttttgctccccacaacttcaaagttaaagtagttgggccaggcgcagtggctcatgcctatcatcccagcactgcgggaggcaggaattcgagaccagaatgggcaacatggcaaaacccccatctctaccgaaaacacaaaaattagtcaggaatggtggcttgtgcatgtggtcccagctacccgggaggctaaggcaggaggaacgcttgagcactggaggcggagactacagtgagctgagatcgcaacactacactccagcctgggggacagggcgagaccctgtctcaaatttatgtaacattttgatacctgtatttccatataattgggttttacttttgtaatattatgtacttatttcatacatttaaaaacattatgccagccaggtgtggtggctcatgcctataatcccaacattttaggaggccgacatgggcagatcacctgaggtcaggagttcgataccacctggccaacatggtgagcccctgtgtctactaaaaatacaaaaattagctgggcatagtggcacacacctataatcccagccactcgggaggctgaggcaggaaaatcacttgaatctgggaggcggaggttgcagtgagccaagatcaagccaccgcactccagcctgggtgaaagagcaagactccgtttcaaaaaaaacaaaaaacaaaaaacaaaaaaaaacctgatgccgagaatggtacgtaggtttcactgatgcccgtggggtctaccgcacagacaaggaaagatctctgcactagaatgtggagccactggccaggtgcggtggctcacgcctgtaataccagcacttggggaggctgaagtgggtgggtcacgaggtcaggagtttgagaccagcctggccaacataatgaaaccccatccctattaaaaatacaaaaaaattagccaggcatggtagtgggcacctgtaatcccagctactcgggaggctgaggcaggagaaccacttgaacccgggaggcggaggttgcagtgagccgagatcgcgccattgcactccagtgtgagactccctctcaaaaaaaaaaaaaaaatgaaatgtggagccacttctagacagggtcacaccgctaagttcccagtaggagaggccagccaaggaccagccacctcctcccctcagcctccagcgtggggccaggcaccagacagatgctcaggcagcccactgggcaccagaccgtaagcgccaggctggagagggttgccacggcggaacaggacctcgaggcaactggccagcaacctccaccttgcacctctgtctcctggggcggataggggtgccaagcatacacagaaaccaagagacagctgtgtggagtcaggacctggggaagagccagggaaggcacagggatactcagtggccagcctgcctcccataggcccacccgtccctagcccccagtcggcctgagtcttctgctcctggagcacaaggttcacattgtggggttgggctcttgacccagaatgtgaattctgcagaagactctccagaagaatgctgactccagtgtaacctacggctcaacaggggtacacgtccagggcagttcacctttgcctctttttggctctgcaacagctcctgggagccactcagttaaagaattaaggctatttcttcatcctacccctcggaattctgtccccattccccaccatgactccttccctcaatcactgggagtctcccaggaaagcaggatgggatgctggactaatttagagtaaatccccttttcattcatttcaccaagcaccaatcacagggcagccacagactggccctgcggatacaaaagaaccccaggggttctaaggatgctaggagaggcatgaagggaagcaactcctaacccacaatgggcagacgtgtaaaagtgtactgctggggagaaaactgagtgttctggagttctgagcactaaacctttacccgagggctgggaaaggcttctgggaaagggaaccatctgagctgggcctgcaaatacgtgaagaatcatatagaggacaagaacattccagggctagttgggtgagtgtgcaagggaagaagggaatggaaaaagccatgtgggagagcagatgcagacaggtctggctggagctgacagatttcaaattatcaatcctgtctgtggaaagctcaaagcattgcttaaggagacagcagcagtgccaccaagtgccatgggatagggacccctctccatgaggggatgggaggtgacctcagcgcactctgtctcaacctgaagcctacacccaggctagcaagagaaagtaggatcaaccctgaaacaccccacatcttaaaaagagagatgcattcagagtagattcttgagtttcaaattaaatctgagatgctagtttagggcttcccctactccccaaatcatatggggcacaccccagtcacctggaactctcatggaccccctctgtcccaggctctggtaggattctacagacaaccaaacccaactcccagtgagcccacggcaatggccgtgacttgctggcatcatgcctcgttatgcctgactctatgatctgttctgtgagtgtggctaggagctgagctttgcgggaaacacacttaatcattctgctctaaaggaagccactggggtcaacctcaggctcaaagtacatgggaaagccccataccagactgggatggctcttcccaaggagactgccaggctctggaagctcccacaccctctcaatagcagacctctctaagacctgccactctgttttgcctccctcacccaccctgtgtggtggcccagagaatcggttctgctagaaaagctctcattctggggccaggcgtggtggctcacacctgtaatcctagcactttgggaggcggaggcgggtggatcacctgaggtcaggagttcgagaccagtctggccaacatggtgaaaccccatctccactaaaaatacaaaaaattagctgagtgtggtggcacacgcctgtaattccagctactcaggaggctgaggcagaagactcgcttgaacctgggaggtggaggttgcagtgagccatcatgccattgcactccagactgggcaacaagagcaaaactacgtctcaaaaaaaaaaaaagaaagagaaaaagaaaagctctcattccaggatccagtcagttccagacttgctcccgtccagacatcagcttggttccttcaggagagcagcaggtctcaggccagcttggaatcctgaacccaaatgcaacccctggcactccctgtgagcaccgagccagcctaaccagagagacagcacacccacagctgggcaccagcctgctcagtctaccctttaaaagggtcacaggctggattcaaggatctgaccctgagttccttgacacccatctgagactttgtctgcactgttctctacctgaagggagtctcattgctgaaggactagcacaaaagtcacccaggaagtgaagccttcccacactttatctgagctcagagtccatgcccctcctttgcaaatggcaagaccacacggcaagcagatggatgacagagtcccatgtgtccatctgttccagtggcctgtgagtaccttaagggaagacccactgctattcctggaatatagcaggtgcccacaaaatatttgatttgtatgctctaagctccctcaaccttgggggccaacttagaacccactttctgttgccattttccctgtatcttaaaaagagagatgcattcagtccactagatcccccattctgacctcagtttccaacctggcatctggaatactgctccctcctacaccatgccccctctaccccactgtaccaccagacccacaccttctcccattgaactcacacatagctcaggggagcctaatctttaaaaaacagatcaagcagcttgtaacaaaacccttccagcccatcagggcaaagtctgaagccgccacctggaacaccacaccttccaaccagccccaggcatgcacccctgtccccagaacactctgaactctcaacctttgtcccttaccctgggctcagatgctccctatctgggagattccgcccaacgctctggtgaacccatctgtccacccttcctcccactacgaccactcagctttctttcatttagcccagtatggagcacctactgtgtgcaaggcaccgggctactgagaagcaggtaacatacctgcccttgcactctaaatgcagagaagataaagaacaagtacaaacaatgctctatatagtttatcaggtgatgatgagggcacaaaaagtgggatagatggttagagaaggattccctgagggggtgacatttggcccctgaaagaaatggggaagtgccctgctgggaaaagggaattccaagtccgtctcgaataccgcctcctccgggaagcgcccgggtccctggggtcctcgcaacgccgccctcctacccgggggtcttggcagcgaacatgcgtgtcgaccccagcccccaccgcagccgcacacggtggggccgccagacgcgggcaggtggggccggagccagccaggagggtggagaggagctgcggcccccgcgctgaccctgactcggagcgtgcagctcgccgaccggcgctgggactccgggccaacgggaagaggcgcctacccgcggcattcagcgaccccggctgacgctctcacccgcggtccggccgggacacccatgcccctctccacgccagcgggaaagagcgagggaggcgcagcactcacccggtggccgccgccatgttcgcccggcaccggcgtcacgtgaagtgcggcgtcagctgagcccctccgggtgccaatgcatggggcggggtaagggcggggcagggggcggggcatggagtccttgacccacctcctccagagccaaat

SEQ ID NO: 2675 - DNA, 134945 bp, Homo sapiens; identical to SEQ ID NO: 2674
  source 1..134945: mol_type = genomic DNA

SEQ ID NO: 2676 - DNA, 134945 bp, Homo sapiens; identical to SEQ ID NO: 2674
  source 1..134945: mol_type = genomic DNA

SEQ ID NO: 2677 - DNA, 18057 bp, Homo sapiens
  source 1..18057: mol_type = genomic DNA
cgcagaggcaccgccccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggtgagcggggccgggtcctaagccgagcggaggacggagctaagcgcgggggcgggtcctcagctgggtgggggcggggctaggtgtggaggcggggctctgagcagatcgagggccgaggcgagggtccttaaagctcatctatttcaccattactgatcggctgctataaataaagccagcacctcccatttgttttaatgtttcccttcctcaaatgaagacatgttgccgattacagctcctgtcgcagcacagcaaaaggctttgtgtaaattttctaaaatgtacggacaactaaatcataacattcctatccctttgaggtagttgccgtccctaatttatggagaaggaaagtcctcaggtgaagggacttgctcgaagtcacacagctaataaaatgcagtgcccttaaccactgagccaggctgcctccgccgtttaaccaaaggattagtagtgacagagctgaaaccgcagtaaaaactatgaacggcgagaaaaacagtcctaacattttagttacctgtgtagagttatccctgctgactggatacacaagggttcttagggttttttaatgcttaaaatagcacaagacttctctttttgcccaaccaaagtctgtattagggttctccaaatggaatcaataggatgtgtctatatagaggcaggtttattttgaggacctggctccctatggggattggcaaagtcttaaaagccgcagagtaggcgggcaggctggagagccagggaggagccagcggtgcagttcaggtttgaagcctggccgctggcagaattccatcttcttccagggaggtcactcttcttcctgggggtgtagaaccactcactaaattagcatagcccctgcattttacaggttagggctgaggtggtggaagagggagtgacttgcccaaggacacagctgttagggccaagcagtggctcctgggtttcctggtttccatcccagttcttattgctcatcaccactgtctcatgtttgagctctggccagtttggggtgacaggtgacatctggcctagtccccagcccctgaccttgtcttttgccacagcttaactggcagaagctaaggatgggaaatttgactaatcctgcttaaaactaaagaggcttttttaactgaggagattgatcctcctaaacttaccattcacacacaccttcttcgcacacttcaccctcctatgcctgaaaatgttattagttatcaattaatttcacattaaaaaaattttttttggtcaggcactgtggctcatgcctgtaatcccagcactttgggaggctgaggcgggcggatcacgaggtcaggagtttgagaccagcctggccaacatggtggaaccctgtctctactaaaaatacaaaaattacccgggcgcagtggtgggcgcctgtaatcccagctacttgggagactgaggcaggagaattccttgaacccgggaggcggaggttgcagtgagctgagatcacgccactgcactccagcctgggtgacagagcaagactctgactggggggagaaaaagttgttttcactggctacttttgctggaattaatttcacatttaaaaaattctgggccgggcggggtggctcatgcctgtaatctcagcactttgggaggccaaggcgggcggatcatgaggtcaggagatcgagaccatcctggctaacatggtgaaaccccgcctctactaaaaatacaaaaaaattagccaggcatggtggcaggcgcctgtagtcccagctactcgggaggctgaggcaggagaatggcgtgaacccgggaggcagggcttgcagtgagccaagatcgcgccactgcactccagcctagaggacagagtgagactccgtctcaaaaaaaataaaaaataaaaaaataaaaaattctgaagccaggcatggtgactcatgcctataatcctggtgctttgggaggccaaggtgagagaatctcttgagcccaggagttgaagaccagctgggacaacatagtgagaccttgttcccacaaaatattaaaaagttagctaggcatggtggcacatgccgatagtcccagctacttaggaggctgaggtgggtggattgcttgagcccaggagtttgaggctgcagtgagctgtagttgcaacactgcaccccatcctgggcaactagcaggagtgtgctagtagcaagctctaaaaatttatattataaaaatatatatataatgtgtatatatatgtatatgtgtatatatgttgtgtatactataatatgtatgttccatataatagtatatagtatattttatatatatacacacacacgttgcttctgctccatgaagtttataagggaagttggattttccttttttttttttgatacggagtctcacaccgtcgcccaggctgtgcaatggcacgatctcagctcactgcaacctccacctcccagattcacgcaattcttctgcctcagcctcctgagtagctgggattacatgtgcacaccaccacacccggctaattttttgtattttttagtagagacggggtttcactatgttggccaggctggtcttgaactcctgacttcatgatccgcctccctcggcctcccaaagtgctgggattacaggcatgagccaccacgcccggcctggactttcatttttttaaaaggttcaaagttatagtgcaaggttaagttgcttacagatagcaggtgctttaggaaccctctagaaggaaagttgccatgggctgggtcatcagggctggtcacagaggaaggaggagcttgagttgggcttgatggctgagcagggatgagccagacagagcaatactatagaaacaggggctggaaggatgctgtgagcagctttcagagggaggcgtccaaaggatgagtgcaggcagcgtgcagaccagcctggcagcagccagaacacagataacctcctgggcagtctgatggacagccgagtgacacatgaaagcaacatattttgatgtggctcagagcagggaaggcacggcactgagagtggggtagtctagagatggtgcctggtaggctatggccaaggggcatatgcagagctgtgcctggcacccaggggtgactaaccttggaaaggaagagctcagcagatcagaccatttgagagggaaagcggagcctgggtgactggaagagtgacgtcaccgctgcctgaagcaggggaagacccaccagatttttgtcacatggcctctttcccagtgcagcactgcccccagcacctgcacctccatctatttctgtctgaactcttgtactcttgctacctttctggacagagtagcctcatcggggccctaagaggcagagagagaaagacagtactgaatccctctgctctggggatgcgcctgatgtcacccacttgcctgagagaccctctgagatcactgtggatcacacactcctgctagttgcccaggagccgtcagccaaggtctttgcagagcgagctgtctccataatcagacacctccagaactctgctggagagtgaaggcagcaaggagaggtgcactggctgcgggacgtggggtttctgacctctcagatcattgagtattgtgatcccagtgaagcaacagagtttgagaaaaatcattctgaataatgagaaagaagatggcctggacccaggctgagcagtagaacctggttgggttgtgtttttctggtttattgatctggtcgacgtggaccacgccttgctgcacctctctctgcctcccctgtttcccttttcttgggccttcctaggctccctggctcacggtgcattcttttctcatcacaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggtaagcaccaggcctttcatctttaaaggagatgttctcaaaatgcccatcttagtgggcctggtgaggattttttccaggaagtaggtaggaaaagacagattatccacaggaaaggtgcctgtatagtcaggttacctccccctgttacacagaagtctaaaccagaatgtttgaaattgtattctgcccacagatcacccagagatcaggttcaaaggtagattttggccaggcctggtggaccatgcctgtaatcccagcactttgggaggccaatcacttgagctcaggagtttgagaccagcctgggcaacatgatgaaaccccatctctatgaaaaatacaaaaattagccgggtgtgacagcttgcacctgtatgtagtcttagctacttgggtggctggtggctgaagtgggaggatcacttgagtgcaagaggcagaggctgcagtgatccaagattgtggcactgcactccagcctgggtaacagagtaagaccctgtctcaaaacaaaacaaacaaacaaaaaaaacccaaaggtagattctgattcagcaggtcagggatggggcctaagattgtgccttcccaataagctcccacgtgataccaatgccactgctctgtcaaccacactttgagtaacaagtgcctaaaccactgatttctaccttgattggttagttcaccatcccctccttcctgcaacctgcctcactggagagggggaactggatctctttcctttaagctcactctgcaagcccacctccagctcagaggcttgcatgtcaactccctactctcaactcttggaaggactcaagactttgggaaattgaagagtatttttcccccacgaaaacaatttctgtccacttaatttatttaccttgccattgctaggtaggttttaaaaatgtattaagacccgatgctctgtctcctgcccatccctgggcccatccattcaaggccgcagtgggaagtggccacagccgttcatggtgggccctagaggatgcagtttcttgttctgatttggggaatgaaggttattagactgttgcactccaagctgggttaatagctaacaagtagccaaatcctttgcctgtgaaacatccagtcttagcatcaaaacatgccctggttggggcatgacagctgttgcattcacagcagctacaagattgttgattcttaccagatcttcttgatacaggtttcatatgtcctgagagcccttcccaatacaatgaggacaataaggtgctttccccactctttggtttttgtctgtttgtcgtgggggatggaggaaggctgttctgtgattcagtacaacttcacccagggtggagcatgtcaggctctggcctggctgctgaagggagcctgcagaatgagttagtgatccagtggtcaattttgaactggtggggaccagaggcaccgatggcaggaagcagcaccccatatcctgatcaccttggcatctcctccagccctggcatctaggctgcaagagtttgaggagtgtgaagaatcctctgagttggcatggatggtacctctgtctgcctcccaggagtaactagtctcagcctgccagttaagacaggtcatcttatctcgaaggtcagagccaattctaggcagtagctgccctgctccaggttacaggcagggcttacaaggaacttaccattctgctccggcctgtgtaaccctgggttccttgtgggtgttccaggcaggttcctccagcgaagccatcttgaacacaatgagccaggagctggtcccagcgagccgagtggccttggctggggagtatggagcagtcacttacaggtaagtgccctctgcctgccagactgactgggacttctttgagagcaacttcatccatcacttatgtcctcagcacctggtacagtgtctgatatgacagtagataataaaggcttaatgttggtgatggattttcagttagtggataatttcacttgggaaagattgcaggtaatctgaccccaaatgatgatgcacttgcgtaattcacattggagcaggggagaggaggccccccaaaaatgcccagttcacagtgttgcatgattgactggggttctcagattcctcctaagaaatgcacgggtagagcgccacctatcggaataaactgaactctgtccccaccagagggaacactcatttcactaatagttatgtgcactgatggtgccaagagattttaaaaaaaacaaaaagtggtctgttggcccagaggtctcagtgtggcagcagagagcccagggtgtaagtgctagaatcgagtatgcttgggctgagggagcccaggggaggcgtgtgctgcagaggaggggctgctcagaaagccttctcaaagggacagtttgtgccaccttgtgaaggatgaattggcattacttgggcagaggagtagggaagtggcattcccagcagagggaagagcaagtgaacagcagctacgctttcagctcagaaaagcccatgtccaccaccagcctcaccacaggtggtgaggactgacgcgcaggctatgacagaggagatacttgtgcccacctcaatatttacagcctggctcatgcctgtaatcccagcactttgggaggctgaggtaggcagatcacttgagcccaggagttcaagagcagcctgggcaacatggtgaaaccccgcctttacaaaaaataaattttagccgggcatgggggcaaatgcctgtgatcccagctactcaggaggctgaggcgggaggatcatttgagtccagggaggttgaggctgcagtgagccaagatcatgccactgcactccagcctgggcgaccctggagtgagaccctgtctctcatttgtagacccaccaagaagaggtgggtctgctgcatttttggtgatttactggagggctggtttatagatcttcattctgtcagaagcagggaggcaaaagtatgaaattaagggagtggttgtggaaaaccccttccatggtttggaggtttccaatgtgactgggagtccctgcaggccggtggaggtagctgctcaagtggctgctgcttctcctgaggcctttttggagaaagtggacacctgaatgtcagctgctttggggctaacatgatccttgatgcctccttttgtggcatgagtggcagccggccgacgtggtgctgtcctgctgccggagcaccatgatgtctgctgctgagacctcccatctgacatagtccctgtccctcttcagggactttgttcctttagcagttctcactgtctggcctcaaataacacgtctttttctgttggttcctttttgctccagctgtactgtaaacactctttgtttactgcataccctcagtaaatacctgttgaatgaccggatagatgtggcagcaggtacattacctcaacttctggtacaccttgggagaagctttcccaagaacaccctgggttcatttcctcctagcctctgctctcctggggcccagagattgaaggcgcttaacctgctcatctcaccacgtctcccgccttatctctcacccttctcatcagcaccctacactccaccacgctggcttcatagctccttccccgaatgtgccaggcttctctgtgaccatctcttgagcgtacagctggctatacctgggctgccctcctcccacatttcaggtctcagttcagacacccgcaaccccaccatgtatctccccagtacagccatactcctctgcccctgagctcccatgacacctgctggggccctgacagcctggggctgtgatcatgacttgcccaggggcccgagggtggaaacgatgctctggctcctttgattgcatagaacaggggccactcaggttgactcaagagcaggagcagcgcgtgggcacacgtggactgcagccacacagcctggggaccatgcagtgctgggagaggccggtgccctgctctctccccagcaccgtctaggctctgccccattcgcttccctccaccattgttatgcagcaaagggggctctagcctgatgtgctagaagcagtcacactggatttttgagaaaagccaagctttctattgtgagtcgactcatatggagacaggagttgaattcaaccctgtctccctgtgctagctttaaggcggtaattttattagaggaggtttaaggggtggattctaagattagcaggtgattgatggaaggaaaggagaagtctggacagtccttggacatgcacagttatctgttcatgccaactcatgggtcccctgtgcagatttgggaggagtgagtatgaaacgtgcagtggcaattcaggctttgacatcagcaaacttgttctgtgcaagctgcaattggccttattggttccaaccaatttcagccagttcttttatctcataagcagagggagtttcagcctttcagaaagtggtttctgcaaactcaaattttcttttatttttctgagacagggtcttactctgttgcccaggctggagagcagtggcgtgatcttggctcactgcagcctcaacctccctgggctcaagtgatcctcccacctcagcctcccaagtagctgggtctgcaggcacatgccaccatgcccagctaatttttgtagtttttgtagagacagagtttctccatgttgcccgggctggcctcgaactcctgggctcaagcaattgcctgcctcagcctcccaaattgctgggattacaggagtgagccacgggaatttccatcagttactgattcttgaacttgtaggaacgtggttccactgtccacatgctgttctttcctcgcatctcctgttcctgcttccctttggcctgctcacctctggctcctcatggccccagtgaagtatcgtggcttcctctccactgcagactggcagatttcttcactcacactcccaaaaagagaatctacttccctcccttcccttcgtccaaccatctgggtctcgagtgtcactgtaggttcactgccgttggggcaggtgactccttgggccagtcagctttggctgaagggcagggctggcacacagctggcagagccaccccatccaaaatccagccactgtgcctcagcagggctgtggtttgggggtcggggggcgctccccacaggataaggagcagccagggcaggcagatgacactaccactactagctgcatctggatctattcacttattcaacaaaggtttattacacccatattctatgccaactactgtactagacttggaataatggagaaaattcaggcacagtccttgctcttagggagctcacatgattactcattgatgaatatctctctcccctgatagactgcaaatccatgaggacagggactctgtcttgttctgtgccatagttccacagcattccagcatgatgtctggtactcagcatgcaaacagtgcgtattggttgaatgaataatagtacagctaatagcagctgagagcttcctctgtgctagacacgattctaggtgccttccacactttgacaaccttatgcagcgtgttaacactgcattccccttgcaccctggagattgagcccagagaagataaggacagaggggacacattccaagatagatcccccagtggatgcctgaagccacagatagtaacaaaccctatatatactgtgttttttcctatacacacatacctatggtaaagtttaatttataaattaggcacagtaaaaaattaaagataactaataaaatagaataattatgacaatatactgtaataaaagttatgtgaatgtggtctctctctctctcctctctctaaatatcttcttgtactcacctattctcaaactgtagataactgaaattgcagaaagcaaaactgtggataaggttggggctactgcaactcagccaaggacttacagtggcagacctggaatgcaaacccaggcagtctgataccagggtttctccacctgtgttctgccacatgggatggataggatggatgggtgtacggatggacggacggacagacggatggacaaatggattgaaggatgggtaggggagtcatcagatgtgttctccaacaccatgtacagtacctggcacatagcaaatctatgataaacatttgatagtaagtgaataatgaatgtcagtgccagtgttggtgtggccttaggttattctttccaggtgttgtatctgatgctggcctcatatgtttgtctcacttggctgactagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaagtaagtgacagcagcgcggcagggcctggagctgatacatctcccaaggggagctggttcctgccctccatgtgcaccttgatcagggggttttggagaacagggtcatcacccttccggagaagaaagccatgcaaagggaacatatctgccctggagagcattttccctgtaggacgatttttcatggaaacaaactctcatcttcatccagaacatacttgtcacctagtccttttggtccatttgactgttaaccttttctgtggctggacttatctgtttttaacataaaaaccgttctccttcctcaccctctgtatcccctaactttgctatagtgggtattttattttaaggaaataattatctgcaccattactttgaatatagggagccccaactcttacttcctaatttgaggatggtgagtgggagggaacagaaaggatgctggggaaaagtgggaatcaaagtgctcctggaaggggaagaggaacggcctaaccctaacagtgattaaggttattaggaggccgggaatggtggctgacgcctgtaatcccagcactttggaaggcggaggtgggtagatcacttgaggtcaggagtttgagaccagcctggccaacatgatgaaaccctgtatctactaaacatacaaaaattagcctggtgtggtggcgggcacctataatcccagctactcgggaggctgaggtaggagaattgcttgaacctggaaggtggaggttgcagtgagccaagatcgtgctactgcactccagcttggcgacagagtgagactccatctcaaaaaaaaaaaaaaaaacgtattgggagtcgtcgatgtgtggtagccagaggccctctcccctctccgccagctatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccaggtaggaacctgctgcaccatcagagctctccaggggcactagagggtgggtcaggagcatttaggactgactcttcaggtcctctctggttttgtgttctaagtcatgtctttatttagctccgcacacaagaggttagcaatctctcccttagaacggggtttttttttctctctttgcagagagacagcacttcccaagttcctttctctagcccacttaaagaacaaggacctcagtgctgcaagttttcctaggtaaataaagaggcccggcacagtggctgacacctgtaatcccaacactttgggaggcttgcttgaggattgcttgaggccagcagtttgagaccagcctgggaaacagagtgagatcccttctctacaaaaaaaaaatatgttttaaattagccggaaaaaaagttagccaggcatggtggcatgcacctgtagccccagctacttgggaggctgaggtcggaggatcacttgagcctaggagttaagagtctgcaatgagctatgaatgtgccactgtactccagcctgggcagcagagtgagatcctatctcaaaaaaataataaaaaataataaagtaaaagagaagtagactttagctcattataaaaaataactttcggccgggggtagtggctcacgcctgtaatcccagcactttgagaggctgaggcgggcagatcatgaggtcaagagatcgagaccatcctggccaacatggtgaaaccccatctctactaaaaatacaaaaattagctgggcatggtggcgggcgcctgtaatctcagctacttgggaagctgaggcaggagaattgcttgaacccgggaggcggaggttgtagtgagccgagattgtgccactgcattccagcctggcgacagagtgagagtccatctcaaaataaattaattaattaattaaatttttcaaacaatgaaagctgtccaaatgtaagcccagttgcctctggaaatgagttgcctaccactggaagcattcaagtagaagctgaatggccacttgcctaggaaaattgtaaggagattcatacatctgataaatttttgaactagaagatttaaaataattgactagaggaactggcttttattatttctttatttatttacttatttatttatttatttatttgagacagaatcttgctttgttgcccaggctggagtgcagtggcgccatctcagctcactgcaacctctgcttcccaggttcaagcaattctcgtgcctccgcctcctgagtagctaggattacaggcaggtgccaccacgcctagctaatttttgatttttttttttttttttttttgagactgagtctcgctctgtcacccaggctggagtgcaatggcatgatctcggctcactgcaagctctacctcccaggttcacaccattctcctgcttcagcctcccgagtagctgggactacaggcgcccaccaccacgcccggctaatttttttgtatttttagtacagacggggtttcaccatgttagccaggatggtctctatctcctgacttcgtgatccacctgcttcggcctcccaaagcgctgggattattatttttagtggagatggggtttcactgttggccaggctggtctcaaactcctggcctcaagtgatccacccacctcagcctccaaaatgttgggattacaggtatgagccaccacgcccagctgggagttggcttttttttttttttttttttttgagacggagtctcactctgtcgcccaggctggagtgcagtggcatgatcttggctcactgcaacccctgcctatcgggttcaagcaattctcccgcctcagcctcctgagtagctgggattacaggcacacgccactacacctggctgatttttgtatttttagtagagacggggtttcaccatgttggtcaggctgatctggaactcctgacttcgtgatccgcctgcctcggcctcccaaagttctgggattacaggcgtgagccactgcgcccagccaggaactggctttttaaaggaattttgtgtggacccttttacaaataaccaattctttttttattttttctgagacagagtctcgctgtgttgctcaggctgaagtgattctcctgtctcagcctccttcacctcccaggttcaagtaattctcctgtctcagcctcccgagtagctgggatacaggcacacaccaccatgcctggctagtttttttgtatttttagtagagacaggggtttcaccatgttggccaggctggtcttgaactcctgacctcaggtgatctacccgcctcggcctcccaaaatgttggcattacaggccaccacacccggcaataactgattcttaatgcacctggttcttaggtttggatttggggtttcaaattcaaatcaaagtctcctggggtataagggcccttggagatcatttgaaccaagctctagctcctttggtcttggggacagctccaattactagaacatgatttaaattgagccacacagtcctttgcctggggattttgcagcctgtacttactggaggcatttccgtgttcgcacagcaggcccttctgatcagctctcaggccttgctgacctcctgggccaacactgagccattagcccctgtcagctatgtcttgctggtggctttagtagggacataggagggcctctcagagggaaggaggggaggagaaatggtcactttgcttgctccttcccagacggctgcccctggctggtgatcgcagattttggctgctgcctggctgatgagagcatcggcctgcagttgcccttcagcagctggtacgtggatcggggcggaaacggctgtctgatggccccagaggtgagtcccgagtgtgtcatgcgccatcggcagcccttcccccacatgtccactgaatgcaggagactcgatgccttgtgataacccaacacctccatcttttctgacccataatttggcacaagttccttccctgccactttgctttcctccggcgttccctcatgttccaggagaatgcaagtcctgtcacataaaccaggtggtctaagcagaccccttctgggtctgagccacagctcactcaagctctgggttccttgggacagagttcagattagcccatggatcaggtgatgtgcaggacatgaaaaggttagatgggcgggcagcgtgatgtctcacccactgcttctgagcaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaaggtgaggctgtccccggcttcgaggggacggtgtgggtagaaacctctgttctcgttccagagtgaaggtcaggtttgggccagagccacagtgacagatcctctgtgttaggaaggtaaaggctagttacaagagaacaaaaaacagattttaatgtaggtaggagtaggagcactagccaccacagcatagtcagaatcctagcagttcaactcctgtggcttttttagttgctgaaaaagttgttcagaggccagacacggtggcttacacctataatcacagcactttgggaggctgaggcgggtggatcacttgggaccaggagttccagtccagcctggccaacatggtaaaaccccgtctgtactaaaaatacaaaaattagctgagtgtcgtggcacacgcctgtaattccaggtactcgggaggctgaagcaggagaatcgtttgaaccctggaggcagaggttgcagtgagccaagatcgcgccactgcactctggcctaggtgacagtgcaagtctttgtctcaaaaaaaaaaaaaaaaaaaaaaggctattcagagagagaaaaggaggcatttttgagaaatgtttaatggagatgtagctcatggaagcagctgagaactgatcagagagagatggaaaacatctcctgagagcagatctggacattgtgaaattaatataaaggaatgcaaaggcagacctatccgaagccataattggagtggcagctggctcaggggcaggcttagtgcaaagagctgagccatacctgcaccccagcactgttctgccactccgttaactgctctctgtacgtggcctgctatcttggtgcgcagtgaaggttagaacaacagctgcaaccagttatgaaatgatagaggagactacttacctggttcaagggaccagatagctgtgcacaagaggcactaggctttccacccagggggaaaggctatttcaacaatgcatgctgccccatgcagaggtgtacacatggaaaagcttggagcacgggcaggggacaggcagtatttgtcacctgagtgaagggcatcagtaggagatagggtagaggaagaattgggttgggaccagagaagggaagaccctcactaacaaagcaggctttgggttgagactgtgttaacagatgttctagctacagcttcccttcctgttgcagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacatggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctctgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 2678 - DNA, 6397 bp, Homo sapiens
  source 1..6397: mol_type = genomic DNA
atatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccagagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttccagggcagcaatgaacttcatcaagttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcacgaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaaggtgagtggatcatttgaggtcaggagttcaagaccagcctggacaacatggtgtaaccctgcctctactaaaaatgcaaaaatcagcctggcatggtagtggatgcctgtagtcccagctacttgggaggctgaggcaggagaattgcttgaacctgggaggcagagatctcagtgagctgagatcacaccactgcactccaactgggcgacagagcaagactccatctcaaaaaaaaaaaataaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggtgaggtgggggcaacaaggaccaaaagccctccctacagcttcccagaaaccttgttaccatccccttctcccagagggctggccatagcacaagagaagtgcggcctctggttgagtcttccctgaggggaggaggcagggaaggccctctgggttggaatgacatcccctatctttctgtgttgccaggaacccagacaaccggaggcgaccctggtgctatgtgcaggtgggcctaaagctgcttgtccaagagtgcatggtgcatgactgcgcagatggtgagcatcactgacctgctgatgacagtggggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcatgtacggccctgggtttctcctcttcgactcttctgccccaccccaagcacatccctttctccttcccagcaaagtgttccgcctcatttctccctcatctgcccctgtccatgcagcccatggccttggggacaagtcgtgctttgaggcctctagggagggaaggaagaagtggcagatttcatgggactaagctgtttgatgggtatcttctcccacagtgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattggtgagggggaaccccgcgactactgtggccataatggcttggggagagtgggacccagggagagactggagctgaggttgaagctgcccggtggggcaggggtggggcgagggaccttgaagcctcgatatacatgacaaagggagtggcagggaagagttccatgaagtctgaggggcctggtgctcctctggagagaccctgaatttccccaacaagtagcctcttgcgagtggaaacagccctgtgggtatatggcttgggctgggaaggccctgtttatatgaattagaaaaagacacaccttcctttgtgggatgcagcctctgtctgtgctaggatatagaacttggagaatggagccttgggatggattccagcctaactacctcagctgggagtttttgcagaaacgacctgtacagctgtatgcagtggctctggccatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccgttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagcgtgatcaagggaagactgcagagttagaggtgggagcactgaggcggtggcagatgggtccagggatggatgaagagtgttgtttagggagcgatgggctgcaaaggtaaatagatggtaggggctataggtggagtaaaggctcagatttgcatggaagagaataagggccttccctggtagagatactttatggttcccctctctggcagactcccagtggacagataaatcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggtgagtgttccaagcatctctctccacctcttccatatctccccagagctcctgggcttgttccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaactcagtgcccagggtgtgttgtgaactataaatgatcaggtgttcaggagagggaggtgagtgccaacctgagggtcagggaggggaggctttaaaggaaatgtgacttgataggcatttgaagaggcagagggaagaaaggaaggtgtttcagttgaaagatacaaaactgagaaggaggctggcatattccgggtggggaggagaactagggtctgggagtgtggatggaatagtggcagatgacagggcttttaaagccaagcaggggattttaaacttgatgtggtagaaaatggggctgcgtcaggcacagtggctcatgcctgtaatcccagcactttgggaggccgaggtggatggatcacttgaggccaggagtttgagaccggcctggccaacatggtgaaaccctgtgtctactaaaaatgcaaaaaaaaattagccaggtgtggtggtgcctgcctgtaatcccagctaatcaggaggctgagacatgggaatcgcttgagcacaggaggcaagtttgcagtgagctgagatcacgtcattgcacgccagcctgggcgacagagcgagattctgtcctccccccgaaaaaaagaaagaaaatgggaagtcgctaaggactttgactgggaaactcttccctctctctggtatggttgggtgatgggatcagaaatcccctcctcacttctctagggctcatcttttgtatctttggcgtcacagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctgatgacaa

SEQ ID NO: 2679 - DNA, 6397 bp, Homo sapiens; identical to SEQ ID NO: 2678
  source 1..6397: mol_type = genomic DNA

SEQ ID NO: 2680 - DNA, 24252 bp, Homo sapiens
  source 1..24252: mol_type = genomic DNA
tccagccaatttttttttatttttagtggagatgaggtctcactgtgttgcccaggctgatcttgaactcctgagctcaagagatcttcctttctcaccctcccaaagtgctaggactacaggcatgagccactgtgcctgtccttccatgatgttttgatataggcacacaatgtgttagtttataaagtttgtaataatttatcacaggcagccctaggaaactaatatagccaagtttcctgtttcttctctatatcacatctgctggggctacatgtccaaggtggcttcttcacccacttgtctggtgcctgggctgagatggctgaaacatctggggctctatctccacatggcatttatacatgagtagcttgggcttcctcacagcatggtggtctcagggcagtagtacttttacatggcaaccagcttccccagagtgagcgttctaagattcagaaagtgaaaaatgaaagtttcttaaaacttggttccagaacatagcacagcaaaacttccaccacattctactggtcaaagcagtcacagagtcactcatattcaagaggcagaagtacagacctcacttctttaagccactacagtgacaggtggtgatatgtcattagagaaagccctaaacaagaaccttgtccctcacctgcccccaaataccatggaagatgtctttttttttttttttttttttttggggatagtctcactgtgtcatgcagtggtgtgatcttggctcactacaacctcctcctcctgggttcaagcgattctcctgcctcagccttccgagtagctggagttacaggcacccaccaccttacccggttaatttttgtaattttagtagagacggggttttgccaaattggccaggctggtctcaaactcctgcctcaagtgatctgcccacctcggcctcccaaagtgctgggattacaggcgtgaaccaccacagccagccgaagatatcttattttttcttcattagccacaagatttgatggggaatgtaatttttgtctccatgggttgccttagcaaatgatgagaagaacatgaatttttcaatattgtgctcctagagtgccattgaaatggtagttctgtctctttttctgacagtcctgaggcatcccgggaaatagagcccagcctttatccccggtccccagcacatcaggggaagtgcactcctgtccttattcctcactgcagtgcatgcagggagttctggccatcaggttatcttctatccgtctcctttcccaaagcatgctgggaaatgtggggatgtctccttagaacaacaaaatagttgcaacctttgaagtttaggagaagactagaaggttagtgttcagtgtgtgatctggaagcttgcatttgtaagaattaaagaaagaggaggccaggcacggtggctcatgcctgtaatcctagcactttgggaggccaaggtgggcagatcacctgaggttgggagtttgagaccagcctgaacaacatggagaaaccctgtctctactaaaaatacaaaattagccgggtgtggtggtgcatgcctgtaatcccagctacttgggaggctgaggcaggagaatcccttgaactaggaggtggaggttgtggtgagctgagattgtgtcattgcactccagcctgggcaacaagagtgaaactccatctcaaaaaaagaaaagaaaagaaaagaaaaaggaaaaggaaagaaacatgaaatgtggcttgacggtgaaggacaggtttattttagagaaaaccaacctgaggggggcttttggctgagttaggttagagagcccttttttttttttttttttacagactaaggatatttaagagttttggaagggggtgcttatctaggttcggaatgttttcatgtgaggaaaagtttattgtggggttggaaagtctctggtcggaagggaggctatctgggggttggcatgtttctggtcagagaggggtttatcttagggttggaatgtttctggttatgctgatggtagccattaggctgatgttttggggctggatttagctgatttttttttgagacagagtcttgctctgtcacccaggctggagtgcagtggtgcaatctcggctcactgcaagctccacctcccggattgacgccattctcctgcctcagcctcccgaatagctgggactacaggcacccgccaccacgtccggatttagccgatttttaatcaagaggaactaagaatggtggtgtttgttcaagatggcagtgctcctgctctgtcagcatttggagtccagaaatagatgtggaggcagcccccaggaggacttccaacctaggcaggggcctcaaacatgacccctgattccaggagcctgtgaaaaggtgtcccccaccatttatcctcccaaagatagacactacaaagaagggcatacctggccttgtccactggtacaaaatctttatgtaagtataaaataaataatatgaatattaattaataacaacaacacaacagcggcaacaatattaataataacaagagctctcccattggcccacggccttcctccagcttttctcttctgcttcacacaactttgtgagatagctgttttcatagctgggaaaactgaggcccagagaggtcggcacactggcctgaggtcacacagcaagtctgtagggctgggagccgagggaagggcaaaggggtcccccggatccagccagggcagagagggggatttcaggtttaggtccagaggagagtgcctccccacagtctggcagtcattagcagggtgatggtgaggctgagatgggcagggccaggctgaggagcagccccactgcggtactggacatccaggtctgggtggttacagccacttttagtacagcaggagacatcaatgtggttcatgctgaaggcgtcacccaggtgggcatgttggcacattgaggcggttgcacagcctcttaccatatagctttggtttttcggttctgaggaaagagaagacggagtgagacttccagctcctgggcccaggactggaattctccagtaggtgacctgccaccttgcagtgggtgccaccttcactaccacctagagaaagcagcagttctcagggccaggtgtggtggctcatgcctgtaatctcaacaccttgggaagccaaggagagaggatagcttgagcccaggagttccagaccagcctggacaacatagcaaaactctgtttctacaaacataaaaaagaaaaaaacagctgtagtcccagctacttgggaggctgagatgagaggatcacttgagctcaggagatggaggctgtggtgagttatgatcacgccactgcactccagcctgggtaacagagtgagaccctgtttcaaaaaacaaataaaaagaaagaaaggaaggaagggagggagggagggagggaagaaggaagggaggaagggaagaagggaaagaaaagaaagaaagagagagagagggaggaaggaaggaaggagaagggaaagaaggaaggaagggaggaaggaaggaagaaagaaagaaagaaagggaaagagagacagagaaagaaaaggaaagaaaaaaaaagaaagaaaggaagcgagcagcggttcttaaagtgtggctcagggaccccagagaccctttcaggagatctgtgatttcacatggctttttcactctcataagtgtacaatgggcttttccaaaaactccaggacatgtgatattgcaagagactgaaagcagaagcttccatgaggacccagctgtcttctattaagctggacattaaagagatgtgcaacacagcaaaataatgccagttttctcattacgctttttttttgtttttttttttgagatggagtctcactctgtcacccaggctggagtgcagtggcacgatctcggctcactgcaacctctgcctcccgggttcaagcaattcttctgcctcagcctcccaagtagctgggactacaggcgcgaccaccatgcccagctaatttttgtatttctagtagagacggggtttcaccatattggccaggctggtctcgaactcctgaccttgtgatctgcccgccttggcctcccaaagtgctggtattacaggcgtgagccaccgcgcctggctggttttttttttgttgtttctttgtttgtttttttaagacagggtctcgctctgttgcccaggccgcagtgcagtggtgcaatctccgttcactgcaacctccacctcccaggctcaagtgaccctcccacctcagcctcccaagcagctgggactacaggcatgcaccaccatgcccagctaacttttgtattttctgtagagacaggatcttgctatgttgcccaggctggtctcaaatccctaggcttaagtgacccgcccaccttggcctcccaaagtattgggattataggcatgagccaccatgcctggctatcattacattttttctttggaaactatacttatttttcattaaaatgttatttatcttaatgtgtaatgagtttttattgttataagatgaattcataaataaatctttaaagatttctcagttttggctgggcacggtggctcacatctgtaatcccagcactttgggaggccgaggcaggcagatcatgaggtcaggagatcgagaccatcctggccaacatggtgaaaccccgtctctactaaaattacaaaaataagctgggcatggtggctcatgcctgtaatcccagctatgcaggaagctgaggcaggaggattgcttgaacccaggagggggaggttgcagtgagctgagaccatgccactgcactctagcctggcgacagagcaagactccatttcaaaaaaaaaaaaaaaagatttctcagttttaattttaatttaattttattttattttattttttgggacggagtttcactcttgttgcccaggctggagtgcaatggcacaatcttggctcaccgcaacctctgcctcccaggttcaagtgattctcctgcctcagcctcccgagtagctgggattataggcatgtgccaccatgcccgactaatttgtatttttagtagagatggggtttcaccatgttggtcaggctggtcttgaactcccgacctcaggtgatctacccacctcggcctcccaaagtgctaggattacaggcgtgagccaccactcctggttctcagttttaattttaatgtggcatttatctatagaaatcactgatataaacaataaagagtttttttttttttttgagacaaagtctccctctgtcatccaggctggagtgcagtggggtgatccccactcactgcaacctcctcctcctgggttcaagtgattctcgtgcctcagccccctgagtagctggggttataggtgcacgccaccacacccagctaatttttgtaattttttgtagagacagggtttcaccatggtggccaggcttgctctcatactcctgacctcaagtggttctcctcctcaccctcccaaggtgttgcaattacaggcgtgagccaccacacctggccaaaaataatttttaaaagcatgaagaagttgagaccaaaaagtttgagaaccactggaatacagagacctttccaggacaccacaggatgaaagcccaagatgtcttcagcaaatccccacaacccacgagaaatccaccaaagaattccatttttctttttgtagagatgggggtcttgctatgttgcccaggctggtctcaaactcctggcctcaagagatcctccggcctcagcctcccaaagtgctgagagtacaagcttcagccaccgcacccagccggaattccacttttccatggcaaaaatgtccacatcctgatggacaagtcctaattccttacaataatattcacccacctgaaggaaatcccaccttttccacagggagacccaccacagttaactccagcttaactggaagtcaatctcttgcggaactctccacccccaataagtgttccctcccagcctcggagagggcctcaccgtgagtgccggtggctaccagacattgattcatggggcctcggcagtcaatgaggaaagtctcttcagaggagcatccatgggtgctgttccccttgcagctgtaacactggcggccattctgcggcagattttcaagctccaggacttaggagaagaccagagacacagagaccaagaaaattagtgcttggatctccacttccttgaatgacctccccaggacttccactccgagccagagatgtcatggagccaccttgtggtcaggcgtctgaatggcatttggagggggatggttttcgagggcttgagagaaaccccaactttcaactccccatgagtcccatttctggccaggcaccgtgctgggtgctgggtaaaactatgtaagatgaaactgtccttgctctcacaaaagttacaacttatttatttatttttgatacagggtctcagtttgttgcccaggctggagtgcagtggcgcaattgtagctcactgcagcctcgaccaccccggctcaagagattcttccacatcagcctcctgagtagctgggactacaggcgtgcaccaccatgcctagccaatttttctgttttttgtagagatggggttttgacacattactcaggctggtctcaaactcctgggatcaagcaatctgcctgcctcagcctcccaatgttctcggagtacaggtgtgagccactgtacctggccagaacttacaagttattactattattattactaaaaaattttttttgagacggagtcttgctatgttgcctaggcttgtctcaaactcctggcctcaggcgaccctcccgcctccgcctccaaaagtgctgggattacaggtgtgagccactgtgcccagccagaatttacaatttagagctacactacccaatctggtagccactggccacatgtggttgtttacatttaaataaattaatattaaatcgaatcttaaaattcagttcacatttcaagtgctcactgaccacatacagtggtggctgtaatattggacaggacagatagggaacatttctatctgttgacagtgctgggtaatagagacagggatctagattacactggaggggagggacagtgaaagcatccctgaagatgatacattaaagctgaggcctaatggatgagaagttgccagcagggtgaactcttggggaagatgtgttctaagggaggatattcatctgcaagggccatgagaccagatgggctttggtgattatagaaaccaaatgaacgtcagcacagcggctcatgcctgtaatcccagcactttgggaggccgaggcaggagaatcgcttgaacctgggaggcggaggttgcagtgagccaagatcacgccactgccctccagcctggctgacagagcgagactccatctaaaaaaagaaagaaaggaagaaagaaagaaactaaatgaaggccaggtgcagcggctcatgcctgtaatcccagcactttgggaggtcaaggcagaaggattgcttgagcctgggagtttgataccagccccggcaacatagtgagaccccatctctacaaaagttttaaaaatttagctgggtgcggccgggcgtggtggctcacgcctgtaatcccagcactttgggaggctgagtcaggcggatcatgaggtcaggagatcgagatcatcctggctaacacagtgaaaccctgtctctactaaaaatacaaaaattagccaggcatggtggtgggtgcctgtagtcccagccactcgggaggctgaggcaggggaatggcgtgaacccgggaggcggagcttgcagtgagccaagatcgcgccactgcactccagcctgggcaacagcgcaagactccatctcagaaaaaaaaaaaaaatgtagctgggtgcaatgatgcgcatctgtagtcccagctacttgggaagctgaggtgggaggatcactggagcccaggagtttgaggtggcagtgagccgtgattgtgccactgcaccccagcctgggtggcagagcaagaccctatgtctaaagaaaacacaaaaccccaaaaacgaatctaaacaaagactgtgaggcagacaggtgccagattacataggccaacagaataaggtctttggatcttattctaagaggaaggggaagtcattgaagtgcctgagaaaggagggtgacatgatctgatttacattaaaaaataaaaaattggtggtgcatggtggctcatgcctgtaatcctaacactttgggaggccaagcccaggagttcaagaccagcctgggcaacaaagcaagaccccatctctaccaaaaatacaaaattagctgggtacggtggcatgcacctgtagtcgcagctactccagtagcttaggtgggaagaattcctgagcccaggagtttgaggctgcagtgagccatgatcatgccagtgcactccagcctgggtgacagagcgagaccctgtcccccccataccccccaaaaaatcactcgctgctgggttgagccttggctgtagggtggcaggagtggaagcagggagaccagagaggaggtcattgcaacaacctgggcaagaagtcagcgtggctcagcccaggtggtggcagtggagcaggggaggagtgggaaaatttgagagagacaaaagagacaggaagcacaggtcttggcgagggctgatagtatcattgaatccttacgaagttcttctttgaagaaaggcctggctgggtgcagtggctcatgcctgttaccccagcactttgtgaggctgaggcagacagatcacttgaggtcaggagttcgagaccagcctggccaacatggtgaaacccccatctctactaaaaatagaaaaattagccaggggtgatggtgggcacctgtaatcccagctactcaggaggctgaagcaggagaatcgcttgaactcgtgaggcgaagtttacagtgagcggagatcacgccattgcactccagcctgggcaacagagtgagactccgtctcaaaaaaaaaaaaaaaaaaaaaaaggcctgatactcccatttttcagaaaagcaaacagaggcccagagaggacttgattgccagagagtgactgcgcagctgtctgcctgagtgcatgcccctgcccgaccccaggccttgcctgtgtctcccgttccttacttgggccctcgttgcatttggtggtgttgcagcatttcaggaagtggaaggtgtcgttgttgtggaaaccattggagcccgggcagccgggaaggtagccacagccacggaggtggcggtcatcctttggacgccctatgggggccaggggacagaggtcagatgtcagattgtgaatgagggactaagatgggatttgcccgaaatagcaggcattcaaccattctctacttcacccttcatcataagaccctcattttatctagaacagtcatagatcttgtcgaaaactacatattccagcctctccaggtagtcatgtgatgaagttcggactaatgtgatataaatagaagtgctttatgggacttccagaaaggagaacccttacaaaaggaggagtgcccccttttttgtcccttctttccttcttcctccttcctggaacttagatgtgagacccggagctctggcagccattttagactatgaggcattttgagaatggaagtaatgtgtaagaaacaagagggtggccgggcgtggtggctcacgcttgtaatcccagcactttgggaggttgaggcgggtggatcacaaggtcaggagtttgagaccagcctgaccaacatggtgaaaccccatctctactaaaaatacaaaaattagcaaggcgtggtgatgcacacctgtaatcccagctattcaggaggctgaggcaggagaatcacttgaacctgggaggcggaggttgcagccagccaagatcatgccattgcactccagcctgggtgacagagagcaagactctgtctcaaaaaataaataaataaataaataaaaagaaatgagaaggcatctgggttcctggtgactctggacctgtccttgtggccctggacttcctatcactggacctcttgtgtatgagagaacttagtcccttgctgacatccctgttactttggggttgtttgttaagtgcagtcttagggaggagcagagcagggaggaggagttgccagcaggttggggctcaccttcttcaccttcctggatccagtgggtcaccacatccaggcactgttcttcagggctgcggcactgcaggctctggtgccggcccctctcacagctcatgtctgatgagccacaggaaatgcattcgaggtaacggcttcgggaataggtgacagcccggcctgtttggaagagggggaggggagtgagactccatggggacagtcctggagccccagctctgcaaggactcactcaaaatcaattcctccttatcccaccctgcagccagtcattgagccctgcctattctgcctgctgaatctttctagaatccaccccctcctttccagccccatggaccagtccagctcagacctccttcaactccagctacctccctagcctctgggtttccattcttgtcaccccctactcaccccagtgcagcatctccacatggccctagaaacatttctttcctttttttttttttttttcccgagacagagtctcactccgtcacccaggctggaacgcagtggcaccatcttggctcactgcaacctccactccccgggttcaagtgattctcctgcctcagcctcccgaatagctgggactacaggcgtgcaccatcacgctgggctaatttttgtatttttagtagagacagggtttcaccatgttggccaggctggtctcgaactcctaacctcaagtgatctacatgccttggcctcccaaagtgctgggattacaggcatgagccactgcactcgggcccttagaaggatatttctaatactcatatctgaccctgtctctcctctgctcaagactcttccatagctccctactgccctgaaaataaattccaagatcctcagcatgggattcaaagcctatcaaatactggggcctgagcacctctcctgcctcgtctccctccactacaccctgagactctgctccacactgacttcccacagtctgcgacgacacatgttccctggcatccaggcctttgcatatgccgttgtttctgtctagaacacctttcctttgctctctgccttccctaactcctactcattcttcaggtgtcagctctaatttcacctcctctaggaagcccttcctgatccaccaggctcccacacacccctgtactcccccatcccactctgggtggtcactgtctggtgacaggtatgtctcctctactggactgtgagcccccaggagggcagggccaggggctgtcttgatcactactgtgtcccaacaccacctggcacatggccagggacagataagatattcaatgcatatttgttaaatgaatgaatgaatgagcaattacttaaaacccttctattgttccctgtggtagcctgtctccaaaatggcccccaataatctctgctccctggtattcatgcccttaaagaatagggctggctgggtgcagcagctcatgcctgtaatcccagcattttgggaggccgaggtgggaggattgcttgagtctgggagtttgagactagtctgggcaacatagcaagactctgtctttaaattaaaaaaaaaaaagaagaagaaaagaataaggatgccctatgtagtcaactggatattatggaaatgatggtgtatgccttctgtggctagatcatagaacacatgcctggctctctcacttggatcactttttctggggcaagcagcagccatgttgtgaggacactcaagtagcaccatgggaaagttcacgtggcagaactgaggcctgtgccaaagccatgggaggggagcattcatgtgagtgaagctaccttaggagccttcagatgactgcagccccagctgacatctcgactgcaggctcatgaaggatcctgagccagaaccacctagctaagccactccagggtttttgaccttcagaaactttgtgaaataacacatgcttattttattgctgcaatctgtaatgcagcaatagataatagataagcaatagataatacactacctaattgtcccagggatcaaagactcacttgactgattcctgatcacttcgccttttgcacgaaccttgtggtgttggccaactggatccgttacttttccctggaaacaccagagtcattcctctacccagcccttggctcacaccatttcccatgcttggcatgccctccccgtcctgacccaagacacatctaagctgagtccaggccaagtcttaaaaaagtgagaggaccatgtcagccaaggttctcaactggcaggccgctagctgtaattaggcgaatcatttacatccaaagcccaatcgtccccctcaaagaaaaataactacaaggccacccacgtcttctcacacaaacttccatgaaaatgaaaacacaaattctcaccattgccaacatagctgttcatacctagaacaccttttccttgagccctactttctctaactcctattcattcttcagctgtcatcttcaatttcacctcctctaggaagccctccctgacccatcagcctggaacgggtacctgctctgagctcccactgccccttgaattccccatttctagttctgcccactctgggtggtcactcatgggtctctggtgtgaactcttgtaaatgccaatgatccttagggctattttcctttttcttttcttttctttttttttttttttgagatagggtcttgctctgtcccaaggctggagtgcagtggctcactgccacctcgacctccctgagctcaggtgattctcccatctcagcctactgagtagctgagactacaggcatgtgccagttcacctggctgattcctgtatttttgtagagacaaggtcttgctatgttacccaggctagtctcgaactcctggactcaaatgatcctgccgcttcggcctcctaaagtgctgggattacagacgtgagtaccgcacctggccagggctctgttttaagccctttttatctctcacagtatagactctctcatggggtaaatattgacatgacttcatttccatctatctgctcatcactcacaaatctctctctagtctagacttctctctgagctccagacacgcaactgtctcttcgaggccccatggctatacctcaaacacctgtcctaaacaaaactccccatcttctcccacaactgctctttttcttgaagtccacgcgtccaaggcggccccatccagtccccggggcagaaacctggcagacccccttatcttccacatctgtgcatcaaccgacatgcttctactgttctgtcttctagctccttaatccttttgctctgctgtttctgacctctatcaagcataactgccgagttcttcatttgagtcactgttctatattttctgttggactcttttaaaaaatggattccaggtgctaaaacatatcctttcttctgttttcctgaatatatcgattgtagcaattttcatgtttcctgtcctataatccaatatctgagttgctacaattctgtttctacagttggatttttctcttggtttctggtcaattggtcccttttattttcttcaggataccttgtaaggttttttgttactgttttttattttttgttttttgttttgttttgttttgagacagagtcttgcgttttgttttgttttgttttgttttgttttgagacagagtcttgccctctcgctcaggctggagtgcaatggtgtgatctcggctcactgcaacctccacctccctggttcaagcaattctcctgcctcagtctcccaagtagctggtattacaggtgtgtgccaccatacccggctaattttttttttttttgtatctttagtagagaaggggtttcaccatgttggccagtgtggtcatgaactcctgaccttgtaatcctcccacctcggcctcccaaagtgctgggattacaggcttgagccaccatgcccggcctggttttttttttttttaaagatggggtcttgctatgttgtccaggctggtgtgcagtggctattcataggcataatcctgctactgatcatcacaggagttttgacctgctccatttctgacctgggctgcttcaacccctccttagacaacctggtggtcccctgctcctgggagatcaccatattgatgccaaacttagtgcagacacccggttgatatagcacactacagcccagaactctcaggctcaagaaatccttccaagtagttgggactacagacgcatgccaccatgcctagctatcttgtaaattttgatcagacgccagacattctagataaaaatctgtcaagggcctaaacgatgttttcttcttccacagagagtcaggttttcattcctgtcaaggactggacctaggcttgtttagggctggtctatttcactttggcccttacccctggggtggtcttagggggaaagcctgagatgcttaccaaggcctcttcagcttggcaacctgtgtccccagcatcacatgtctgctggaagccttgttcgcttttgtagcttcccagttgctatttttctcttccaagtttcttggactctcaccctgtgcatgtagagcttgccaatgacttgagggagatttgtttgcaggttgggaactcccttttctgtggtcccatccattccaggattttaactctcatcttccagacattctggcagccccaaactccaacctccgtcttctcagtctagcgactctctttccgtctgggctctatttcccttccacagcagcagattggcaagtgcgctccgggaaaaagccaggttgtctgtggaacccaaattctacacttctgttatttcagagattgtagcgcctcaagtttctcctttctttcttttttcttttttttttttttgaaatggagtctcgcgctgtcgcccaggctggagtgcagtcgtgtgatcttggctcactgtaacctctacctcccgggttcaagcaattcttgtgcctcagccacccaagtagctgggaccacaggcatgtgccaccacgcctggctaacttttgtatttttagtagagacggggtttcgccatgttgcccaggctggtcttgaactcatgagctcgagcaattcacctgtcttggcctcccaaagtgctgggattacaggcatgaaccactttgcccagccaagtttctcctttcatttgctgctctccagtgacttccaataattgtttattatttgtccagcatttgcaactgtcattggcagaagggttggtctgatacaagtgactccatcatgaccagaattgcaggtcccctcccacatctaatccaccactaaggcctgcttcttaatagctcttgttcggctttggttgagacagggttttgctctgccgcctaggctggagtgcagtggcgtgatcactgcagcctccaactcctgggatcaagcagtcctcctgccttggccttccaaagtgctgggattacaggcgtgagccactgtgcctagcctgaatagctcttaaatctatccacttttcttcctctgcacacctgacaccctagtcctgctgccctcttctccacctggacaacctcgcccacccccaagttggtttcccctcatctactcttgcttcctttcagtctatcttctgtcctgaggtcagaataatttgttaaaaatataaatgggggccgggcgcggtggctcacgtctgtaatcccagcactttgggaggccgaggtgggtggatcacgaggtcaagagttcgagaccagcctggccaacatggtgaaaccccatctctactaaaaattcaaaaaaattagccgggcatggtggcgggtgcctgtaatctcagtttcttgggaggctgaggcaggagaatcacttgaacctaggaggcggaggttgcagtgagctgagatcgcaccattgcactccagcctgggcaaaaagagcgaaactccatctcaaaaataaataaataaataattgcgatcatgacattcgctgtttaaaatcttctgtgatgccccagtgctcccaggacaatgtctagaaacccctgtgtaacatgcccctgccaagctttccagctcatctcgccccactgtactgtttcctttgtccagccacactgcttttggccacctttgtatctgctgctccctctgctggaaaaccctttccactgtttttttttttttttgcaggatctcgctctgtcacccaggctggggtacagtggtgcgatcatagcttactgcagcctccaccacctgggctatagtgatcctcccgcctcaacctcccaaggagctgggatcacaggcatgtaccatcacatctggctaattttttaatttttttgtagagtcatgttgcctaggctggtctgaaacaatcctcccacctgggcctcccaaagtgttgggattacaggcgtgagccactgcacccagcctccattagctgtttaatagtctgattcctactcatccttcaagatccagcttagctgttgcttcccctaggaaaccttccctgacctgagtcaggtatctcctctagggtcccacagctcctactcttccctcatcccagccctgacccctctgcctgtgtttcccccttcatagcccagacaaatctattaggttggtgcaaaagtaattgtggtttctgccattgcttttaatggcaaaagccacaattacttttgcattaacctaataatcagtcactgtctggtgatggatgggtctgtcacccctacacacacacacacacacacacacacacacacacacacacacacacacacacaggactgtgagtcccatggagtcaggcagggcacaaggctgtcttggtccctgctgtgttcccagcatcatgtaagtactgagtgcagtttaaccaactatgcaagttgccacaagcagggtacaatggcattagaaatggggatgaggccgggcacggtggctcacgtctgtaatcccagcactttgggaggctgaggcgggcagatcacctgaggtcaggagttcaagatcagcttgaccaacatggagaaacctcatctctactaaaaatacaaaattagctgggcgtggtggcgcatgcctgtaatcccagctacttgggaggctgaggcagaagaatcgctcgagcctaggaggcggaggttgcagagagccgagatcgtggcattgcactccagcctgggcaagaagagtgaaactccatctcaaacgaacaaacaaacaaaaaaaaaaaacaaaaacaaaaggaaacaaaaaaaaaaagaaagaaaaaagaaaagaaaaagggatgatataggtatctcagttattagattcctgaattgatagctgctgctctaagctcctggtggatccctgaccactgccaactctctccccaggacccttcatgtccctgtgacccatcatggaaaggggcaacaccaggcccagcagcggactccaggagtttgtcccagcactgaccaatattgttaaatattttcgctatcatctctgattgaatgcactacttagacccaagtattggtgctttccttaagcacatctcaccgagacgggaagcccacatcctctcgtcacttcctcaaaacaaacatctgatttggccccaccagcggattagtgtttgaggtcaggatggatgaaaaccaggcagaatcaggatgaatgaagaacaaagaaaacccagtgcaaacgcagcactctgctcactgatgtcaccaaccatgactagactggccttaccctatttccttcctcaccaggtccagaaagaggaatctctttcacggatggatccatgcaccatggacccattccttccccacccttcctctcctgtgggaatttaggaaaatttgaccttttctaagtctttttcttaaaatgatcagagcctgaagccatgaaattcgacaaaggggcttatggttgttgcccaggctggtcttaaactcttgggctcaagcggttctcccgccttggtctcccaaagtgcttggattacaggcatgagccaccacacccagcctattatggacatttcctcacatttgttttttcactgcccaagtcagagaccatctattgcagaggattctcccagcctactgcggcccatttaatcttcccctctttcgacttcccttaagaacgtcaagtctttgcttgaatcctggcccctcagtatctattgcttggaccatctcccgtcccaatggattgggcaggaccatctcctgcccagtcagatggacaaacatcactgagacatctcatctatgtctcatgcatgcgtgtgagcttgttaagggcagagttgcaagttatacataacaaccatacatacaaacatgcaggatggggattgggttaaggatgaaagtaattgtgtcgttggggtggggatttgggtagtctgagataaggatggggttgatttggggatggggttggaactgtgcttggaacagggctgggtttgagttgggaacagtgttagggtaacatgaagttgggcataggattggaggtgaagttgagttggggttggatatggggtcaagaatgagttggggatggagctgagctagagatgggttgggttggggttgggacttggataaggcatggagttggggttcagctgatgtaaagttaagaataggattgggatgatgatgaggttgagctggggatggcttggggttggggatggcaagggctgccctactcaccagagttgccctggttgcacaagtctaacccacacacaacctcggtaaggctggtgatcttcaagccagtccgatagctcagggtcctgttggtcttctctgagtgggtacagcttttctccaccagctccagctcttctccttctgcaaggaggggatcttcattaccccagaggctcctctcagctcaaccagcctctgacactcctggtctcaaggtcatccactcccagggctgatctctgctaggcctcttctgttatttgagtcgaactctgtctttttctagagttaaccttgcctccacccccaccccaacaaggagcctgctctattttatttcaattaattaattaattaatttttttttccgggagacagggtcttgctctgtcacccaggctggagtggtgcaatcatagctcactggagccttgacctcccaggctcaagcagtcctgcttcggcctcccgagtagctggaaccacaggcttacatcaccacaccctgctaatttttaaattttttatacagatggcatctcactatgttgcccaggctgatctcaaactcctggcctcaagtgatcctcccaccttggcctcccaaagtgctggaattacaggtgtgagccactgtgtcccactcctgctcttgtagtgacagcactacaactgggactttctggatccatctatccctcccccacaccctcagcttagtgatctcagtactgagatgcctcaaatgtaactttattttatttatttatttattagaaacagggtctctgttgtcccagctggggcaatcatagctcaccacaacctcgaacttctgggctcaaggaatccttctgccttagcctcctgagtagctaggggtacaaatgtgagctactgtgcttggcttcatatactgttgtttcatgtgttcttaaagcttataaaaaacgtatcatattctgcaacatttttttccctctcaaccttaggtttctgagatgtgtccacattggtatctgcagctctatttccttctttaagctgcagtagagcgctccattatgtaattattaccacagtgtttctcttctgctgctgacttgctgactgacataaagtcgtttccattttcttcttttctttctttctccccttccttcctccctcctccctccctccctccctgcctctctccgtccctccctcccttcctctctctctttctctctctctctcttcctttcctttctttctttctttcttgagatggagttttgctcttgtcgcccaggctggagtgcaatggcacaatctcagctcactgcaacctccgcctcctgggttcaaacaattctcctgtctcagcctcccgagtagctgggataactggtgcctgccaccaagcccggctaatttttgtattttttagtagagacagggtttcaccatgttggccaggctggtcctgaactcctgacctcaggtaatccacctgcctcagcctcccaaagtgctgggattacaggtgtgagccaccatgcccggcccacctttctctctttcgttcatttttttgacaggatctcgctctgtcgcccaggctggagtgcagtagcatgatctcagctcactgcaacctccacctcccaggttcaagcaattctcctgtctcagcctcccaagtagctgagattacaggtgcgtgccaccacactcggctaatttttccttttttgtgtgtgtgtggagacgggtgtttcaccatgttggccagcctggtcttgaactcctgacctcaagcaattcatccgcctctgcctcccaaagtgctggaaatacaggtgtgagccagtgcccagcctgtttccaattttccatgtcacaaacattgctgctaagaacattcgtatacatgtgtccctgggtatatgtggccaaggttctttggcatttctgcatggcgaggagttgagctgtagcatatgttaatcttcatctggactagatattgccgaatcgctctaagtggttgatgtgccaatttactcccccaccacagacacggtctgcaactccacatccttactaacccgggtattgtcagatttttaaatgcttgccaatctggtgggtgtgaaatgggctctccttgtttgtttgtttttagtttgcatgtcccagttactggtgaggaaggtttctcaatcactcgcgttccatgctgcgctggaggggtgtgtgggttggggggaagctcaccttcccacaagcgcacgatcgtggtcctgcagaggtcctgtcccagggcgcactcttccacacggcaatccccgttggtcttacactgcatgcaccgcaggccccaagaggctgggggaaggagggagaggagaggagaggttaactacgcttagctccaagacccccgctcacccctgcatgtcccaataccaacaccaagtctccaggccccgtccattcagattcgtgtccatgttctgctgggttccggccggcggtacttccagtctgtccgttgtccacgttctacctccaccccactaactgaacgttctatccctgcccacaagtcctttcccaaagtcctgccttggcccgtttttcctttcattctgtcctcgtgaggcgtatatcctgacagtcgtatccccgccctctctatcagtacgttctattcctgctcctattaggtctttctcaccgcaccggccctcggtcgattacgcctctccagttctgctggggacgttctagccttgccccacccgcgtcgatctttatgttataccgtcactcccagtgccctaatggaactatccctccactcactccccctggttctacccggctccagagcctctcccggcccactaatttattcccaaattctaggcccggccccatcagccctccggagtttctattgttagatactctagtttcccgcgaagttctgtctccgccctccagctctccaactaggttttggccccgctccagactcatcgtcgaggttctagccccgccctttagctcttcctgaccttatcttcccgccccctagctcctccccgatgccataaccccgcccctagctcctcctcgaggctttagtccctccctctagctcctccttgagattctaacttcgccctttagctctccccgcccctagttttcccctgaggtcataactccgccccagtcccttcttgaggtttcagccccaccctgtagctcctccccgaggtcgtaacccccgccccttggccccttgaggtcctagcccagccccgtagctcctccccaagcttataaccccgcccctagcccctccttgaggttccagccccgccctctagctcctccccgaggttataatcctgcccctcaagagtctagtcccaccttctagctcctcccgaggttataactccgccctctggttacgcctcgaggttataaccccgccctctggctccgcctcgaggttctagccccgctcctagctcttcctcggtctgtaacctctcccgtagctcttccttgaggttccagccccgccctctggctcctccccgacactctctccccgccccaggctccgccccgagattgcagcccagtccctaggcccggtccccgacctccgggccttcccggacatccctttccagctgcgcgttcggagtatcccggagctgttactcattcccggcctcccgcggtctcgagcgctttccgggttattcatcgcggccccaacaccctgtggccacccgccctgactcagttccttctcgaattcctcgacccagagccccccacattttccggggaagtaagtgagagtcgcctcagtgagagggaaaggtcctgagggacagtcccgggtctccagcactggctctgcgccgctcagtcagcctccctttgggccttttgtaaaagggggtcctgtccccccgtttctcagagggggagacccagcagcgtggagagcgctggggggcgctgcagggtcagatcctgcgtattcaagcactggctgtgtgattttaggccagttatctaacctctctgtgccctagtttcctctgcgaaacgaaattaataaagtcccatcgcctagtttgaaattgcaaggaagaggcttcgaagaactccatttaaaaaaagaacacttgggccgggcgcggtggctcacgcctgtaatcccagcagtttgggaggccgaggcaggtggatcatctgaggtcaggagattgagaccatcctggctaacagagtgaaacccggtctccactaaaaatacagaaattagccgggcgcgatggcaggcgcctgtaatcccagctacccaggaggctgaggcaggagaatcgcttgaacccgggcggcagaggttgcagtgagccgagatcgcgccactgcactccagcctgggcgacagagtgagactctgtcaaaaaaaaaaaaaaaaaaaaaaaagcactcactaaattatgtaaagctaaatgcctttgctccactaatatttccttagctactgagtgccaggtactgcgccgcgtggcgttgcacaaagcacgagaattactattatttgattagggaggatgctgaggactgaaccgcattcctccaactcatcctctgacaacccccaaccccctcaattagaccctgttccaggcgcaggcgttcgggacccagcccctacctgggacgcaggtgtggagcagcagcagcagcggcagcagcggcgggtgacccatgtcgcgagggcagctcctgtgcgcggggtccctgcacgtcttctctccttctggcctcaggaaggaggcagttttgtggccccagggactcctcccagacgttttgcgaaagagcgagtcagccccagatgcgtgggcgcctccccctcctcccgtacgaacctcctccgccacaaacttcccttcccggggcgcggccggctggtggtgaaggggctggctcggc

SEQ ID NO: 2681 - DNA, 21776 bp, Homo sapiens
  source 1..21776: mol_type = genomic DNA
tggccttgtccactggtacaaaatctttatgtaagtataaaataaataatatgaatattaattaataacaacaacacaacagcggcaacaatattaataataacaagagctctcccattggcccacggccttcctccagcttttctcttctgcttcacacaactttgtgagatagctgttttcatagctgggaaaactgaggcccagagaggtcggcacactggcctgaggtcacacagcaagtctgtagggctgggagccgagggaagggcaaaggggtcccccggatccagccagggcagagagggggatttcaggtttaggtccagaggagagtgcctccccacagtctggcagtcattagcagggtgatggtgaggctgagatgggcagggccaggctgaggagcagccccactgcggtactggacatccaggtctgggtggttacagccacttttagtacagcaggagacatcaatgtggttcatgctgaaggcgtcacccaggtgggcatgttggcacattgaggcggttgcacagcctcttaccatatagctttggtttttcggttctgaggaaagagaagacggagtgagacttccagctcctgggcccaggactggaattctccagtaggtgacctgccaccttgcagtgggtgccaccttcactaccacctagagaaagcagcagttctcagggccaggtgtggtggctcatgcctgtaatctcaacaccttgggaagccaaggagagaggatagcttgagcccaggagttccagaccagcctggacaacatagcaaaactctgtttctacaaacataaaaaagaaaaaaacagctgtagtcccagctacttgggaggctgagatgagaggatcacttgagctcaggagatggaggctgtggtgagttatgatcacgccactgcactccagcctgggtaacagagtgagaccctgtttcaaaaaacaaataaaaagaaagaaaggaaggaagggagggagggagggagggaagaaggaagggaggaagggaagaagggaaagaaaagaaagaaagagagagagagggaggaaggaaggaaggagaagggaaagaaggaaggaagggaggaaggaaggaagaaagaaagaaagaaagggaaagagagacagagaaagaaaaggaaagaaaaaaaaagaaagaaaggaagcgagcagcggttcttaaagtgtggctcagggaccccagagaccctttcaggagatctgtgatttcacatggctttttcactctcataagtgtacaatgggcttttccaaaaactccaggacatgtgatattgcaagagactgaaagcagaagcttccatgaggacccagctgtcttctattaagctggacattaaagagatgtgcaacacagcaaaataatgccagttttctcattacgctttttttttgtttttttttttgagatggagtctcactctgtcacccaggctggagtgcagtggcacgatctcggctcactgcaacctctgcctcccgggttcaagcaattcttctgcctcagcctcccaagtagctgggactacaggcgcgaccaccatgcccagctaatttttgtatttctagtagagacggggtttcaccatattggccaggctggtctcgaactcctgaccttgtgatctgcccgccttggcctcccaaagtgctggtattacaggcgtgagccaccgcgcctggctggttttttttttgttgtttctttgtttgtttttttaagacagggtctcgctctgttgcccaggccgcagtgcagtggtgcaatctccgttcactgcaacctccacctcccaggctcaagtgaccctcccacctcagcctcccaagcagctgggactacaggcatgcaccaccatgcccagctaacttttgtattttctgtagagacaggatcttgctatgttgcccaggctggtctcaaatccctaggcttaagtgacccgcccaccttggcctcccaaagtattgggattataggcatgagccaccatgcctggctatcattacattttttctttggaaactatacttatttttcattaaaatgttatttatcttaatgtgtaatgagtttttattgttataagatgaattcataaataaatctttaaagatttctcagttttggctgggcacggtggctcacatctgtaatcccagcactttgggaggccgaggcaggcagatcatgaggtcaggagatcgagaccatcctggccaacatggtgaaaccccgtctctactaaaattacaaaaataagctgggcatggtggctcatgcctgtaatcccagctatgcaggaagctgaggcaggaggattgcttgaacccaggagggggaggttgcagtgagctgagaccatgccactgcactctagcctggcgacagagcaagactccatttcaaaaaaaaaaaaaaaagatttctcagttttaattttaatttaattttattttattttattttttgggacggagtttcactcttgttgcccaggctggagtgcaatggcacaatcttggctcaccgcaacctctgcctcccaggttcaagtgattctcctgcctcagcctcccgagtagctgggattataggcatgtgccaccatgcccgactaatttgtatttttagtagagatggggtttcaccatgttggtcaggctggtcttgaactcccgacctcaggtgatctacccacctcggcctcccaaagtgctaggattacaggcgtgagccaccactcctggttctcagttttaattttaatgtggcatttatctatagaaatcactgatataaacaataaagagtttttttttttttttgagacaaagtctccctctgtcatccaggctggagtgcagtggggtgatccccactcactgcaacctcctcctcctgggttcaagtgattctcgtgcctcagccccctgagtagctggggttataggtgcacgccaccacacccagctaatttttgtaattttttgtagagacagggtttcaccatggtggccaggcttgctctcatactcctgacctcaagtggttctcctcctcaccctcccaaggtgttgcaattacaggcgtgagccaccacacctggccaaaaataatttttaaaagcatgaagaagttgagaccaaaaagtttgagaaccactggaatacagagacctttccaggacaccacaggatgaaagcccaagatgtcttcagcaaatccccacaacccacgagaaatccaccaaagaattccatttttctttttgtagagatgggggtcttgctatgttgcccaggctggtctcaaactcctggcctcaagagatcctccggcctcagcctcccaaagtgctgagagtacaagcttcagccaccgcacccagccggaattccacttttccatggcaaaaatgtccacatcctgatggacaagtcctaattccttacaataatattcacccacctgaaggaaatcccaccttttccacagggagacccaccacagttaactccagcttaactggaagtcaatctcttgcggaactctccacccccaataagtgttccctcccagcctcggagagggcctcaccgtgagtgccggtggctaccagacattgattcatggggcctcggcagtcaatgaggaaagtctcttcagaggagcatccatgggtgctgttccccttgcagctgtaacactggcggccattctgcggcagattttcaagctccaggacttaggagaagaccagagacacagagaccaagaaaattagtgcttggatctccacttccttgaatgacctccccaggacttccactccgagccagagatgtcatggagccaccttgtggtcaggcgtctgaatggcatttggagggggatggttttcgagggcttgagagaaaccccaactttcaactccccatgagtcccatttctggccaggcaccgtgctgggtgctgggtaaaactatgtaagatgaaactgtccttgctctcacaaaagttacaacttatttatttatttttgatacagggtctcagtttgttgcccaggctggagtgcagtggcgcaattgtagctcactgcagcctcgaccaccccggctcaagagattcttccacatcagcctcctgagtagctgggactacaggcgtgcaccaccatgcctagccaatttttctgttttttgtagagatggggttttgacacattactcaggctggtctcaaactcctgggatcaagcaatctgcctgcctcagcctcccaatgttctcggagtacaggtgtgagccactgtacctggccagaacttacaagttattactattattattactaaaaaattttttttgagacggagtcttgctatgttgcctaggcttgtctcaaactcctggcctcaggcgaccctcccgcctccgcctccaaaagtgctgggattacaggtgtgagccactgtgcccagccagaatttacaatttagagctacactacccaatctggtagccactggccacatgtggttgtttacatttaaataaattaatattaaatcgaatcttaaaattcagttcacatttcaagtgctcactgaccacatacagtggtggctgtaatattggacaggacagatagggaacatttctatctgttgacagtgctgggtaatagagacagggatctagattacactggaggggagggacagtgaaagcatccctgaagatgatacattaaagctgaggcctaatggatgagaagttgccagcagggtgaactcttggggaagatgtgttctaagggaggatattcatctgcaagggccatgagaccagatgggctttggtgattatagaaaccaaatgaacgtcagcacagcggctcatgcctgtaatcccagcactttgggaggccgaggcaggagaatcgcttgaacctgggaggcggaggttgcagtgagccaagatcacgccactgccctccagcctggctgacagagcgagactccatctaaaaaaagaaagaaaggaagaaagaaagaaactaaatgaaggccaggtgcagcggctcatgcctgtaatcccagcactttgggaggtcaaggcagaaggattgcttgagcctgggagtttgataccagccccggcaacatagtgagaccccatctctacaaaagttttaaaaatttagctgggtgcggccgggcgtggtggctcacgcctgtaatcccagcactttgggaggctgagtcaggcggatcatgaggtcaggagatcgagatcatcctggctaacacagtgaaaccctgtctctactaaaaatacaaaaattagccaggcatggtggtgggtgcctgtagtcccagccactcgggaggctgaggcaggggaatggcgtgaacccgggaggcggagcttgcagtgagccaagatcgcgccactgcactccagcctgggcaacagcgcaagactccatctcagaaaaaaaaaaaaaatgtagctgggtgcaatgatgcgcatctgtagtcccagctacttgggaagctgaggtgggaggatcactggagcccaggagtttgaggtggcagtgagccgtgattgtgccactgcaccccagcctgggtggcagagcaagaccctatgtctaaagaaaacacaaaaccccaaaaacgaatctaaacaaagactgtgaggcagacaggtgccagattacataggccaacagaataaggtctttggatcttattctaagaggaaggggaagtcattgaagtgcctgagaaaggagggtgacatgatctgatttacattaaaaaataaaaaattggtggtgcatggtggctcatgcctgtaatcctaacactttgggaggccaagcccaggagttcaagaccagcctgggcaacaaagcaagaccccatctctaccaaaaatacaaaattagctgggtacggtggcatgcacctgtagtcgcagctactccagtagcttaggtgggaagaattcctgagcccaggagtttgaggctgcagtgagccatgatcatgccagtgcactccagcctgggtgacagagcgagaccctgtcccccccataccccccaaaaaatcactcgctgctgggttgagccttggctgtagggtggcaggagtggaagcagggagaccagagaggaggtcattgcaacaacctgggcaagaagtcagcgtggctcagcccaggtggtggcagtggagcaggggaggagtgggaaaatttgagagagacaaaagagacaggaagcacaggtcttggcgagggctgatagtatcattgaatccttacgaagttcttctttgaagaaaggcctggctgggtgcagtggctcatgcctgttaccccagcactttgtgaggctgaggcagacagatcacttgaggtcaggagttcgagaccagcctggccaacatggtgaaacccccatctctactaaaaatagaaaaattagccaggggtgatggtgggcacctgtaatcccagctactcaggaggctgaagcaggagaatcgcttgaactcgtgaggcgaagtttacagtgagcggagatcacgccattgcactccagcctgggcaacagagtgagactccgtctcaaaaaaaaaaaaaaaaaaaaaaaggcctgatactcccatttttcagaaaagcaaacagaggcccagagaggacttgattgccagagagtgactgcgcagctgtctgcctgagtgcatgcccctgcccgaccccaggccttgcctgtgtctcccgttccttacttgggccctcgttgcatttggtggtgttgcagcatttcaggaagtggaaggtgtcgttgttgtggaaaccattggagcccgggcagccgggaaggtagccacagccacggaggtggcggtcatcctttggacgccctatgggggccaggggacagaggtcagatgtcagattgtgaatgagggactaagatgggatttgcccgaaatagcaggcattcaaccattctctacttcacccttcatcataagaccctcattttatctagaacagtcatagatcttgtcgaaaactacatattccagcctctccaggtagtcatgtgatgaagttcggactaatgtgatataaatagaagtgctttatgggacttccagaaaggagaacccttacaaaaggaggagtgcccccttttttgtcccttctttccttcttcctccttcctggaacttagatgtgagacccggagctctggcagccattttagactatgaggcattttgagaatggaagtaatgtgtaagaaacaagagggtggccgggcgtggtggctcacgcttgtaatcccagcactttgggaggttgaggcgggtggatcacaaggtcaggagtttgagaccagcctgaccaacatggtgaaaccccatctctactaaaaatacaaaaattagcaaggcgtggtgatgcacacctgtaatcccagctattcaggaggctgaggcaggagaatcacttgaacctgggaggcggaggttgcagccagccaagatcatgccattgcactccagcctgggtgacagagagcaagactctgtctcaaaaaataaataaataaataaataaaaagaaatgagaaggcatctgggttcctggtgactctggacctgtccttgtggccctggacttcctatcactggacctcttgtgtatgagagaacttagtcccttgctgacatccctgttactttggggttgtttgttaagtgcagtcttagggaggagcagagcagggaggaggagttgccagcaggttggggctcaccttcttcaccttcctggatccagtgggtcaccacatccaggcactgttcttcagggctgcggcactgcaggctctggtgccggcccctctcacagctcatgtctgatgagccacaggaaatgcattcgaggtaacggcttcgggaataggtgacagcccggcctgtttggaagagggggaggggagtgagactccatggggacagtcctggagccccagctctgcaaggactcactcaaaatcaattcctccttatcccaccctgcagccagtcattgagccctgcctattctgcctgctgaatctttctagaatccaccccctcctttccagccccatggaccagtccagctcagacctccttcaactccagctacctccctagcctctgggtttccattcttgtcaccccctactcaccccagtgcagcatctccacatggccctagaaacatttctttcctttttttttttttttttcccgagacagagtctcactccgtcacccaggctggaacgcagtggcaccatcttggctcactgcaacctccactccccgggttcaagtgattctcctgcctcagcctcccgaatagctgggactacaggcgtgcaccatcacgctgggctaatttttgtatttttagtagagacagggtttcaccatgttggccaggctggtctcgaactcctaacctcaagtgatctacatgccttggcctcccaaagtgctgggattacaggcatgagccactgcactcgggcccttagaaggatatttctaatactcatatctgaccctgtctctcctctgctcaagactcttccatagctccctactgccctgaaaataaattccaagatcctcagcatgggattcaaagcctatcaaatactggggcctgagcacctctcctgcctcgtctccctccactacaccctgagactctgctccacactgacttcccacagtctgcgacgacacatgttccctggcatccaggcctttgcatatgccgttgtttctgtctagaacacctttcctttgctctctgccttccctaactcctactcattcttcaggtgtcagctctaatttcacctcctctaggaagcccttcctgatccaccaggctcccacacacccctgtactcccccatcccactctgggtggtcactgtctggtgacaggtatgtctcctctactggactgtgagcccccaggagggcagggccaggggctgtcttgatcactactgtgtcccaacaccacctggcacatggccagggacagataagatattcaatgcatatttgttaaatgaatgaatgaatgagcaattacttaaaacccttctattgttccctgtggtagcctgtctccaaaatggcccccaataatctctgctccctggtattcatgcccttaaagaatagggctggctgggtgcagcagctcatgcctgtaatcccagcattttgggaggccgaggtgggaggattgcttgagtctgggagtttgagactagtctgggcaacatagcaagactctgtctttaaattaaaaaaaaaaaagaagaagaaaagaataaggatgccctatgtagtcaactggatattatggaaatgatggtgtatgccttctgtggctagatcatagaacacatgcctggctctctcacttggatcactttttctggggcaagcagcagccatgttgtgaggacactcaagtagcaccatgggaaagttcacgtggcagaactgaggcctgtgccaaagccatgggaggggagcattcatgtgagtgaagctaccttaggagccttcagatgactgcagccccagctgacatctcgactgcaggctcatgaaggatcctgagccagaaccacctagctaagccactccagggtttttgaccttcagaaactttgtgaaataacacatgcttattttattgctgcaatctgtaatgcagcaatagataatagataagcaatagataatacactacctaattgtcccagggatcaaagactcacttgactgattcctgatcacttcgccttttgcacgaaccttgtggtgttggccaactggatccgttacttttccctggaaacaccagagtcattcctctacccagcccttggctcacaccatttcccatgcttggcatgccctccccgtcctgacccaagacacatctaagctgagtccaggccaagtcttaaaaaagtgagaggaccatgtcagccaaggttctcaactggcaggccgctagctgtaattaggcgaatcatttacatccaaagcccaatcgtccccctcaaagaaaaataactacaaggccacccacgtcttctcacacaaacttccatgaaaatgaaaacacaaattctcaccattgccaacatagctgttcatacctagaacaccttttccttgagccctactttctctaactcctattcattcttcagctgtcatcttcaatttcacctcctctaggaagccctccctgacccatcagcctggaacgggtacctgctctgagctcccactgccccttgaattccccatttctagttctgcccactctgggtggtcactcatgggtctctggtgtgaactcttgtaaatgccaatgatccttagggctattttcctttttcttttcttttctttttttttttttttgagatagggtcttgctctgtcccaaggctggagtgcagtggctcactgccacctcgacctccctgagctcaggtgattctcccatctcagcctactgagtagctgagactacaggcatgtgccagttcacctggctgattcctgtatttttgtagagacaaggtcttgctatgttacccaggctagtctcgaactcctggactcaaatgatcctgccgcttcggcctcctaaagtgctgggattacagacgtgagtaccgcacctggccagggctctgttttaagccctttttatctctcacagtatagactctctcatggggtaaatattgacatgacttcatttccatctatctgctcatcactcacaaatctctctctagtctagacttctctctgagctccagacacgcaactgtctcttcgaggccccatggctatacctcaaacacctgtcctaaacaaaactccccatcttctcccacaactgctctttttcttgaagtccacgcgtccaaggcggccccatccagtccccggggcagaaacctggcagacccccttatcttccacatctgtgcatcaaccgacatgcttctactgttctgtcttctagctccttaatccttttgctctgctgtttctgacctctatcaagcataactgccgagttcttcatttgagtcactgttctatattttctgttggactcttttaaaaaatggattccaggtgctaaaacatatcctttcttctgttttcctgaatatatcgattgtagcaattttcatgtttcctgtcctataatccaatatctgagttgctacaattctgtttctacagttggatttttctcttggtttctggtcaattggtcccttttattttcttcaggataccttgtaaggttttttgttactgttttttattttttgttttttgttttgttttgttttgagacagagtcttgcgttttgttttgttttgttttgttttgttttgagacagagtcttgccctctcgctcaggctggagtgcaatggtgtgatctcggctcactgcaacctccacctccctggttcaagcaattctcctgcctcagtctcccaagtagctggtattacaggtgtgtgccaccatacccggctaattttttttttttttgtatctttagtagagaaggggtttcaccatgttggccagtgtggtcatgaactcctgaccttgtaatcctcccacctcggcctcccaaagtgctgggattacaggcttgagccaccatgcccggcctggttttttttttttttaaagatggggtcttgctatgttgtccaggctggtgtgcagtggctattcataggcataatcctgctactgatcatcacaggagttttgacctgctccatttctgacctgggctgcttcaacccctccttagacaacctggtggtcccctgctcctgggagatcaccatattgatgccaaacttagtgcagacacccggttgatatagcacactacagcccagaactctcaggctcaagaaatccttccaagtagttgggactacagacgcatgccaccatgcctagctatcttgtaaattttgatcagacgccagacattctagataaaaatctgtcaagggcctaaacgatgttttcttcttccacagagagtcaggttttcattcctgtcaaggactggacctaggcttgtttagggctggtctatttcactttggcccttacccctggggtggtcttagggggaaagcctgagatgcttaccaaggcctcttcagcttggcaacctgtgtccccagcatcacatgtctgctggaagccttgttcgcttttgtagcttcccagttgctatttttctcttccaagtttcttggactctcaccctgtgcatgtagagcttgccaatgacttgagggagatttgtttgcaggttgggaactcccttttctgtggtcccatccattccaggattttaactctcatcttccagacattctggcagccccaaactccaacctccgtcttctcagtctagcgactctctttccgtctgggctctatttcccttccacagcagcagattggcaagtgcgctccgggaaaaagccaggttgtctgtggaacccaaattctacacttctgttatttcagagattgtagcgcctcaagtttctcctttctttcttttttcttttttttttttttgaaatggagtctcgcgctgtcgcccaggctggagtgcagtcgtgtgatcttggctcactgtaacctctacctcccgggttcaagcaattcttgtgcctcagccacccaagtagctgggaccacaggcatgtgccaccacgcctggctaacttttgtatttttagtagagacggggtttcgccatgttgcccaggctggtcttgaactcatgagctcgagcaattcacctgtcttggcctcccaaagtgctgggattacaggcatgaaccactttgcccagccaagtttctcctttcatttgctgctctccagtgacttccaataattgtttattatttgtccagcatttgcaactgtcattggcagaagggttggtctgatacaagtgactccatcatgaccagaattgcaggtcccctcccacatctaatccaccactaaggcctgcttcttaatagctcttgttcggctttggttgagacagggttttgctctgccgcctaggctggagtgcagtggcgtgatcactgcagcctccaactcctgggatcaagcagtcctcctgccttggccttccaaagtgctgggattacaggcgtgagccactgtgcctagcctgaatagctcttaaatctatccacttttcttcctctgcacacctgacaccctagtcctgctgccctcttctccacctggacaacctcgcccacccccaagttggtttcccctcatctactcttgcttcctttcagtctatcttctgtcctgaggtcagaataatttgttaaaaatataaatgggggccgggcgcggtggctcacgtctgtaatcccagcactttgggaggccgaggtgggtggatcacgaggtcaagagttcgagaccagcctggccaacatggtgaaaccccatctctactaaaaattcaaaaaaattagccgggcatggtggcgggtgcctgtaatctcagtttcttgggaggctgaggcaggagaatcacttgaacctaggaggcggaggttgcagtgagctgagatcgcaccattgcactccagcctgggcaaaaagagcgaaactccatctcaaaaataaataaataaataattgcgatcatgacattcgctgtttaaaatcttctgtgatgccccagtgctcccaggacaatgtctagaaacccctgtgtaacatgcccctgccaagctttccagctcatctcgccccactgtactgtttcctttgtccagccacactgcttttggccacctttgtatctgctgctccctctgctggaaaaccctttccactgtttttttttttttttgcaggatctcgctctgtcacccaggctggggtacagtggtgcgatcatagcttactgcagcctccaccacctgggctatagtgatcctcccgcctcaacctcccaaggagctgggatcacaggcatgtaccatcacatctggctaattttttaatttttttgtagagtcatgttgcctaggctggtctgaaacaatcctcccacctgggcctcccaaagtgttgggattacaggcgtgagccactgcacccagcctccattagctgtttaatagtctgattcctactcatccttcaagatccagcttagctgttgcttcccctaggaaaccttccctgacctgagtcaggtatctcctctagggtcccacagctcctactcttccctcatcccagccctgacccctctgcctgtgtttcccccttcatagcccagacaaatctattaggttggtgcaaaagtaattgtggtttctgccattgcttttaatggcaaaagccacaattacttttgcattaacctaataatcagtcactgtctggtgatggatgggtctgtcacccctacacacacacacacacacacacacacacacacacacacacacacacacacacaggactgtgagtcccatggagtcaggcagggcacaaggctgtcttggtccctgctgtgttcccagcatcatgtaagtactgagtgcagtttaaccaactatgcaagttgccacaagcagggtacaatggcattagaaatggggatgaggccgggcacggtggctcacgtctgtaatcccagcactttgggaggctgaggcgggcagatcacctgaggtcaggagttcaagatcagcttgaccaacatggagaaacctcatctctactaaaaatacaaaattagctgggcgtggtggcgcatgcctgtaatcccagctacttgggaggctgaggcagaagaatcgctcgagcctaggaggcggaggttgcagagagccgagatcgtggcattgcactccagcctgggcaagaagagtgaaactccatctcaaacgaacaaacaaacaaaaaaaaaaaacaaaaacaaaaggaaacaaaaaaaaaaagaaagaaaaaagaaaagaaaaagggatgatataggtatctcagttattagattcctgaattgatagctgctgctctaagctcctggtggatccctgaccactgccaactctctccccaggacccttcatgtccctgtgacccatcatggaaaggggcaacaccaggcccagcagcggactccaggagtttgtcccagcactgaccaatattgttaaatattttcgctatcatctctgattgaatgcactacttagacccaagtattggtgctttccttaagcacatctcaccgagacgggaagcccacatcctctcgtcacttcctcaaaacaaacatctgatttggccccaccagcggattagtgtttgaggtcaggatggatgaaaaccaggcagaatcaggatgaatgaagaacaaagaaaacccagtgcaaacgcagcactctgctcactgatgtcaccaaccatgactagactggccttaccctatttccttcctcaccaggtccagaaagaggaatctctttcacggatggatccatgcaccatggacccattccttccccacccttcctctcctgtgggaatttaggaaaatttgaccttttctaagtctttttcttaaaatgatcagagcctgaagccatgaaattcgacaaaggggcttatggttgttgcccaggctggtcttaaactcttgggctcaagcggttctcccgccttggtctcccaaagtgcttggattacaggcatgagccaccacacccagcctattatggacatttcctcacatttgttttttcactgcccaagtcagagaccatctattgcagaggattctcccagcctactgcggcccatttaatcttcccctctttcgacttcccttaagaacgtcaagtctttgcttgaatcctggcccctcagtatctattgcttggaccatctcccgtcccaatggattgggcaggaccatctcctgcccagtcagatggacaaacatcactgagacatctcatctatgtctcatgcatgcgtgtgagcttgttaagggcagagttgcaagttatacataacaaccatacatacaaacatgcaggatggggattgggttaaggatgaaagtaattgtgtcgttggggtggggatttgggtagtctgagataaggatggggttgatttggggatggggttggaactgtgcttggaacagggctgggtttgagttgggaacagtgttagggtaacatgaagttgggcataggattggaggtgaagttgagttggggttggatatggggtcaagaatgagttggggatggagctgagctagagatgggttgggttggggttgggacttggataaggcatggagttggggttcagctgatgtaaagttaagaataggattgggatgatgatgaggttgagctggggatggcttggggttggggatggcaagggctgccctactcaccagagttgccctggttgcacaagtctaacccacacacaacctcggtaaggctggtgatcttcaagccagtccgatagctcagggtcctgttggtcttctctgagtgggtacagcttttctccaccagctccagctcttctccttctgcaaggaggggatcttcattaccccagaggctcctctcagctcaaccagcctctgacactcctggtctcaaggtcatccactcccagggctgatctctgctaggcctcttctgttatttgagtcgaactctgtctttttctagagttaaccttgcctccacccccaccccaacaaggagcctgctctattttatttcaattaattaattaattaatttttttttccgggagacagggtcttgctctgtcacccaggctggagtggtgcaatcatagctcactggagccttgacctcccaggctcaagcagtcctgcttcggcctcccgagtagctggaaccacaggcttacatcaccacaccctgctaatttttaaattttttatacagatggcatctcactatgttgcccaggctgatctcaaactcctggcctcaagtgatcctcccaccttggcctcccaaagtgctggaattacaggtgtgagccactgtgtcccactcctgctcttgtagtgacagcactacaactgggactttctggatccatctatccctcccccacaccctcagcttagtgatctcagtactgagatgcctcaaatgtaactttattttatttatttatttattagaaacagggtctctgttgtcccagctggggcaatcatagctcaccacaacctcgaacttctgggctcaaggaatccttctgccttagcctcctgagtagctaggggtacaaatgtgagctactgtgcttggcttcatatactgttgtttcatgtgttcttaaagcttataaaaaacgtatcatattctgcaacatttttttccctctcaaccttaggtttctgagatgtgtccacattggtatctgcagctctatttccttctttaagctgcagtagagcgctccattatgtaattattaccacagtgtttctcttctgctgctgacttgctgactgacataaagtcgtttccattttcttcttttctttctttctccccttccttcctccctcctccctccctccctccctgcctctctccgtccctccctcccttcctctctctctttctctctctctctcttcctttcctttctttctttctttcttgagatggagttttgctcttgtcgcccaggctggagtgcaatggcacaatctcagctcactgcaacctccgcctcctgggttcaaacaattctcctgtctcagcctcccgagtagctgggataactggtgcctgccaccaagcccggctaatttttgtattttttagtagagacagggtttcaccatgttggccaggctggtcctgaactcctgacctcaggtaatccacctgcctcagcctcccaaagtgctgggattacaggtgtgagccaccatgcccggcccacctttctctctttcgttcatttttttgacaggatctcgctctgtcgcccaggctggagtgcagtagcatgatctcagctcactgcaacctccacctcccaggttcaagcaattctcctgtctcagcctcccaagtagctgagattacaggtgcgtgccaccacactcggctaatttttccttttttgtgtgtgtgtggagacgggtgtttcaccatgttggccagcctggtcttgaactcctgacctcaagcaattcatccgcctctgcctcccaaagtgctggaaatacaggtgtgagccagtgcccagcctgtttccaattttccatgtcacaaacattgctgctaagaacattcgtatacatgtgtccctgggtatatgtggccaaggttctttggcatttctgcatggcgaggagttgagctgtagcatatgttaatcttcatctggactagatattgccgaatcgctctaagtggttgatgtgccaatttactcccccaccacagacacggtctgcaactccacatccttactaacccgggtattgtcagatttttaaatgcttgccaatctggtgggtgtgaaatgggctctccttgtttgtttgtttttagtttgcatgtcccagttactggtgaggaaggtttctcaatcactcgcgttccatgctgcgctggaggggtgtgtgggttggggggaagctcaccttcccacaagcgcacgatcgtggtcctgcagaggtcctgtcccagggcgcactcttccacacggcaatccccgttggtcttacactgcatgcaccgcaggccccaagaggctgggggaaggagggagaggagaggagaggttaactacgcttagctccaagacccccgctcacccctgcatgtcccaataccaacaccaagtctccaggccccgtccattcagattcgtgtccatgttctgctgggttccggccggcggtacttccagtctgtccgttgtccacgttctacctccaccccactaactgaacgttctatccctgcccacaagtcctttcccaaagtcctgccttggcccgtttttcctttcattctgtcctcgtgaggcgtatatcctgacagtcgtatccccgccctctctatcagtacgttctattcctgctcctattaggtctttctcaccgcaccggccctcggtcgattacgcctctccagttctgctggggacgttctagccttgccccacccgcgtcgatctttatgttataccgtcactcccagtgccctaatggaactatccctccactcactccccctggttctacccggctccagagcctctcccggcccactaatttattcccaaattctaggcccggccccatcagccctccggagtttctattgttagatactctagtttcccgcgaagttctgtctccgccctccagctctccaactaggttttggccccgctccagactcatcgtcgaggttctagccccgccctttagctcttcctgaccttatcttcccgccccctagctcctccccgatgccataaccccgcccctagctcctcctcgaggctttagtccctccctctagctcctccttgagattctaacttcgccctttagctctccccgcccctagttttcccctgaggtcataactccgccccagtcccttcttgaggtttcagccccaccctgtagctcctccccgaggtcgtaacccccgccccttggccccttgaggtcctagcccagccccgtagctcctccccaagcttataaccccgcccctagcccctccttgaggttccagccccgccctctagctcctccccgaggttataatcctgcccctcaagagtctagtcccaccttctagctcctcccgaggttataactccgccctctggttacgcctcgaggttataaccccgccctctggctccgcctcgaggttctagccccgctcctagctcttcctcggtctgtaacctctcccgtagctcttccttgaggttccagccccgccctctggctcctccccgacactctctccccgccccaggctccgccccgagattgcagcccagtccctaggcccggtccccgacctccgggccttcccggacatccctttccagctgcgcgttcggagtatcccggagctgttactcattcccggcctcccgcggtctcgagcgctttccgggttattcatcgcggccccaacaccctgtggccacccgccctgactcagttccttctcgaattcctcgacccagagccccccacattttccggggaagtaagtgagagtcgcctcagtgagagggaaaggtcctgagggacagtcccgggtctccagcactggctctgcgccgctcagtcagcctccctttgggccttttgtaaaagggggtcctgtccccccgtttctcagagggggagacccagcagcgtggagagcgctggggggcgctgcagggtcagatcctgcgtattcaagcactggctgtgtgattttaggccagttatctaacctctctgtgccctagtttcctctgcgaaacgaaattaataaagtcccatcgcctagtttgaaattgcaaggaagaggcttcgaagaactccatttaaaaaaagaacacttgggccgggcgcggtggctcacgcctgtaatcccagcagtttgggaggccgaggcaggtggatcatctgaggtcaggagattgagaccatcctggctaacagagtgaaacccggtctccactaaaaatacagaaattagccgggcgcgatggcaggcgcctgtaatcccagctacccaggaggctgaggcaggagaatcgcttgaacccgggcggcagaggttgcagtgagccgagatcgcgccactgcactccagcctgggcgacagagtgagactctgtcaaaaaaaaaaaaaaaaaaaaaaaagcactcactaaattatgtaaagctaaatgcctttgctccactaatatttccttagctactgagtgccaggtactgcgccgcgtggcgttgcacaaagcacgagaattactattatttgattagggaggatgctgaggactgaaccgcattcctccaactcatcctctgacaacccccaaccccctcaattagaccctgttccaggcgcaggcgttcgggacccagcccctacctgggacgcaggtgtggagcagcagcagcagcggcagcagcggcgggtgacccatgtcgcgagggcagctcctgtgcgcggggtccctgcacgtcttctctccttctggcctcaggaaggaggcagttttgtggccccagggactcctcccagacgttttgcgaaagagcgagtcagccccagatgcgtgggcgcctccccctcctcccgtacgaacctcctccgccacaaacttcccttcccggggcgcggccggctggtggtgaaggggctggctcggc

SEQ ID NO: 2682 - DNA, 21776 bp, Homo sapiens; identical to SEQ ID NO: 2681
  source 1..21776: mol_type = genomic DNA

SEQ ID NO: 2683 - DNA, 38197 bp, Homo sapiens
  source 1..38197: mol_type = genomic DNA
gagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcgacccgagcggaagaccttccaggtcaagctggagacgcgccagatcacgtggagccggggcgccgacaagatcgagggggccagtaagtgcgcccacttcctgcctgggcccgccccgcgcgggggtcgtgggagcccggcccgactgcttgcaccccggccggccgccccagcgacttgggcaaactttcgggccctcccagactccctccgggccccgcccccgcttcgtctcgggtggtcactgggggcggggggcatccgggtcctcggtcacctgacaggacaccccccctcccccagctggggggagtgttccaggcgctttgccctgaggcctaaaaatcctcgcgggctggagacctgcggtgcaggcatcgggccccccagaccctgggagtggtggcggcgtcggcgaggggagctaaggcagtggcccccaccctgcacgggaacctggggcctgaccagacggtccccgcccactctttatccagaaagagcagtctgtgaaactctccgggcccccaggctgggctcttatttgcaaaggaatctttgggttccctaagtagaacttaggcagatgttgggtagggctggtcttggagcagagctgggcctactcatctccctctgggggagagggaggaaggtggtcttgtttggtttggagaagcctgagagaagccagtggctggaatttttttttttttttttctgctacttttgtcccaaagctgggttttggaggcctatgtgggtgggcagacactcaatgccagggcagggactccccttgccctgggaagcacgttcccaggagatgggccccataaaggcctgccccagcgccttggagtcaggtattcttctcaggagtgcagctagtttgtgagtctagccctttgtcctctgtccggtggcttcagggagcgggagcggcttctcttagtttcctgccttttcgccttcccaggcctgagcttggctgcttttgcgctggtctctagtgggaggagggagttgggggattttgaaaaaccccagatctttgagagttgttccacttagcgcgtgcctgtgctgtggtcggatgggcactctgctctgccctccattcccccgcctctcagtgtgaagagatggtgtgtctgcaactctagactgggttgcttcttgcagggacccccggagactagggttagagagacccaggctcagaaccaggtctgtgtgaaggagggagatcaggaagtgacaccccaagggggggtcccacaaaccttcttgggtatggtgtgcatgtgtgtagatagttgaggagattgggaggaaggaaggtcttgtggtgaggcagccaaccatcctcagctacaaactccagatctgacacagatctaatgcagctgctcaacttagaaatggcagcccccttcctcagtgcccccactgaccctgtcagccattgggagaacattttagtgacttgagagcctgtggattccaaagtaaaggaagaatcgacactgcaaagagctgagataaccctgggaacatcactcaggcatcaggctccaggcatggtccccttccttactccctatgctgtgttgagttggtggcactggctggaagttctcagagatctcctgggtaacagactgcattttaaaccacgcatattagcaggcaataaatgtagcacagtggttgatggcaagtctggatttgaagcccatatattcattgtgtgtttcccggccagttacttaccttctctgagccttgatttcctcatgtgtaaaatgggggtaataatatatccagtatatatggttgctccaggatcaaatgagacaattcatataaaacatctagcattgtctgacacataaatgtttaataaatatgagctgttattagcaataacattaacaatagaccgtggctgcccttcaagaccctgaactgggaatggtgagggggtgaggtgtggctataggtgaggatgaaggtgcaggaagggaggaggacggtgaccaaattcacatttcacttagattgctactcagaaaaaggcaggaaacagttttgttttgccccaacccatgtgcccactcacccacccaccatgtagaacagtgtttctgtagagaaagtgtttgcagttgtgcacatttgactcctgggtgtgacctttcttgtttgtaagttggggcctgaacagaaaagaggggtgcagagaggggatgatttatcatgcctcatgtatttgggggatggaggcaggcatacagaggacctgataaccccctacccaggggtgagcaggtgggtcagccagaggtgtacaaattcagtgatctcatcagttagctgggatttaacaggcctggagagtaggcagaggatgtaggaggaccctggcttttggattttgggggctcagattgaaaagagcctggatgaaaagtctggtcgatgcttgtgtgttcagacttaactaatggaggcttccactgaagccgtgccctgcttctacccattcgtgggctctccttgttggtgggttctgatccctgcggcctctgaggaggttggactgccagccgggttttctgccacctggactcttgcccaagcacctcaggtatctggcctttcctgctgaccctaccagggtaccagcagtgcctgaagcctggcctaagagagagacactgtgctaccttcagggtgttggtagacctgagggagagacagtgtggtttaaggagcactcatactgatatgtaagaccttcttctgccctgactctgtgccctctcttgtcagcagttgtgaaatggagctgacacctcctgatttctagggtggtcatttggctcaaaagcggggtggggaagtgcttaggtgttgacaagtttggttgtcctggtggtatgacaggaaccaggttggtgtttggccttttatgttgcagatactgacataaatgaataaaatgcagttatgtagagttccagctgagtgctattgagacctttcgtcccattttacagatgagcaaatggaaatggagaatcgtttgtgcccaaggtgttgtgtcagtgtgtgccagggcctcagctggggccagctcactagtcagaggctgactagcaaccccaagcccatgttccctgtggtccacgtggctcctctgtgagacacctttgtgctcagaccatgcattacagggcaaagaccactttggcttttgtatcccaagacagcctcagcctctctaggctctggctccacactttttcttctggtgttttctgagttgagatggttcagactcgtgtttaatgaggttgtccatttgagggtctttgtgggcccagtaaacactggtgtagacactgtggaggtactctgaatactggctgagcatgtccatggggacttctgaggccccaggcttctgtctttggctgatccttcactagatacttttctagatgccaggccctctgaggtgaaggagtatgggtgcttgcttttagggaaatgaaaacaggcaatgacaattgtgagcagtacctttgatgaagagggtgagggtggcggaagaaaacagctaactgccttgatgaggcaggcgggctcagaagggaggtagtagtggaaccagctggctggggcttgacccctgtggctggggagcagaccacaccaggaggcctgctccgagggctaggcccacagcacgggagagggcaaggcccaggccggtgtcatcaagggttttctttgtactggctgttactcccagtgggagaggggcaggagcacatgtccggatctccagagctagccatccctgcctgtgtatttcctgtctgatgtagttttttccaagggaagtcagaccttttagtgtttcctcagcaccccaggcttgccccgatgtgtgggtttccaggcccccccgcccagctgggatcctctgtttcctgtgaacctaggaaaagggcctgcttcacagataactggaggagctgagcacacccagtcctgggacccacaacacctccagcttctctccagactcttgtgtgtgtgtgtacacagatgcacaggattcagttggagtttagagatcttggctaccagctttgctctgggtagcttcttggaatgaggcacatttattaatatttgcaataagtattattatacctccccatttgcccagtgctaggcaccaaggattcaaaagtttattgagacatggtttgtgccattgatgaactcttggaaaagacagatgtagaggcatatgattataaccctgtgtgttacataccataatataaaggcctctaccaagaactgtgaggagctctgccaggaaggcattaaaggagaggtgacctttgaggtaggccttgaattactgaggcacctgtctgtgccgaggctaaggaactgggaatcactctgtgcaggggtagggaacagatatggtgtggtagagaggaagctgggactggttggagacagctatagccctagtgtgccatgtccagcagattacactcagtcctggaggcgacgggagtcagcggaggctgttgtgggactgacttgcctctgcctgggagaccacagtggcagtggtttgtcaggcaggtgttggggagggaggccagtgagctcctacggtttgcacagtttgcaggagagagctgctgagggcccagacaagaccttcttgctgaggcagggtggggatgccatggtggtagatgggagaagggctgggtcttgaggggtgagacagagcttagtagttaagcatttgggccctagactctgcttgaattaaaatcctgttgtgcagcttacttgctctgtgaccttaaagcatatgactacctctctgggctgcttatctgtaaaaaggatagtattaaatggcatttattttataaggtttttgtgaggatttgatgagaacctgtataaagtgcttagcacctgtataaagtgcttagcatggagtgtggcacagtgtaagtgcttactacgtaggatccctgacaggacagagatgaggattaagttctcaggaggacctggtggggaggagttcgaatgcacctgctgtcctaaggggctggtgcctggccaccaagccctttgattcagaggcaaggaggcccgcccatcctctcttgcagctctcagcagtccctctattgtcagggctctttcccactgctggttttgcagggagacagggcagttggctggaagcagctgctttgggtggtaaccccttctgtagagtgaaggtatgatattgtcctatttctaagtgcctagcccaggacgctatctggagagatcttgtctttgaggaagtgctctaatgccacagcctcgatgtggtagggcctgcctctgctgtcactgttctgtgtcagtctccgttaactcacagcatctcttcttactctgtgccttttcctgtgggatgtggcttcaaggagaccacagatgataagttggaggaagggagtgaggcctgagattgcaaaggtgtgatattaggagactgatttttccccctttccacttgctttgttagaactagagaagtcactgcagactgtgaggagagtcctaggagagatgggtgtgggataggaggatgggaatgttctggtgccccttgtagagtgccttgttgagaggagcatgggaacagtgcgtccttggagggaatctctgagagcagcatgtttacaggtggcaagactcaaggtggagccacgggtgaggagtggcttcaggctaccattgaccagatagtcccaccttgctggtaattgagctgaagtgcctggagatttgtggctagagctggtcagatttgggttcaggtctcagctcttactgtgaccttgggcagattacttttccctgtctgaaattgatctttagctgtaaaagtaatttctcctcacagagctgtatattaataataagggagattatatataagagtaagagattttatgtgaaaactacccagcacaacatttgtcacttagtggccacttaacagtattcatttcctttactctcacctttgttaaccacagagctccaatcttttccaccactaagctcggccacaagtggctgctccaacaacctgggctaggagtctgtttcctacttgctttctgtgttccttccctgagtctgtacacagaggactggggcatcaaaaaactctggaattggaatagcatattgggagttcatggaacattttctcacctgttgtattgtttgaacttcacagcagctccatgaatccatggagggcaggagttactatccctctcttacagaggagaaaaccaagccctaagggtaaggtcacatagcaagttcatggcagatcctaggatttcagattcctgctatagtattcagtttattctcccattctggggaaaatgataataggatggaccgttctataggaacagagggttattttgttttgttttgtttttcttccctctggccacatgtgtttgaccagcctagacttccatctgtggacaagctggactcattgcctcaatttcaaaacccgtcctgcactcatccttgccacaacaccggtgtcgagatgcttggcccacccagacctttcccacactcctacatgggggtgaatgtagccgctgattgggggtgggacacagaagagcctcaccctcttgactttctggtttgtggtgacacttccgcctaagcttctacagaacatgggaacctggggctccatgccccaaatatcctgagaagggcttttccaggattctctatgacaactcaagagcatgcattcattcatgtgctctttaatttgtcatacatttgttgtgggccttgctactgtgtgttgggcacactgagctggatgtgattactccagcctctgacttgttcatggtggcagtagatctctagcgtggtttgtgttccatctcaccatacctactctccttaaaaaaaaacaaaaaactagctttcttgggcctcagtggctcattgaataagtgagagacgacttgtgcttccctggctttagactctggcatttgctaactgtgccaagcactgtggagaccagtagtggacataaggttagggtagatacagccagaaaggagataaataggcagacagataaaattcttataggatttggtgagttctatgaaggaaataaggcaagaggctgctctgtcagggtaggtgagggtgtgctgtgataacaaatgatgcccacatatcaatggctggcaacaaggaaggttaatttcccctgtttgctatgtgtgctaacctacaccaccgtccctggagagtggcctcagtggttctgggtgaggcctctagtacagaacctgaacaccctgggcaaactaggctggagagggatttggagtatggaggtttagaaggaattaatttctatgacttaggatgcatgtggtgagtgtggctttgctgttgtggtagagtagagtgctgcctgtgtgggtcaagagactgtcttggctgacatctttgaaataggtatatttgtgtggcccttgcctaattgtcatctctgccatagctgcccccgccttccccaccaacccatggccctacttgagctgcctgctgagcctactctgttgtggccacagtatcctcctgctgcccagagtttgagtttctcgctacttctgccactcatcacacttgcttcccagagctttgctgggtgtgctgaagtctccagagaaagtggggaatatgggtgcctagagacttctagggggtgttttcagcccctagagagtagagaagtgtgagaaggggttggtccccgaatattctgtagttttggggaagaagcaatggggacagtggagttggttgccttaagagaggctatggtcccaagagatgggacttggagagtctctacttgcattcctggctaagcccttaatattctcgcacccctccttgcaagactagttccttttgaggtggttcttggctagcttttgagaggctgcagtggctgtgtgcccaggcttaagtcctagctttctccccactctttacctcctaggaaccgggcccatcctgggggaggcagggaggagctcctttttatagtccacatgtaggctttgtgtataggctctgctgcttccttccggccctggcccttcctggtgttggccggtggccctggcttcagcaagactcaggatgcagagtaaacggggcagggcgttctcctacagaagactggcatccctttttactgagcccaggcctggcacagaggaggctggagttaggaagcaagaaaacgaggtgacccagtccttgatcctgagaagcttgtgatctggaccatgcagaaaaccgctaatgcccagggctggcaggagacagctgtgcctaaagtgctgtaggctgggcctgagggccaagatggaatcgcttttctccctgtagcagcccatcctaccccctggggtccctccacctgccagctggcacacaggtgttgggtaaagcatctgtacaaaggctgtgaggggcctgggcgcaaggcagcaaggcttgggtacggaggagagtgggtggtcttactgatgttctgggccctgacagtgaacagctggccaaactggtgaggagttgggccatggcgagtttggccacttgtttgtgtgtgtttagttcttcctgggcacaggtggggagttcactttggggttggcttcctgttttcttggacacctggggatatggttgagttaaaatgttctgagggaaatgattgttgagggcatgggcttgggtcatagtgtccttggcttggccttgcccatggtaggagtcgggtattgaccacactgggttctggctgtgtaggtgtggatgtgtggtgggagaattccaaccccaccttgacttcagcctaaggcccagagagtgtgggcctgagttcacagggtgactaaccctaggaaggagtgaaggagagctccagttggccataggtcccacaggtttctcagcttacttgggggcaggaggtgagctaaggaatacaactccattccctcagttgggaggttgggcagcgatgggggcaggggtgatggtccttctctgaggcactgaagacccactttatggtcaccctattctgcctgatagtccaccacctgtttggaggcagctcccctcttcctgccctagtcacttcctccaccttcaacagtaattgagtataatgtgcctgtgttagcttgtccatcctaactgggactgtggccttttcttgggcgttcttagcatatctaccaaggaggttggaaaaggtaacatatgtcactttgttaaggattttgctgagggccttttgaggccagcagtgaaacacagagcattccctccagtgagaacagaatgtctgttgccagactgatcacaagaggatggcctggttctggcctgagaactggtctacaccggaagcatgaagctccatacaatcatgtgtgctagtaaagtttgggcaagcagctgtcctaagcaggtaaaacgataggttattcaacttcaacttcagagaaagaaatccaaggtagccatctctctcagtaggggaggtgagttcaaagaatttaagctgggctgggcacggtggctcacgcctgtaatcccagcactttgggaggccaaggtagggggatcacgaggtcaggagttcaagaccagcctggctaagatggtgaaatcccatctctactaaaaatacaaaaattaaccaggcgtggtgtcaggcgcctgtaacccagctactcaggaagctgaggcaggataattgcttgaacccgggaggcagaggttgcagtgagccaagatcgcgccattgcactccagcctgggtgacagagcaagactctgtctctttaaaaaaaaaaaaaaatttaagctgggctttctgggcaggcagtgagtgaatgagatccctggcaccttggagtgagatcagagtctagatcactcactggggccctgtttcccaggaagcaaaaagggaacaggagagtggcttggcttgggctggcatggcgcaaagggagtgcagccagatgctgtggcggctgggtcaagtagctctaaaacaggagagcctagtgggttctgctgaagcaggatgtctcagcaagcaggcctctgacctgacgacttccggtcattatttagaacgtctccagccccacagatttactctgttggaggcttaaggactaaaccaacatttactgtccaagaggtggcagtaacacagaaaccaaagaggcaggaaccaaggttggggtggtgagatgtcatggggttcagggagtggcagaggggaaggcctctattctccctttcccacttgtctccctacctcagcccctgttgctctgacgcttcccccaccactatgagtcctaggcccctgttgtttccttgtaggagggagaccccagatttttatttcttctcccaacccattccatttcctctcccttgtgagagggctctgcagagacagggcagcagagagagacttggagatatgctgggctgtggtcaggagggcctcatttatctagtgagcaggaacaggttatatagcagtgatgctttcatagtatttttcttgaataaggtccccaaaaccttattaagttcctggtaggcatggagcattgaagatggcagacatggtgcagtctctcaaggagtttacgctctagtggagaaaacaatcagacagccttaaaatacatgtatggctactataataaatactgtgaagcaggagtgcaccacgaaacctggagtcctctccatcctccccttctgtctgtgctggccctgcttggccacttccaacaaggattctgaggcattacagagcacacgtctagggtacaggcagtcttggctttgaagtattgttggctttgccactcaccaactgccaccttaggtaagttaattaacctctttgtgctcaatttcctcactcgggaattggggaccctaatacttacttcatagtgttatttgcaagtataaaatataaggcagtttttatcgttgtaaggcagtcttatcaagagctttatgcaatgtctatgcaaagtaaatatgcaagaaattagtgttaggatgccagatgctgctgttgctcatcgtctcttcccacccagcagaggtagtaactacttcatcctctacttctcagcttcttatagtatttgtctgtggactctaacgtaagctatctagcataatactcatatctaatttttccttccacattcaagctccttgaggtacttgtattccaagtatctagtttaatgtctctcatgtaggtgctcagaacgtatggttaattttgaataataaagccagtgggacttctcagagggctggattgggggctggtgagagaaaaggagatgcgaaggatcattctgaagtttggagtttgggtacctgtttgaatggtgatgctcttagctgacccagggggtatggcaagaggccttggttctggtgagagagagaagacagtgtttggttttgaggagttgtctttgagacgttttgagatgaagagtggggatagcaagtaggcagctgaattgaaggatctgaagcttaagaggagaggactaggctagagacctgtttgtgaattatctgtacataggaggtaattaagggtgtgggcatggctgacactgatgaggaagaaggcagagcaccggaagagaggaccttgacctgagccttgaccaaggccattgctaaatgcaggtaggcctgtagcgcacaaagaagcatgaaaaccaggcaaggttgtgcaggagaaatcaagggcagagcttcaaggagagagggcgtgatcaaccatgttgattgctctgaggtgtcaggaaggaggaccatagataagtgatttatgggtcaggcacggtgattcatgcctgtaatcccagctctttgggaggccaagactggcgagtcatttgagcccaggagttcaagaacagcctgggcaacatggcaaaacaccatctctgcaaaaaatataatcagcctggcgttgtggtttgcctgtagtcccagctacctgaaaggccaaggtgggaggatcacctgcacctggggaggtagaggctacagtgagccctgttggtgccactgcactccagcctggacaacagagtgacttatgggccaggcatggtggctcacacctgtaatcccagcactttgggaggccgaagtgagaggatcacttgaggccaggagtttgagacaagcttgggcaacatagtgagaccccatctctataaaatataaagaaaaattttaaaagtgacttatacccattgctctggttctccaagtagcctgagtgtactatgtgggggagcattttatgagggacttttgaggtcctgggcatccctgagacatggccctggtgggtccccagtctctctcctgtagctaggagcctggcatacacaggccatctagaaagaacttaggcagcatcagtctgcaagggaggcagagtttggagcacactagactcctgacacagaggctgacccatggctgcctggagaatcttctgggcttgtgcagaaaagttggggaaagccacctttccctactgtggcagtcaaggcttggtataggccatcttccctcccttctcatccatgatactctgaatgccctgtttgtggaacttagtggactcctgcacctctgtcttggtttccatgaacccctctgcccaatgtgtgcttgtcagccctccagacctggcttttacagagcactccaagacattgctctacacacactcagctccacagacacctccctgttgttctactcgttgcatgacctcatagttatctgcttccccatctgtttcctccatcaggcaggggttttctcaaaggcaggaactcaaatgccttattgatctctgtttccctaggacccagcccagggcctgacatggagtagatagatgcccgataaatgtttgatcagatgatggaatgaatgactgcataagccgaatagatcactgctgagtgctcttccagctttaatttctctgggtgggacctcctttcccttccttcctttggattctgttcttacctctgaaataggtgagattaatttagagtcctagggaagagggctgcctgcctggatggtacaaaggctggctgtggctgctctgtgtttctctgtatacccagtgtcagggatagcagctgctgtggggacactgcagagtgtcccagttctgccatgactcaccatatgaccatgacaagaccctttggaccctctgtttcctcattgtttcaaagagatttgtctagaatctagaccaagcttgtccaactcgctgcccgcgggtctggtttgaaggcagctgctgcacagtaatgggaaggacagtaagccccaccatcgccttccctttgccatataaccctgtgacctcagaagtccctgaacccagatccttgtttgtaaaatggaaagggatagctacccacccctccactttgaccttcctttggtggcagccagatgtgctcagggaaacctcagatttgtgagtatgtttctactgagaggcaggaggaggaatattatagtctcaggaagagggaggaatgagagggagaggagaactctcaccctttccacaggctttgggcatatgcagccagcttggaaatgctgaccatcctgtgacctggctactattgcatcaggcttccttcccacctgtgtccaggtcctatctttgtctcttctttggctacctccatccttttccttcagagctgcaaaaaccttgccaaagccgtatggtcctgatgggtgcagagcccctgtgcctctggctgcctgtgaagggggatctgcagtgcagtgcctgccgtaccccacagggagttgtataggaacctggggatggggtgactgaggtagggggccagaagtggcccagatgatactcacttctgctggaacttttctttgtccatctttcagcatcctctggtggagaaggcttagctccattaatgctctcctaggtcctggctgtgtattttctttggtatgggagtggggaactgggagggactcatctgtttgccacagactacatgtggagagggtgattggtgagaggtcattttggagatctacacacctcttctgacccctgggaccactctcctgaatctcctcatggtcttggcttcgggcccagcagggcgtgggtgctcggcatcctgctgcttttactgtttttcccaaagctctgttagcttcccgtggttcccactggctataggaatctttatgtaaggacttcccagtgtttccagactgtatttgcccccaggggtcacattccccccaactatgcctgctgctgctttttctgttcccgttgttacctcactgaccactgcattttcagtatttgttgtagcccctcagcctctgtggcccactgtgccacctcttccaggaagccatccttgataccatctttctggtaccatttttgagcatctgtggcctttgctgcctgttagataattagctctggaatctaactcccatgtgtttactcctgctcttaagtactctgaacattttgaggcctccccaggccctgggtttgtgttggactggtagggaatggagagaagagtcaaatgtggtttcttccttggaggagctcataggccagtggcctaagacaccagggaagcaccagcaggtgtgacaagtggtgacacacaagagaggagggggcacctagtgtgcccctggcctgggcctggtgggggcttaagtgaggaggtaggagtggcttgtgcaaaggctgaggcaggaaggagtatggggagacatgggctggtgtctgtgttgtgttaattggacttggacccttttgaggagggctgggctttccctgccttcctccagtgccctctgcagagtggggcacacaggccttgaggggttctggggtccacaggccacaggtgggggtagtaaaaacccccagaagggaaggaacctgtccaggaaatcttcgcttacctctttcaagctctttagattttaaagagacctttcatatttactatgagttgcagtttttttaagttacaaaatttctttactccatgcatgtttaaatggatagtttttgctaccatttacatcaattagcttacacactttgggttttgtgtttttgttttgtgtttttagagaaaggatctcgctttgttggccaggctggagtacagtactgtgatcatagctcatagagcttcctactcatctgcagcctcaaacccttgggctcaagtgatctttcccaccgcctcccaagtagctgggactacaggcatgtgctaccatgtctagctaagtttttttaatttttattttttgcagaggtggggtcttcctctgttacccagatgggtcttgaactcctggcctcaagcagtcctcttgcctcagccttctaaagtgagcgtatgcactttataaagggaaaaccctctctgaagagaaatatttcagacagggcatggttgctcatgcttctaatcccagcactttgggaggccgaggcaggcgaatcactggaggtcaggagtttgagagcagctggccaacatggtgaaaccccgtctctactaaaaatacaaaaatcagctgggcatggtggtgtgcatctgtaatcccagctacttgggagactgaggtatgagaatcacttgaaccccggaggcagaggttgcagtgaaccgagattgcaccactgcactccagcctgggcaacagagcgagacacccagacccagagaaatatttcagtgaaagcatgtttcatgttcagaaatttggggtacttttggttatggttttcttggccatatcttcatcatttggtgggtttagttttcaatatgtcctcctgtccctttctgattaaatcacttctgtatctcttacctcattggcatctcactgtagtccaatgaaggaggtgccaggagtggtgattctattttgcagatgaagaaaatgaggctcagagagatgggtccaggcctcctgcccaccttgccagtgcttttgttcataatacctctctacaccctttttgcctgctgagcggttaacaggcttataaatttgggggacctctgtctgttgggctatttggaagtggcttttttgagcacaggggatactaggacacaggttccaacaagaaacttaggtctaatttagggtcttggatttgatgattgggctccctctcccccttctagggcctgccatgtgtctgccccctagggcaggattggctggctctcactggctgtgctctgaggagccctgcctttgctcttctctttctcttccctagggttcctgctgtccttgaactctgccggggcaacaggaatactgcccttatgcacatcctcgtggtggccagacagggtggttatcccactttactggacaggaagagagctagtggcaggcctgtgacttggcctgatgtctcgggggagtcggggtgggagcaagagtcaaagacaggaagcagccctaccttcagaagagccaggcacacagatgggtcctttgtggttattgtcttctccctttcccaggttccagactggctgcccgccatatagcttgtcccttcgacagcaccctctctccccactcagtggattgggtgctgtcccagggtgggggcttactctcctgcagaggcaggttctcagctggccctgagggttgtatagcttcacagctcccagagtgcttgggcatagggtggctcagatgaggaaacaggctcctcttttaaagggaaagcaactgccattactggcatgtccaaaagggggatgctgtccaggactgcatggcccagaagctccgctctgagtaactgctggtctctaatctctgtggtctcaggccaggagtctgtccctgggctgagaagggaggggagaagagggaagagatggaaaaggaacattgctcttcccagtctccctggcctcgtcatataaccttttattttacaaattcagtcttgtggcattttgctttaatgcttagagctggccccaggtgccaggcagcaggcacatttccttctgcccaaaaaacaaaacacacatgaatctgaggttgggcgtggtaagggcaggccaaggctgaccgtcctatgtggatatctgtgaggtagtgtgcctacatgtaagggtctgttgtgggtctactcccacgaaagccttcatcttacgatgaaccagagaggactgcagacttgccaaggcctagctatatgcttggagccaggatttgaaacttgatctttggggatgcacgtgcctcagactattggtgagtgtgctggtggggcactgcaggctcaggaagcagcgtgtctgcatatgcttatctgtacacaagtctgtaagagtcccccttctccccatacaatgcccccatccctgccaggcttctttttgagctggcgaaatagctgcttgtattcttctcttcatggatcatctttatttcacccaagtttgggtttgcacctagtggagccttggcaagtggccttatttgtctccactactgccagcttttgtaggctccatgtcaatggcactaggcacacaggtagacaggtgggctgtctccagacttctctattaccagcacttcccagcatggccctcacagcaaccatgtgaggtaagaggaatttccagtttcctgatggggaaactgagaccaaaagagtgagggactgccaaggcctcatagctagaatttaagagctgtgtggttctcctcactaagctgggaaggggatggtcagggaaagcttcttgaaagagcaggagaaggcagatctccatcagggcagggagcagagcaaggccccaggattctgcctggggcaccaggaagcctggcttatgagaaggttctcagtcctcagagctgacatgtgatatacagtccaggcacaggtgtgtgtggtccctcattacttcagagccccttaagaaagactgaatctatttcttcatcagagtttgtgagcgattcaatataagggactaaatccccctcactgccccaagcagcttatcttgtcactgtctaccatagccacatttggaatggtaatgcccaggccattcctgaagcccaggcagcattcactgtgggcttggggacatggtgccattcctgaagcctgggcagccatcaccatgggcctggggacgtggtgctgggcagaatgaatatgctgcagccctgatgggctgtgctggctgggctttgccttcttgggtcaaggcgagcctgggcattaggcctttgtcattatgctatacatcaggcttctgggctgctacttgtgggatcctgcccttgttctcaaagagttcctccttctcactgccccatcttcttcatagtgacggcctcttcgtacccctggcttttcttttccccagagttcccctgaatgttgtcctctcatggttctgagttggggaggagtgctaggtcatggatttttgggtataacgtgtgactttcctactcccctaagtagttctccccttctcaagctcctaagttctgggaaggtctcttttcctgccctcctgactaatggcagagaggtctgacccagactgtgccagactggatcattcgctctgtcacctgccaccagggcagaggccattcctctctggggagtctccttgtgaatttctggggaccagctctggctctctcaagaaagaggatgctgccatatttgttctgggaggcaggaagatgaagggtgaggttgggaggtagcacaggatgtggctttcaagaacctagtagagcatctcactgtgctgccagggccaggctggtgccttcttacggaagacagtacaagggatcaggtgtggccaacaggaacttgggagcattggatgcctggcgtggagctgcgctatgcttacctggttcctatctcaggcacctgttctgccttcaactgatctcaatggaaatatgtgcaggagtgcaggcctgttgactctgtgtgtgtgtgtgtgtgtgtgtgtgtgtgtgtgtgtacagtcacactcacctttgcaagaaggtgtgggagggggatgacagcagctccacaccggaagagcagactggtttctgtttcaaaaggcagagtttgtggttgttctgcagtttctgatctagccatttcccctgatggaagctcctccttctgtcattggaagccctgtgttctcggttaggtcttttatggcccagttctccctgcccctgtttctacccgagtataactgttcatttttgttccccatccctatttggttttccctccttctgcctgtgtacctgcctttttcatttcttcagtcattaagcaagccctggaggggccctgcctggccttaggtatgtgagcatgtatgtacgtgtttgtatgcacgaggcatcaagtgtattagtaccacaggaaggagcttctcagttgggcccttggtggaagagaagggagccggggaggtggacatttccagactaggaatcaagatgaaatagggatgggaagcaacagctattcttgccctaggtgtggcttagtgtggatggagcagagagggtgagagggcaaaagctggggaggtaaattcctgagccctgtcacaaagagccttcaaggccatagaaggtgtttgttgtttgttctccttagactggcagtgggcagcctcgggaggggcttgaatgaggtctaggggggtcagaataatgttttatgaagagccagaagactggggaaggatggctgatgggtgagaaccaggggtcagggaaaacagcagaaaaggcaggactctcagctggaggacaggctggaggggtttgctgaggggacaggtggttccaggtagaaccagaaatgtgtcggggagctagggttagggccagaagcaatgcccactgttccaggtgggatagatgtggagttttgtgacagttgctagagggacaggacaggaagagagcatctgggggagttgggccgttaggacattccaggcaggttggtgtgcagttcgggctggaagggctcctggggtgggggctggccaggcaaatgctggcactgcatctggctccgaagttaccaggccagtctgggtttagaggattttaagaggcttcagagcttggggagtactcaaagaaagtcatagctgttggctaagccaagcttttttcctttgacctaatctaccttaaatcggtgatttctgggctggaatgtctgccctccagccagcaggcagcccctccctgtgctggagagtgtgtcagagcctgtgcacctttgctgagggagcagaggagtccattggatgggccccctccatgtcccacatatagtgctgggtgtttctagctgttacgacttttgatcttaccaacatctttctgatgctattgtgttactcttatgttactctcttcacaggtgtagcagtgaggtcagagtggctgtcactttattgagatcacatagctaatgtgaggtagagctaggattttagttcagccagtctcacccagagctcgtgcatgttttttctaccaccctgccttctagagaaactcagtcaagccctttgctttacacatggtaaaactgagactctgagaagttaaataaattattcatcattgcctcaagttttagtggctgagggcaggtcatctgctattcaagcccgtgtacctctctgactatgccttgtgaaggccacgggagcatgcaagggccttggatagctaagataaggaaatggtcccaggcaaaatggtggtctgggtccaggatggttgctgctcttggacagccagtgccttggtcaggggatggggtggggattaggccccttgctgagacttgtgtggggatggctttagcagttaggcatttcagggatgcaccagtcctctgggccagagcctactttctcccagggatcctgaggcccatcttgacctacccagccctgcctctgggactttatgatttgatttgtgtgtaccttgtgtcaggaagtggtcctcatgaacagccttgggtccctatttcttcttctggagtctagctcttttgcaggtcaaaatgtctcagtgagggaacaaagatagggaagggacaccccacagaaccacctttcccccatatagccctctctgacatctcagcccttacttagcaaaggcctatccctagactcaacccagccctcttattaccagagtgactgagtggtcttggctctgcctctggggttcctccctgagagagagtgtaagaatgaggaaaccaggctgccctcctttcggtgttgactctgggagaccccagcttgatcttggcctctttgctaccttcctagttgacattcgtgaaattaaggagatccgcccagggaagacctcacgggactttgatcgctatcaagaggacccagctttccggccggaccagtcacattgctttgtcattctctatggaatggaatttcgcctgaaaacgctgagcctgcaaggtgggagttaagggggtagaggaggtagaggatagttaggggaatgcctgctggctcctgcccagtgggaggtatgtgccctcggggcagctattgataccttgctcacagccacatctgaggatgaagtgaacatgtggatcaagggcttaacttggctgatggaggatacattgcaggcacccacacccctgcagattgagaggtaagaaccactcctgaaggggttagggctgggagcattagggaccagggggacagggacagcagacctttgtgtgcccagacatctcccaggcctgactgtagatggagaagtggccctcacctcaggcttctctctccaggtggctccggaagcagttttactcagtggatcggaatcgtgaggatcggtaagtactgagctgtggctgtagcccagcagggtggggatgggcatccagaaccttagccaggcctctaagtagctgcccggagagccagaggacccaggggaccttaagtggggccaggagggtgggcagaaggttctgccacgtgtagctttctgcacaaagtcctctggtggccttggtgtgagctggtgagaggagccagccacatgctgtgtgccctgccactatgggcagagactggatgtgtagaactggctttgggtgtcctggaggtgagggtggccagtagcgtgtgaagggtgccctgaaactctggctctgagacctggtatggcagccagaggggccaaggagagaagggggagcaaagaccagatagtgtgggtgctgcaccatggtgaggtcctttgacctgaaagaaatgggaagccatggaagggttctgaggagaggagtgatgtgacctgacttgggttactcaagatcactctgcctgctgtgtggagagctcagttaggagctgtttccacactccaggtgaaaaatgagagggcttggatcatgatggtaatggtaggaagtggctggattttggccatgttgtattttgaagatagcgccagaaagaatgtccttaacagattgattttggggtgtgagaggcattgaggataatagtatgctgtttggcttgagcaactggaaaacagagtcaccattgactgagatgagaagatcatgggactagcccatttggagggaagcttgggttcagttcgaggcatgttaagttttctgatgcctattagctgtccagggagagatgttgagtaggcaggtggttagagtgagtttaggtacatacacagtaggggctacagattttaacttgggagtatgtagataacactgaaagccacagggctgggtgagatcacctagggggcaagcagaccaagaaaagggcagggtccagtggctgatcccagaccacccccatattagagattggaggggtcagggacaactagtgcggtaagaggagaacccccagagtgttgagttctggcagcccaaggaagaagacagtggtgaaatctgaccgttgacccttggatttaacatggtgagaagagcggtgtcaccctagcggtgaggggctcaagggaatgagagggagcaagatgactcttgcaaggagttttgctatggaggggagcaaagaagagggcagtagctggagagctaagcaggggcaagacaggtgtttttggtggaagaagtaacaagctgttcgtatgctgatgggaaagagaccacagagggcaagatcggtgatgcaggcagttgcaaccagaaggcctctgtttcctcactggaaaacaaggaccctgatagcacctacctcctgggtgactgaggatcagaggagggggcgcctatatagagccagccctccctccgcagtgcttgatccactcagtgtggcgctcagccccctcggggaattttggtgcctcctcccaggctcttggggcccagaggaggtggtcccaccctcccctcccctccttgacaccaccttccaggagagaaagccccccccttcccccttcttgtccatcctgttgccaggtccagcagtgtccccagcctcacatcctgggcaggacacccctggagagcaggggcgcttgttctctcagtttctttcctggagccaggccctgtctagccccaggaggtgcccagttgccagtcattgtatttggtggagcatgcacctcctccttcctccctctcatgggttagtgggttctgaggaccaaactcccagcatcccagtgggcagcaggtagggacctgctgccatgctgcccccaacagggaagttgtgagtgagccctgccttctgtcttggataggctgactgccaccttggcacaggcctcagcagtgccggtaggaggggaggcctggagtgtggtttttcttcctcccatgcctgacccactttactgaatctgttcacatcttccttgccagaattacaggttttttttgtttgttttgtttttgttttttttttttttttttttgctcagatgaggaactgaggtccaaagaaaggaagggactaacctcaccccatgggttctgatccagtcttgccctcaggcctccaggttcccagaatagtgttgtttacctgtccagccccaggtgggctcgacccacaggtcagaggtcatgagaagctggatgagaccactggggatgtccctgttttctcagtatatcagccaaggacctgaagaacatgctgtcccaggtcaactaccgggtccccaacatgcgcttcctccgagagcggctgacggtaagtgccacccagggctgtctgtagatgggggcaggggaagccaagagcccttcagctgggggcctgactgcctgactggcactcctgctctataccatgcaggacctggagcagcgcagcggggacatcacctacgggcagtttgctcagctgtaccgcagcctcatgtacagcgcccagaagacggtgcatgagccacctgccctccctcaacccctgcccctgctcttccaccccacaccccagctctgcctgcctcagccctgctgccctgcttaggggcttttgggtgccatttctccagttcttctcctcttgaggcctgcccccatctgctgctctagcctgccttcttactagcccatttcccacatggcctcccaggggtcttgccctgaccaggttctgtttcctgcagatggacctccccttcttggaagccagtactctgaggtttggtttggagtggggaggtggggttttccctgggcccccttcatctctccactgggcgattcttgatccaggtgggaggcagtgggagtagggaaccatgctggaccattctgggaagctgtgctggctgggagttgggttctgccttccgtggggcaccttgttgtctgttgaccatactagctagcttaccttctctccctgcagggctggggagcggccggagctttgccgagtgtcccttcctgagttccagcagttccttcttgactaccagggggtatggctgggctgacattggcccaggctggtaggttgtggggggctgggctcatccctgactggaggcttctctcatcccctgccctccctaccccatcaggagctgtgggctgttgatcgcctccaggtgcaggagttcatgctcagcttcctccgagaccccttacgagagatcgaggagccatacttcttcctggatgaggtgagcccgatgtttcacccattttttgtcaagagaatgagtaggggtgaccaggaccccacccgggctccaggagctagacgctccttagggatgccaccttgtttctacctactgtgcaccttgcccacccccagttgggacagagcactctctctcctacccccaacctaccatcttgggttggacagggcagggactcactgtctcttcccttccacatgtttctggacagtttgtcaccttcctgttctccaaagagaacagtgtgtggaactcgcagctggatgcagtatgcccggacaccatgaacaaccctctttcccactactggatctcctcctcgcacaacacgtgagtgtggctccttcaggcccacccagcttcttccccaggagggcccatctgaccatacctacctgcctctccttgcctatccaggtacctgaccggggaccagttctccagtgagtcctccttggaagcctatgctcgctgcctgcggatgggctgtcgctgcattgagtgtgcgtggggtccagggctgggggagggaagatgggaggcctgcccgcttgaccatggtgatgttgctccccagtggactgctgggacggcccggatgggatgccagttatttaccatgggcacacccttaccaccaagatcaagttctcagatgtcctgcacaccatcaaggagcatgcctttgtggcctcagagtgagtcggaggctggatgacccaggggttaacttggctccaggtctctcgttctagagggacagagggcagaaagactcctcaaatgccctgtcccctctccctcagcctttcatctttgtccttcctcttggcctctcctcgtcacctgctccctgcttgagctgttgcttcccaagttacactttctgtttcctacgtgttgggcccactctcttcttcatgggtcctttagactgtagaacacatgctcttctcatcttcagaaaacatgccctggtttctttaggccagtgtcctgccaactcctttgccctcacagcccagaagattgtctctgttccctgtgtcccattccttcaattctgtttactgcttaaactgtggtcactggtctcccttagctcaccagggctctaacagctaactttggaggcttctcctctctcctggcctctttggtgtgaaacatttttcttgcactgctgagcagcctccataattgggccagctcgggactgcatcagttgccaccctttggtttccactgctgccacagctgtagaacccctctctgccccaccagtggctatggcctgcctcttttctgggatagtttttacagacaagaagcccccaggcccttggcttccaacagctcactgtgaggggctacttagacccagagaattgcagaatctgtttcactgtgcttgtcccccatcccgcaggtacccagtcatcctgtccattgaggaccactgcagcattgcccagcagagaaacatggcccaatacttcaagaaggtgctgggggacacactcctcaccaagcccgtggagatctctgccgacgggctcccctcacccaaccagcttaagaggaagatcctcatcaaggtggggtggcgggcttattgcggaagccccacacttctcagtgccttgcccaggccatggcttcagctgttgggcctaaacctgggtgaggaggtggggtgaggactggggtctgcattgccctgttctggttgcccctacagcacaagaagctggctgagggcagtgcctacgaggaggtgcctacatccatgatgtactctgagaacgacatcagcaactctatcaagaatggcatcctctacctggaggaccctgtgaaccacgtgaggactgggccaggctgggggtggtaggccagtgggtgtgaggaccctggctcacaagtccctctttggtctgttccaggaatggtatccccactactttgttctgaccagcagcaagatctactactctgaggagaccagcagtgaccagggcaacgaggatgaggaggagcccaaggaggtgaggaaccagctcaggtctgggggctgggccaggtcaggcctgggccagggtcacagtatctttgctgttgccttcccctgacaggtcagcagcagcacagagctgcactccaatgagaagtggttccatgggaagctaggggcagggcgtgacgggcgtcacatcgctgagcgcctgcttactgagtactgcatcgagaccggagcccctgacggctccttcctcgtgcgagagagtgagaccttcgtgggcgactacacgctctctttctggtaacacttcccatgcagatgcgtatgttcagtcagcgtgtgtacacagacatcacatcacccagagataatcagttaacatttgagcctttgatccaggacaataattaggctttacatggaacataatttcacctacatacacacacacactctctgtctcaccccccccccatacccctcccttttcggttcatttgaagcccacacctttggttcatgtgactgcccacacctgagctcctcaggagattggcctccctccttgaggctccctccttgagttccaccctcatttggggtggaacttggtctttggggccctggcctgttttccccagcctccctcactctgtgtcttccacaggcggaacgggaaagtccagcactgccgtatccactcccggcaagatgctgggacccccaagttcttcttgacagacaacctcgtctttgactccctctatgacctcatcacgcactaccagcaggtgcccctgcgctgtaatgagtttgagatgcgactttcagagcctgtcccacagaccaacgcccacgagagcaaagagtgagggaagggcctgggggcggacaaggcagggcagggccatgggtggtgctggccgggcctgactctgcctgttctcaggtggtaccacgcgagcctgaccagagcacaggctgagcacatgctaatgcgcgtccctcgtgatggggccttcctggtgcggaagcggaatgaacccaactcatatgccatctctttccggtgaggggtgtggcactgggttgtggggccttgcttgggtctgagctgccctgaccctgtgtgactgttttgtccttgtgaagggctgagggcaagatcaagcattgccgtgtccagcaagagggccagacagtgatgctagggaactcggagttcgacagccttgttgacctcatcagctactatgagaaacacccgctataccgcaagatgaagctgcgctatcccatcaacgaggaggcactggagaagattggcacagctgtgagggggctgtggtagacggggcatggcaggggaggcaggagagacccagaatcttaccagtctctggatgtgtgtaacagcaagacctggtgtgttgtagaagttcgtgggagggcccctgactccagctgggagccacagtgtgggtaccaggagggtgtctgcaggaggggacatctgagcagcatctttaaggatggggacaggcacataagcagagggttcctcatgagtcaagatgtggagtgaggaggttctggggctcacactgggagaggtgcacacagtggaaactcatccacctgggcttggcctggactctgtcctagggcagatgagatgaggctacccaagagtggttgtggagcctccgcctggtggatggtatggagggcagagccacaggaggtgagaccagtgagggaaaaagtcaggacccatggcagcacagctggtgataagggccctggacagaaggaaggggtctaggaccagaagatcagttgagagactgctgtcgtcagtagacagggctggctggggagagagaggcctgttgtccactggcacctgggactcaagtgatggagaggagcggcaggaggaatgtggggagtgggaaggcttttcctgactttgggctcagcagtgaaccaacaagccactgaactaaagcactgaatatgggtagtctgtgaagggcccacctgcacatagctcagaaatacttgggagtttgggcatttaggacctgagagattttagaatcctgggctgggccttacatgtaagaatgtgaagaaaggaaagggaacagtgaggccgggcctgaggcctctgaagccgtctctactgaggtcgaaggatccctgtggatcaggtgcaagtttgctgcactgggggaaagggaagctgctccagaaaccagtagctgctttctacctctgggctctggggcattaacatatcccattgtgtcctgtttccaggagcctgactacggggccctgtatgagggacgcaaccctggcttctatgtagaggcaaaccctatgccaactttcaaggtacagctcaggcctctgggcataggaagctggggagggtccccagctgcttggggcttcatttctgtgttctgggccatctgtggtctttgtggagaagtggtggttgtggttttccgaggcccaagaggttgtgagagatgtgtggttggtgagcgaccgcaggtctcccagggccgacccactccctagcccctaccccttaagtcagcagtgaccctttaaactgctcctgtgggtgacccctgtttccttcctgggcagcagcggggtaggagctgggaggcacactggccactcattccccggcctcatggagccctgttacacaggttcttttttgttttgcctttttctctaaaaaggcctgggccctatttctcaccccctcccctccacagccaggggacctggaaggaagtttttctttccacttcacagatgagtggtagggtcccatccaggccccatatgcttccaggtcccggggaggcactcagggccactgcagaccctgccttcttggcctgccagccctgactcctgggagcggattcaaggttctccctgtggcccagggtggggcttaaggttccacctgggtcccgaggtatttcactggcagaggccctgcctctctgatcatatctgtcctggagcttccctgcagggcagtaacaagaactataactagggcctgttgatggcagtgtcatctcccactggcctgaccccaggcagggaagcccaagcacatgtgtgtgtgcacatgaagccccaggttggcagtggcagggagagcctttctgctctgactggtgcttctcacctctgcagtgtgcagtcaaagccctctttgactacaaggcccagagggaggacgagctgaccttcatcaagagcgccatcatccagaatgtggagaagcaagagggaggctggtaagccagtggtgtggtaggcccagagtccaagggccccagtggagctggggccccaaagacatgcatttgtgatgtgcttgtctcctgtgtgcaccagcagtgcctgcctcaccctggcttaggcatgggaacccctaccaaaggataccctcctcatgggagttcggggtggttgctggaggtcagcaccctgtggctcccacaggtggcgaggggactacggagggaagaagcagctgtggttcccatcaaactacgtggaagagatggtcaaccccgtggccctggagccggagagggaggtaagaccagaaccacctgagtaacagcattccctattcccagattctccttggcatgcccccatcacacagtcccaagcacgcacgtgcatgcacagacacctgtcacatgggctggtcgcacagcccatgtggccatgcacgtagtctcccatatacctgtgctacatttggcagtcacaggtacacccacaagatgtatttgtcccatgcacacggatatcccctcacacacatatgcagtagccatgctgaccattggtgggctttgcttcccacagcacttggacgagaacagccccctaggggacttgctgcggggggtcttggatgtgccggcttgtcagattggtgagctcccatctgtttctcttgcccactgttccctagggtgagattcttctttgtatctctttcctgctcctagggaggaagctgatggctgaaccccaaagtctgccctcactccaagctctccccatgctctggacatccccttgacaccctgggctccctttgtcactgtcagctttgacccctgcatgtttacctatgccaggcactggggaacccgtcagaatcagcagaacaaagttgatgctgctggttggctgacatccccaggcctaatgggttgtaccacagggatgtgacagaggcttggagatggggtggagagggagacacggcctgaggaagaagcatgagtcagagctgagttggaacactggctccaccacaaccagcagtgacttgtttgagttgtagcgtcgtcatctgtcaaatgggccagcagagtagtccttcccctcatggggtgtgggaaggaggaaatgggatgagatagaactcatttgagccagtgcctgcggtgtggagtggggtggagggggtgagatgtctattcccagctgttatctgctctcgccctcccagccatccgtcctgagggcaagaacaaccggctcttcgtcttctccatcagcatggcgtcggtggcccactggtccctggatgttgctgccgactcacaggaggagctgcaggactgggtgaaaaagatccgtgaagtggcccagacagcagacgccagggtgagattctgctggaaccttctggggggcagtgtgtgggcccgtcaggcagctgaggcctccagctcccagcacaggccccctcagagcagtggggcagccgatggcctatgctagataggccacagcccctgccttagctagggattgagaagaaacagacacataagatgcaatgtggtgtgtttaggttgtgttgagtttgagatactgatgggtcgttgaagtgggtctgcttagtgggcaattggatacacaagaccagaggtaagaggagaagtcctgggctggaagcaggagtggagtgggggctgaggcatagaagggatgaggtggtgtcgcataggaagagaacttgggatggattgagaagctccatatgagaaggcatgggcgaggaaaggagcccaggaaaggcaggtcagacagactgcaggccactggtgagggagagggtctgctgtgttgagagctacagaggtaaagacaggaacgataagaacttgcaagtgccctttggattcagcagcagctaatagcccttgtgagacttttgagctgcatcagcagcatggctggcattagatggcagtgggcagcagggagtctggaatggcaaaagcagagcctttgtagggcctgtccttgagggagagaacaggtgactggggtttgagcaggctctcatgcagatggctgaaaggagcgagcagcgtgtgggaggagatggagcccaagcttagctggtaggaccagccttctggagaaggtggcctcttcccctgagcctgggggaacagagaagtattctcaagggttagggaattcctacttggtggccctttcaccaagtgcatttggtagatgggtctgtagctgctttggagagggcacccgcaagccaaatagagaagggatagggtgcttgccaggctgtcccctagaaggaaaaggtgctggcataccaggtggttgaaggactggatctgggggtctaggctgaaaagggaagagtctgaatgtaagagccactgaggccgggcgtggtggctcacgcctgtaatcccagcactttgggaggccgagatgggcagatcacttgaggtcaggacttcgagaccagcctggccaatatggtgaaaccctgtctctactgaaaatacaaaaattagccgggcatgttggccggcacctgtaatcccagctactcgggaggctgaggcaggagaatcgcttgaacccgtgaggtggagattgcagtgagccgagatcacgccactgaactccagcctgggcgacagagcaagactctgtctcaaaaaaaaaaaaaaaaaaaaaaagccactgaaagaaagtcctccaggagaggatgggttggggtgcttgtaagtgggcttctgtagagatttggcatggagatttgccatgaagagtgggtggttatatttgagttgggggcgctgaggcagtgaggatcatccttaggacacagatggaaaccaagccaggggcctgtatccccagtgcagtcacaggtaacacagaagaatcatttttaccccagcatgaggctgggtaataaatggtcagaaagtgtcatttgggagtgtggccaattccaggatccctggaaggtcactgggaacatgggtggtgatgaggagtctgtatcccccaccccccctaagagggttggagggcaaatgtgtcctctgggacagaaaagaggaaagatgatttcaggatgaggctgaggacagagctccctcatttactgttgggtgtggtgtctggaaggtacaggggaaggtgggagaggggcccagagcacctgcagtgtgggcatgcccaaggttggcaggggcttccttctcctgggcagggctgtagcctggggctacagggccttgtgtgtgtcaccagctcactgaagggaagataatggaacggaggaagaagattgccctggagctctctgaacttgtcgtctactgccggcctgttccctttgatgaagagagtaagggccagggcccaggcggggtgtgcatgtgcctggagggcctggtgggtgcaaaaagagtatttaggtatccccccaacacttcctgggtgggcgggctctgtaagtgttttccctgtttggcccagagattggcacagaacgtgcttgctaccgggacatgtcatccttcccggaaaccaaggctgagaaatacgtgaacaaggccaaaggcaagaagttccttcagtacaatcgactgcagctctcccgcatctaccccaagggccagcgactggattcctccaactacgatcctttgcccatgtggatctgtggcagtcagcttgtggccctcaacttccagacccctggtgaggaagtcccctgtgaggagggtgaggaggggcactgtggggcagctggactggaatacaccataatctgcctcttccagacaagcctatgcagatgaaccaggccctcttcatgacgggcaggcactgtggctacgtgctgcagccaagcaccatgcgggatgaggccttcgacccctttgacaagagcagcctccgcgggctggagccatgtgccatctctattgaggtgggtgctgctcatctgggcttcagggtaggaaaggggctgcttgccgttggagtctgtttatgttgagttctccaaaagtaggtattttcaggcatcaaggtggtcagggtgggtggggcctgagctgagtctttgaaggggtgaagatagcatgcagtcactgtatgcatctaggacgtgcagagccatggtgtgacttgttctgatgacttgttttgttctgatgagatcttttttttccctaaggggaggtcatttaaaagatttctgtgttaaaatagtaatggatttaacatgaagtagattgcaaaactcacatggaaattttggctaaagctcagacttcagataaactacaggcagcagctgctctggacagcttagggtccctgatgtcgtgagggactccatgggcagtgtcccgggggcccagcagagggcgcgctgcctccactccacagatgctgactgagcctccgcagtggggaattggagggagcaggaaggacaatcccaggcccttctttgtctgcctacaggtgctgggggcccgacatctgccaaagaatggccgaggcattgtgtgtccttttgtggagattgaggtggctggagctgagtatgacagcaccaagcagaagacagagtttgtgggtcagtctgtcttcccagtcatcctcctcatcctgctggggcactgcaagcctctccccaccagtcatcccatcctctcccacggtgacctgaagccttttgtcgttgccttcacagtggacaatggactcaaccctgtatggccagccaagcccttccacttccagatcagtaaccctgaatttgcctttctgcgcttcgtggtgtatgaggaagacatgtttagtgaccagaatttcctggctcaggctactttcccagtaaaaggcctgaagacaggtgaggaccattcctggaggcagtgcccctgcaatcttgctggcagggtggggctgggccccttgctctgtccctcgtgggctgagggccaggcttttcctcctcctaggatacagagcagtgcctttgaagaacaactacagtgaggacctggagttggcctccctgctgatcaagattgacattttccctgccaaggtatctgcagcaggggtgggctggcctggggtaggtgggaggagagccaggcagcagcctctagaagtgcagaggagtcattgaccctcttgtgcacctggcttcgttgaagcaggagaatggtgacctcagtcccttcagtggtacgtccctgcgggagcggggctcagatgcctcaggccagctgtttcatggccgagcccgggaaggctcctttgaatcccgctaccagcagccgtttgaggacttccgcatctcccaggagcatctcgcagaccattttgacagtcgagaacgaaggtgaggaagatggaggggtgctagagccaggaaggcagtggctaggtcctccttcttcagtgtttctttctcctgggtagaaaagttgtaatattgtctggcattgggctgcaaggccctgcctgccagtaaggacactcttcccttctgtccagggccccaagaaggactcgggtcaatggagacaaccgcctctagttgtaccccagcctcgttggagagcagcaggtgctgtgcgccttgtagaatgccgcgaactgggttctttggaagcagccccctgtggcggccttccgggtctcgcagcctgaagcctggattccagcagtgaatgctagacagaaaccaagccattaatgagatgttattactgttttgggcctccatgccccagctctggatgaaggcaaaaactgtactgtgtttcgcattaagcacacacatctggccctgacttctggagatggatccttccatcttgtggggccaggaccatggccgaagccccttggagagagaggctgcctcagccagtggcacaggagactccaaggagctactgacattcctaagagtggaggaggaggaggagccttgctgggccagggaaacaaagtttacattgtcctgtagctttaaaaccacagctgggcagggtgagaagctagatgcccctgcagtttggccctggagccagggcagaggaatgtagggcctgcatggagaagggttctgccctgcctgaggaggaggacacagcacaagggcacattgcccatggctgggaacatgacccagcctgaaagatacaggggatcatgttaaaaatagcagtattatttttcgtctcaatggtattgtaactaagttatttactcctcctgctcctcacccctgtagggaaaccttggagaggagagtggcaggtgggctgcctgctgtgttaagaggacttagtttgtgatgtaaggcactgtcaggaatggggggcgggccagggtgggaagagaagaaatagcagagcctattttggtgaggttttttgtttttaagtcaaagaagactcagtatgctttccctgaggaatgaaaaagggattgaggagttgcctgactcctgggtgggtggggtacaggcagttaggtgctgaatgaagctgccatccttgctgcagcttctaactggtaaaaagatccagggatggagatgggaaggttagaaaggcagccctcacctctgaggacagaggccggggtccaggcccgtgggcgcaaaggtgcctcatagcatagccagcattcagcacacacaaacctactgcccacatttgggctcagggttggccatttgctagttctgctgccctcttaagatctgactgccaaataaatcatcctcatgtcctt

SEQ ID NO: 2684 - DNA, 38197 bp, Homo sapiens; identical to SEQ ID NO: 2683
  source 1..38197: mol_type = genomic DNA

SEQ ID NO: 2685 - DNA, 210090 bp, Homo sapiens
  source 1..210090: mol_type = genomic DNA
caggtatatagcatttataggcatttcaaaatagtcactttgaaatgttgagcagattcatgatagattttcaaggctttgaattatttacattttaaaaagtttatcagatattgcaatgttaaagataaattatttgaacttctagtaggtagtaatggtgtcagagaatgacaggtaattaagtcatacagtacatcttgtgtccacatttcatgcaatttttgcagaatgctgtactatgtaaactgctactgcaaaaaaaaaaaaaaaagcaattattgcactgaattttccataaaatccctccaagtaaatcttatcacccctttgcagatgagcatcttgtctttgggaagatgcaatagaaaaggaacttgccatagaaagcagtagtaagacttcttatatgagactaagattttcatttcattagctctctccttcaccttgtttattaattctacaagcatttattgccatctcctatgtgccaagcactggtccaggctctggggatacactatgaacaaaatacagtgaagtccctgccccatggagcttacattctagtagggggagacagacaaacacataaatacaaaatatcagagggttcaaaacagcttagaggtatcttgcctgaattctgtttactgcatatcctcattcttgggcaatgataaagtgaagagagaggccaacaatgggctgcagcaatgttgctagtcccagctctaccatctacacattgagtggatttaagtgagttctcatctgatctgagcctcagtttcctcatctataaaatggggagaaattggattaaattacttataagggaaagggtcctttcaggcttttttcatgagagtagggtgctgaaaatcaagagccagtttgttgactcctctaaggtttaaaaaatatttaaatataaaatctaagaaatccttagagatcccatacactcaatacttcaaatgccaatctgaacttctttcatcaatagcaaattcttatttacaatggctatagaatgaagtcattttaccatctttagccatatgaaaaataagttatttacttataaaaacattcatttttattattggttacaaaatctcaccttatttgtgaaatgttccctagctatgagatcctgcccttgatgtgacactatttctctcttctgctaacccctatccctgactttgtgctcctgtttaatttttccaactgaagtattagctttatgaaaacagggatcggctgcttgcttctttgaagaacaacccaaatgagagtatgtccaggtaatccatagacatgtataatcattacacctgcattttgttttacaggtacaggccttttggtaacccacattagctctttagactgtcagagttgttcagcttagtaaaatttagtttatcaaagggtactctaacatccgaaaaggaaaaacacgtttccagactaattcacagactagggcattgtaacttcactggaagccctggtgagaggcgttaatacatatttaataatgtaagtgaagtagcacatattttataatcaattaatttttctcaaagaagataatgtagcagaagacctgaatgtcaaacaaggttagactcatacttactaacttggtaggagttacgatgcctctgattctcttgaaagacaaactgtattcactagtttgattttgaaatgtagagatcaaatttcaatcaacccagcagctaaggatgacaggaaattttacaggactagaaggaatcatcttctcttatctggatctgatcctcctcgacaccttgggggtttccgaaggctgtgtgctctcagttttagctggttgttacgtaatcaaatatcccatgcatgtttttacatttgatcaggtgggcctaatcacaaggactcatgttgtcagtgcctttgggagcaaaatgaaataaatctctgtctcaatattggaatttattccttcctgttgcttagtggtgtcaagatacagtgtcaatgttaccagaagtgcctaacacagtctactgtgtaggctaaagtctgccgtgttcgtacagtgactgaaaaggaataatgactatatcctcatttgggtgaatgttactacttcaggaccagatgagcaggggcatcccatgtaaccatgaagaatcttgaagcagcattacaacatctaataataaacaatctctcaaacagtgcctgtatgaactgcaagatgagggcaggtccagctagacattggctgcataaatgaagatcagagaagaataaggagattcagacaacttttggcaacctagatcacagttactggtaaattcttgttacaaaggaaatggattttggtatacggaatttgaatatgtgttttactcaacagagtacatgctaccaacaagaatgcagccccctttttacaagttaggcagaaggaattataaagtcttgctgatgtttacagtccttacatcaatgtgactgcagccctccccagtcattccaaaaggtccttgggttggatacgagaatgcgtcaggcctggctttggctatgacatccccaggaagtcactgtgtgcagtgtggtctccagggtggaagtctttgagctgccaatgaatatctcttaagtccaaacctccatgggcactatggcctctttggtcccaacagaaggcagtaggctttcttcagacaagaaataaaaggggaattgcaccaaaaatccacggatcttcttcagttcctcctcagctcgaatgggatcttccttagctaatacgggcttgtttataaagtctctcagctgaattaaattgtgtacttcatcattgggaaggcaccggaaaacctgattagagcataaatagaaaaatgagtgaaaagtttaaaagcgagcacatggcctttatggaaaataattattccaacagacaagacctctgttgtatgaaacatattattagtcttatgttacagcacagacctgatttaagagttggttatcttataaccaacaatagatagatctgctacaaacagatagatctgcttccatttaaaaaatcatggttagtggcaagaaattacactaatgttaccccacattaaggttaattttttttggataataatcatccctgaatttcactggagcttctggtctaagaggaatattgcatattatattttccctaacttttcttgaaagaggctcatatctgtacctttacatagcattatcaattgttaatatgtaacacttactttgctggttgaaaatgagttttggatatcataacacttcacccctgaatacttctctgcaggtatgtcttaagaataaggacatgtgcctatataatcacagcactattctcacacctaagaaaattaattatataatgtcatttaagttatgcttcatattcagatttatcctgttatccccaaaatgtcttttatagatgttttcccccaaatccaggacccaaataaggctgtgcactgcatttgtaaaattacattttaatgactctatgcacatgacctatttgatcatggccttcggtccatgaaataaggatgaaataaggttatacaggggtcaggcgcattgggtcatgcctgtaatcctagcactttgagaggccaaggcaggcggatcacttgaggtcaggagttcaagaccagcctgtatcataatacaaaaattagctgggtgtgctggtgggcacctgtaggcccagctactcgggaggctgaggcaggggaatcacttgaacccaggaggtagaaattgcagtgagccgagatcatgccactgcactccagcctgggcaacagggtgagactccatgtcaattaaaaaaaaaaaaaaaaggaaagaaagaaaagaaacaaggttatacagacagtagacatgtttcattaagaataataagtttctctgctggaaggggctctaagagaaaaattgcgtattttccctaatttttttttttaaagaggttcacgtctgtccctggaagtcatgaagaagaacacagacttatccaacttctcacagatggtcaattagtctgggctagaacacagcttgaatagttttccctgatgggcaactagctacttttcgaagtaagctgttctactgttacgcaactcttaactcttttacattctttattataaccaaaggatagacttcacaggcaatgcatttggtatgcatcaaatggagccggttttaaaacacctttctaaaactagagctgtccaacaaatgacatgtcttgttattaatattaacaagattcatcataaggatgaatactgtttactatacactatgtgctaaaaccattcactagactattctttgtcctcataactacccttgtgaatattcctcccaatttataggagaggaaaaagaaactcagaaagttaagtcactatacacaaggttataacaccagcaacggggtgagctaggctggactcagctgtggcttgtttttttatgccatctgcccctcttctctttgtcactagacatgtacaaaggctgggtaaccaggtgctaaggatgctgctgatgggattcctgcatcacaggagagactggaatgctgctaaagcctcttctaaaccaaaatccacaatgctttttgcctttgtttttcagggtccacaaagaggtattttattacaacctggacatgtattagcttttttacgtttattaagaataccctgtaccaataatatgcagaaataacaatatgctttttgtgatgagattcagtgaaaagaaacggaggaggggaatacgtgaacttcaccttgtcataaattgtagcatttcgagctgctgttgaaacccacacctccttgaagaatttgtcactcactggatcctgaatgtcctcacttgggtcatcaagatagccaaggacaaccctgaaatacaagtgacctccacattgagtaactgagataaagcagtttgttgcaggatatatgtctattatatctatctctatatatgcaaatatatatatgcaaattatttgagagaccatgacctagctactctcatatcctcagagtgcctgacataaaagaaactattgtctgaattgaccacacataaacagcggactagacataacaaaaaattctcaagcaaacaagacaagttttagaagtgatatttgaaaattataataacccttgtacttagagaaggctttaggattaaaaagcacttccaccttaatcctgtgtggtaggcgggacagatgattctcattctgtagataggaaactaaagtctcgaggcacactagtaatggagttagaactcaaactgagggcaaagcccttttcccacatacttgataggctgaaataataccaagaagacctgtgctatttggaaagagcaataggaaaattggccttgtaaggctttggtttttatattaagtgaaatggagagtgtagacatcagtgcagaggagtgacagaatctgacttacatattaaaatacggctgctgtattgagaacacactctggggggcaagggttgaaacagggagcccatttaggagctactcccataatccaggtgaggtatgatggtggcttgggcctgggtggcagtggagatgaagatagagccaacaggttttactgatagagtgaatgtagggtgtgtcaaaaagtgaggcatcaaagatgactacaaggtttttgtcttgagcaactataataatgtacagctgtagtcgcctttagctgagatagggaattctgtgggtagagctggtttgtgggagatcaggaattcgattttgagcctgttgagacatctattaaagatgcaagtggcagtgctgagtaggcagtagataaatggaactggggtttgggagagaaggcttgtttagagatataaatctgagaattgtcctcatgcacatgctcataggctgaatgtttttttctgagttcaccaaataagtgagtatagacagagaagaggaccgggtgtatatcaacagtaagggagaggaggaggaaccagcgaggctggagaaaagccagaggatgtggaatcctgaaaccacacaaagaagtatgtcaaggagaactgtccaattcagataagaattgaccaccggctttaacaactggacatcattatattgttaccctccttgtatttaaataaatgtagatttgcatcatcattttaatggctgcagagtttcctatcacgtgaaatttattgaaccaattatttcattatggacttttgggtaatttccaatttttcattattataaacagtgttacaatgaacacagtttattcatcatatgtgattttgtacatttctgtgattatttcataagaagaaattttagaattagaattcctgggtcagagaatattcaaattactgcaagaaaggctgtaccaaaacatacactattaagcatgaatattttcccagttttctccaacattatcaactcacgaaaaagttcaagtctgtagatattaaaggacactcattttagttttagtctgcactttttccactgtataaaaatttttttaaaatggatctggcaccataggctttctaggattcttgacttttataacctcaaagttctgtttccacttcaaataatgtgcctccttcagactacacgagaataactttttttaaaaaaagatttaagagatgtttgcacatagacattggctgctaattgagacccaaagcacaattttactgcatcaaatgtgaatgacagtacaaatgatgacagtaagtcaattattataatacctttgatttgggccagatttaagaagctgaaaattgagcagaaagagtttttctgtaactttgcttttaaattagagcaagagataagccaatgtgtccaccaaactatcaggtaagggcttgtttgtagaaaaagtatttaaataagtctaaaataggcaatatattattttccctggcagtattttaattataagaaatttatattaaatgcagagtaaaaataatatgaagtactctggatgttcttttgaggactaaagtttgagagaaaactagtttaattttatgttgatgtatttaatgaaaattatttaatatttgcttattcatcaaaaaaagtgggacagtaggaaaaccacaaaaaattatttctgttctttccgttcctcatatctatcactttaaatgattctgagtcctaattgtgtggacaatggtttctcttgagtgatggttatatctgcaaagtttggataattttctaggacttgaactgttcagcttatagctgtgaaatttagtgcatgtttgattctgtctctatttagaattgatttcacattgaaataagtctctctatttctattttaaaataggccagatggaaaatggagtgaaactgcattttttaagtgaaaaaaatggttgtagtctaggccacaatatttatctttgggaatgtttcctaataaaaagaggctaaaattgacgcaatgtttttgtggtgcttttaaatatattatctgtgtttgccattggggcaaagtgaaaataattattgaagaacaactgcctctttaacacaatttgaaaaatgcgaagtaaaagaaagcacctagaaacaaagttagcataagatcagcattaaaaaaatgaattatttactgtagaataatcttcctccccaccaataataaaaacccaaagctttattgaagaacaataaaatattcatataaattgaagtccataccttgttcttcaacaagatgactcaatattataaaggtgtcagttcttttcttcatctataaatccgctataattccaattttataaaactagtaagaacttgagagaacgtgagtaaacaattctaaagtccatgtggaagaattaatgtttatgaataaccaagattattttgaaaaagaatactaatttgaagaagtggtatggcaaaaagtagtcttaaaatgcacagccacaataattacatggtatcacactggcatgcaagtaaacagactttcaatatggcataacagagagactagcgagaagccagaacagatagtgattcagtgtatcttaaaggtggactgcagataagagaggcgaagagtcctactacgtatcgtaaggttccagatcatctggttagttgagaaaaagagtcaggaccccgacctcacttcttacactaaaatacactgcagatgttaattgtaaaaagtaaaaccaaacaagcaccaggagaagacacaagtaaatgtttaatcttaggctgaggaagctattctaagcatacagaaaaaggcaggtggggaaaaaaaagaaaaaaacagattgatttgattaataagaattgaaaaatttcccccaaattctccaaagatgactaaaagccaacaggcaaacaaaatttgcaacacatatgacaaaggaataagcatcctacacatatttaaaatacttataaatcattaaaagaaagttaaacaacaaccccattaaaaagtgggcaaaagacaatggaaaagacatttttgaaaagaagacacacaagcagccaacaaacataaaaaaatgctgaacatcattaattatcagataaatgcaaattaaaaccacacaagataccatttcacaccaatcagaatgactattattaaaaagtcaaaaaacaacagctgttggtgaggatgtggagaaaagggaatgcatatacactgttggtgataacagaaattagtataacctctataggagacagtatggacacttctcaaagagctaaatatagaactatcattcaatacaacaatcccacaactgggtatctacctaagttgtcctaaaaatgacacctgcacttgtatgtttatcacagcactattcacaatagcacagtgttggaatcaacctaaatgtcctgagcagacaattacataaagaaaacacacacacacacacacacacacacacacacacacacacacacacaccagagaaaactactcagccataaataagaatgaaatcatgtattttgtagcaacatgcatggagttggaagccattatcctaaatgaaataacagaaagttaaatactgcgtgttctcacttataagtgggagcaaaacagtacatacacatggatgtacagagtggaataactgacgttggagactccaaaaggtgggtgggtagaggtggagtgaaggatgagaaatcacctaatgggtacaatgtacactatttgggtgacagttacactaaaagcccagacttcacccctacacaatgtatccaggtaacaaaactgtacctgtactccttaattgtataaaaataataaaaaaagaaagttaaaccttccatcgtaatgggcaaaggatacaaataaactaggcaatttatgaaaaaaattatacatggctaataaacatatttttaattctaaaaaatgtgaattaaaatggtgaaattccatgtgaaatctaacaaattggtgaagattaaataaactcagtcaagatagaaggaataagccctctaaaatattgccagtgatataataagagatcaaaggagacaataaagaaggtgaacaagaaggtatctacaaacatacccatttttttatatcagcaaaaatatctgccaaacaatgagggattaaaggaattatggcatacacatacaataaaatataatgtagccattaacatattgtagaagaatactcgatgacatggaaaatgtgtgtaacattgtttaaataataaaaaacatgtaggcctgcaaaattctaattttgttttaaaaagggaatacaatatattaatatctatgtatagaaaaaagtggaatgacatataccaaatgttaaaactgttatcacaaggtgatggtattacagatgaatttaattttcttactggttttctgtatttgccaaatttgtacataaaaatgtgctgtaatcaaaaacctctaccttctataattattacacatttaaaaagttataaagaaactcatgactttaaagagaattcttaagttcttacggaactgaaaagatataacatacattccagcttacaaaaggaagtatttgtcttttatgtatgccgcagtaggcaatcaatgggttaattagcagggtaccaatttttaaattctcctctgctaaacaaaacaaattaccattagaagctaattgaattatcaatggtttgaaaatcttcttactggcaaatcaagtagtaacaaaggcaataaatacagcaataaaagttgttagaaggtattgatagattttgagggatggattttttgagctacttagacagagacagcagaatgtctctacaactgaggcttatgttggtcttggaagccgaagtctggattggtaggaatgagcgaagtggcctctgcctttgccgggagttaagtgctcactaagcgcccatctgcaagtgagccagtttccaaaagggaccatttaacacaaagaaaacaacaggctgcagcgcagtgcccttcccgaaagggcataacgcactgatcttaactatatcggggccacctgctgcatcccactatacagtcctcaccaaaattgcattatggcaaatatagttctagaatcataaaactgtggacttcctacaaaggcctagagttgggagagtagtcagggtgttccacagccggtggggaaatgagtgtctgcagggagcaagggaaacagtgaaaggagacgagattatattacttgttccttgtgagataagaagccattggacagtagtgagcagagaagcaacatgatctagaaggttctagagggaccactgtgttgagaaaacacaacaggggacgtggacagttacagcgcagcccttgaaagttctaaataacactttattgaatggacttatttaggatcgcacagctgaaacgagcccagcttcctagcccagtattctctctgcttcaccacagattagtttaaaatttgcatcttcttgccaaagatcagggatcttcgacacctggagtcattttagacctgaaaacagaagtttccacatttaaattttacaccagcagtcactggcataccccttcaataatttttattatatccttgtattactggaattaatttgattttaaaaacttaaatggaagctggagggtttgacctggtctagtcctaattcagttaaggactagtatttaattggctcacgtctgtaatcccagtgctttgagaggccaaggcaggaggatcacttaaagccaggagtttgagaccagcctgggcagcacagcgagacacggtatctacaaaaaatttttaaaaattagctgggtgtggtgacacgggcctgtagtcccagctactcggaatgctgagccaggaggattgcttgagcctaggaattcaaggatgcaatgagctgtaactgcaccactgcagttttttctactgcacgtgacagtaataaaaagctattaaaataaaaaatattcatgtaccacctaaagtcatttcgcatactactggtggtacatatcctatattctgggacacactgttttagatgaagaagaacctaggatgacccatgtgctcagggctagcggggctgggtcccagcgactgctgcagtggaaatgcatcagagagacacactttggcggactgacctaaagcactgtagccgaagtcctcgggcaaaccggccagcttggtactcttttccatccattactgaaggaacagtctctgtatcttgcacaatgacagccatttcactgtcacgctttcccagcatgctgcggtcatttatgttggcagagcctgtaaggagaaacagtgaggctgaacaaccttcctgttgtggcagacactgttggttgccctcccaactcaattcatccttgcaaacaaaaccgtaattttgtccaggttttcaagggaagatgtgtttttagggaggtggggccctccctaacccaggggtgaatcttaatcagtctaagccagccatggtaatttcattatttttattagtgactggcttagaaatgggctcttgacatggtgctagccaatgtgacatgaaggaaagcttctgagaaagagtttcccctttgtataaacacacaaaaaatggattctgtctcttccatcctttggatatcttggcttgaagggttggaagaagacatgattccaggagctgctgcagccatttcacaaccactagagaacaaacaaaaaagcttaaagaaaatgctaagtagaaaaaagagccaggcatggtggctcatgtctgtaatcccagtgctttgagaggccaaggcaggaggatcgcttaaagccaggagtttgagaccagcctggacaacatagcgagacctggtctctacaaaaagtttttaaaaattagctgagtgtggtgacgcatgcctgtagtcccagctgctcggaatgctgaggcaggaggatcgcctgagcctaggatttcaaatttgcagtgggctgtaactgcaccactgcacttcagcctgggccaaagagcaagacttcatctctaaacaaaacataaaaataacaattaaaaaagaagaaagattctgggtctttaagtcattgaattagccaacctttgaatattcttaccttctgtcatgtgaaataatatattttccttattttctacattgttccttattgtttcacacacacttctagttgagttttctaccttgtggcacaaaagattctaactgttacaatcatcaagcacttgaaaaaaggcatgcctaccagttcagtaggaaagatggctttgcttttggagttaagaatcaggctctctgtaggctttaactcaaagtcacataactgtgaatgtcaaaactcaagagtaccttcataattaatagagtataatctcaaatacagattgtcatttgtggctttgggctttctgctttcttgcctccctcacttgtgtagcatgccaatagcttctgtagcaactttcctccattctattttttaaaattattaattctctttattagctcaatacctggttcattcaaggagtccatttttttttttaaatccaagtgagctgagaatgttgacttttacatgtgaagggcaaatattttgctattagttcaacctgtgctttctgcagtcctctgctgtgtattcaggaacctcatcacgtttttttgcattaatctctgcagattcatgcatttgaatccttgaggtgtcctgcaaactacagaaagggcctgactgactcttcttgttcctcttgctctagctgcaacaactccactgcttcttcagacgtggagcagaagggtcaggttgaacaggcaccctggcggccctctgactggagcagccagagctataaggtgacagcagccctaccagagctcaaatggtgagatgaatgagaaaagctgccctttcctgaagagactttactgcctgttgccagaatattgtcatgtggttaatatataaatctatgatgactatggatgtgagtgtttccccatggtggccctgggtaacagagaaaggatcgagcaccctacagaaatgtgagaatgctactggagtgctgctgaaaagtgggaacctttgaaacactttgttttgttagcaccaaatcatcctttatacatagacttacatcgtggttatgctataaaatttgcagctatatctttgagcttgacagttgccccaacattaatttgggcaattcacttaatctttctcagctttaatataatctttcataaattgagataataatatagaccttgtagggatattgtgggaattaagtaagaccatgtgaaagcacttaatgatttacaagctgctctacaaatgttaattattactggcattattatcagatccttgttaactctacaataactgcaccggagaatgctgccataggaaccgaccatttgatggaatgtagcatttgtttaaagaagcctcctctctggcttaatcgccccatgtgtgaactgtaggagctcaaagattgaagatcccatattgctactttaggacttttactgtgcccctggagccagcagaggccgctgtcaggcgggggctgctggattgaactgacatcactgctttgtttcgggtcaggagaacctgggatgtgagccagcctggaaagccccctccgcacacacattctcccacgcgcccccattcctctcccaccacagtgggccccgacactcccgaggtgaggaatacatttccagcattctgagctggaattattagacagagggtgtcgttcttgtattttaagggccaacatggaattacccagataactgactctccaccacattaaataagtgtgttggctgctatttaataggcatgtgaggaaagaaatgagaaaattttagatgaatgaataaattagatataataagatatgatggatgtaaatgctccctccatttgttcctgtattctgaaaatcaaattcagaagaacagttgtagtattaccctatttttatacaacatatgaggaagaagacagaacaagagatctagaaagatacacactgaactgttaacaatagtaggtgcttttcagtgaagagagagaagaaaataaggggaattttggtcttttactctataagcatccttcttgtttatatgacctgttctgagtgctattagaaaacattctaaaaattgtgaatatggcaaaatacaaaaggctatatgaaaatatgtgtgtaaaacttaagcaataataaaatagtcatcactgaatttattaccctggccaaaaacaatattaccacatcccagaaggctttgtgcaccttcccatgcatacccttccctccccaagaggaagacttgatgtttaactttgtgttcatcatgctctgaatgttttcctaaacaacaaaaaaagagtttacttctgacttgtttttaatttatataagtggaatcatatatcagatagtcctttgagatttgcttctttcattcagtcttatgtctttgagatttttctgtacataattgtaatgcatttcttttccttgaatgaacacactagggatttctttatttattctgctattgatggatgtttgggttgcttccagagttttgctgtgatgcacaattctgctctacatagctgagtatttgtttcttggtatagacatgtgtgagtttcttaggctctgtatgtaggcgtgggttgctaagctgcagggtgtatgactttactaggtaacaccagaatgttttccaacttacactcccaacagcagtggaggggagtctgtattgctccacagccatgccaatacttagattgcccaacttttaactgtttgccagtctggtatttttaaaaactcttatttgtctcatgttaatgagaagcaacattttttcacatgcttatgaggcttgggtatgttctttttgatgaagttcctatacaatttctttgcccatttttctttggacatttgttttttcttattgatttataggagttctttatgtgttctgtgtattaaatgggttgcaaatatttcagtttgtggtttatctttttattctctttacagtaccttttaatgaagaaatttctgaattttaatgcagttggatttatctttcctttgtggtttgtgcttattttgtgtgtctcacttagaaattgtgaatccttgtgtggtatgcagaatagcagctctccaaaatgtccgtgttcaaatctccgaaaactgtgaatatatgttcaatggcaaaggcgaactaaggctgtatatggaattaaggttgctaatcagctaactttaaaaatagagtgagtagcctggattatacaggtggacccaatacaatcataagatctgtaaaagtgaaagggagtcagactgagttatgattacagaagaatgggttgagacttttggggattttcagagatagaatgttgctgactttaaaggtggaagaaggggctgtgagccaaggaatgcaggcagcctctagaaacaaggaaatggactctccctaacggcctctaaaagaatgcaacagccctgctcacactctgattttagtcctgtgggactcacgctgaatttctaacctactgaagtgtcagataataaatttgtgttgttttaagctactaagtttgtggtcatttgttacagcagtaatgggaaacgaacgcacgaactctaccccgttttagtttgttttgaaggaaaactggttcttctattgagcacactgggctactctgtcttttctgcctacttgtatttcctttgcctccaggtcagaagttctcagctctgaccacatatgagcattacctaggaaagctaacaaggaagctttttaaaaaatactgatgccaaaaacaaaaccaaaaaaacccaaatgcctggccccaaaccagaccaactagatcataatttctagaaataagaaccaggcattggtataccactccatccctgtatccattgttaatttatatttttgttttgatccatttaaaagcaaattgcagacatgaggaaatatccccctctttactggggcagcccttcaactccagcctctcatctgccacagtgaagcctgctctttaaatcctgagactcatgagctcgacttagtttctcctcctacccacacttgttgattgcccctgaaccttcttgttctggtttggcaacatccatcctagtgtttctgctctcatatggaaggagtagctgcctctcctccagccagtgatctctgggagggcagtggcgctgttttactcacgtttcgcatctctctattgtgctttgcagtgggttagtgaacattaaaaacaaccgtttcacttagtcatcaggataggcttaaaatctacttgaaggggagcttggctttgttttggaaaccaaatatatgtgtgtctggttaaaggctaaaattaagataggtaagaaaactggatttggtcacagatttcatgaccagcagggttacccagggccacaggcaattaaagctatgcacaaaagagatcttcagtgtgagaaaacaaatatttcctcatgaggagtaaaatgaagataaatggtcatttttcttatgtcagctattcaatcattctggcataagtttgccatggaagaaaaattaatcatacattacttaaacctcctttaaatgtttaaatacttccttaacacctataaaatattctcaacctaacttctcaaactcgtctctgagaattttaaacactgttttctgtgttaggaacttaaatagggtgaatgtgttagaacagtaacaataaacctgcttattcttgagtttccaccgagataaaaagaacaaaagaaactctggattttttccttgggagaaatcgattctctaaggcacttggggaaggaaaaaaggaatccagcctccaaggactagcaagtaagacctctttagactcccagggccatatcctcagtttcaagagaatgtgtaagaattgtgtgcaaaattgatcaagtattgctaaacaaaataaattggagtctttgagtgtttagagacttttccagaaaataagtcaattaaaaacctcaacaaatttatttaactgttagctctgttaccaaaaactaatttgtatttatacttcatgtaaagtaaacgaggctgaaagtcaaaatgacctttcaaaaaaatatttacatctgtcagtttttacttcaaggcttctgaaatcttggtgaagaaatatgtggctttgtttatttttccatttcagcaaacatcaatagtttttatttcttactgtcattgtcaaatttaattccaaagtattctgagatttgcttttgaagagcaagtcagagtagctcaggagaaataaatgaaatcttgagtattagggcaaatgggggaataaataaactcctaaagagcttttatccctataggccaggagataaaagaacagtattttttaaatgtgctatacaaatattaaaagtgtgtatgtgtgtgtgtgtgtgtgtgtgtgtgtgtgtgtgtgtatctcaccatactgtggtttacacagtttctggctatagacgaggagataaaggaacaatattattttaatgtgctatacaaatattaaaagtgtgtgtgcgtgtgtgtgtgtgtgtgtgtatgtatctcaccacactgtggtttacacagtttctggcttcagaactatgtttcttttctattcaaatcatgttccagataagacagttttattcttctcagatatgagatatgttttcttttctcagtggagaatagaaagcatatttattgtccaaaattttcaaaacactccatgacatttagtttcttgaataataggaaagtatcttattatagctgataaactacatttcatttgaaacagatgagcagaattcccattagtaggacacatcatctctctaaataacatgacccacactggttacctcatttacctggttgattatttatactctatcatcctggacttccaatactcattttatataatattaatattagaagtcaaaataattcaatgatggaagaatgaagctttctatgtatataaaagaatgaagctgaacatctacctctcttgtcaagctaatctaatttgggtagaatgtacaagttatttaggagagtaactctcctgaatttgtcagtgggaagaggcctttggaaaagtctcctgtgtatccttgacaagaaatgactgcagaccttagtgcagggctacatcctatcattagtacacaattcccacttcatccatacacatcaacaaagttggactgctctacatcctaattaatgacatggaaaacatgcatgttaggaaaaatagtggtaatgcatagaggcagcaatattttaccatccttctgatttcgacttttgtacaacttcagatctgtggtaatggttaggtggatgtggtataaacacatacgaattaccacaaggtactcacttatgacacactttccctccccatttatcccccaccaatccctgaaatctgggcacttggattgtaaataaaaataaggggatagctgggtgtggtggctcgggcctgtaatcccagcacacgggagactgaggtagaagaatcatttgagaccagcctgggaaacacagcgagacccccatctcaaaaatagttttaaaaattaaaaaaaaaagggagtaataaagaattagtgaaatctggcacattattggactgctgggttaaacagctgcctctggattctgcaattttcacgaagtccatttaattgctctgtacctctgattcttcacagataaaaatagtttagttcacaaagagatgataaatgcttgaagtgataggtactgcaattgccctgatgtgattgttatacattgtatgactgtatcaaaacatcgtatgtaccccatgaatatatacacctattctgtacctataacaatttcaacaactgggttagaaaggatgtaagagaagaggatggcttcagaaatgttttagttatggtgttactgtctgtttcaaatgcaaaggatgcttaggaggaatagcagcaaacatttttgcatggggtaagtcaactggcaaggaatacaattatagaccatatactgtacttaccaataataacagtgttatcatcagcaattaacaacttgctgtggacatagataagctcagttactaggtttccttcgagctctgcatgtgttctaagaccacagaatgatatgtaatttatccactgattaccaactgcaaatttaaaaagaaattattaaaattaatatgaccaagctcaataaacgtacattaaatcttattgtttctcaaaacatactacttagactgttcagaatagattgtatattatatgtatatgttttctatttcagaattcatccaggatttatttttgatatctgaatttcatattgtcagtctgaatggctttctctctctctctctctctctctctatatatatatatatatatatatatattatatatattttttttttaattgaagtgttttctgtcttccctttgctaaggcaatccaaaaagctattcatatatgaacattttattttaatgatttgatgagttaactactgaagagtgatggttaaaactgagctggaatagattaaccaagacttcagtgtgacatttgcttctatcctgcttgacacttgctgcagtttgaatcagatgcaaggtgtgtgccaaaccacctgatgctacatcatttgtagcatattcagcgtgaagcatcagttaaattctgcagactttgggtaaataaaaatgttggcaatgaaaaaccactcctccctttagatcattaaaattaggaaacagaagaatccttactacattagacttagaattttcttcagagcaagcagcaccaggtttgtacttcaaaatattgccatccctctaatcacatgggggccattcacatgataagaagaaatacattccatactaagccaagtcataatcatgacccctgttgtgagtgttagtcacaggatttttatggtctttctcccacacagcagttgtcttggataagcaagtctgataccaagaataaatggagtggaaccaaactatcacaaattctcatagaaagagagcatacatttttttttgtctttaagagaatttgaagcatactaatagaagggtggcagttcatctcccatttactgaagtttccatttattactgatggtttctattttgctactgatgttattcagtgtttctattaagtttgggtatcttggaaagaaattcattcataggttatgtatagagatgcctccatttagagatagctctcccctcatatatatatgagtgatgttgtatagctgtgtttgatgagagttgaaatgttggtatactagtacaccatgtgtaagagatgcatttctaaaacgtttcatgtaaatgaggtttttgcaatttattcccccatttgttaatgttatattggaaagacacttcatctgaagaatcacctccttttttaagtcttttctgatccatttccttttttaagcccctcagacctataaaattcctggaaaacatttctaaataatgcctagtatcttacaaacatttatataatcttcaagttattctactgttgtacaggaactgggtcttacacatttttgtttctcatcctttcacagtgctaaaaaaagctaaataaatgtatgagtggataaatgaatattcaggtatcagctgaaactaaaaaatattttaccttttaatttctctgtatcatctactctcctacagctggatcatgatctagaatttataagtttaagatacaaagcagcttttcaaaggaatcatggagcaggacctttgctaaagtaaatatttttttacagtaatttccattaaaattcacattgaacaatatagtagaccagtggttctcagcatgcacaaagaccacctctatggaatttgttaaaagcagattcctgtgactcttcacagaattctgattcagcggaaatcaattcagtaagtccccgaggggatattgtttctgaatgacactgccatagagctttgataattatttaagattagtatacactaagaaaataatacaccatgaccaagtgagatgcattccaggatgcaagtctgctcatatgaggaaatccattattagacattatattgatcaatctagggagaaaaataatataattattttaacagatgctggaaagcttttgacacaattcagtatccactcctgataaaagcaatgaagaaagtaggaaatgatgaatactttcttaacatgctgaaaatatatataatatatgtattatatatttatatgcatatgtgggtataatattttcaatactatttaatattgccttggaagtatcagccaatatagttgtataagagaaatcatataaaaagtaaagtcatcttcacttgcagatactgtgaaaacatacctgaagaatcagtaataaaattatatcaaataataaaaatattaaatataataacaggatataaattaacatatagaaatcaatagcctttatatacacaaaacaataaccacttagagaatataatcacagacaaagcctcatttagaatgacaacaaagaaaataaaagagataaacttaatggttcacgtgcaaaacttttataaagaaaaagttaaaaaactatcaagacacaagagtagacttgaacaaatggaaagattgctcttgttctgggatagaacaattcaccattagaaatatgtcaactcttcccaggttaatttataaatttaatgtgatctcattacattacatgagatcgcattaatgtaatgtaatataaggtaatgtaatggtaaaaatgccaacaagttctcatggagttagataacctgtagtttgtatggaaaaataaacatgcaagaataaattgagaaaaatggaagagaaaagctatgagtcattagccctatcagactttttttttttttttttttgagatggagtctcgctctgtcacccaggctggagtgcagtggcgtgatctcgactcactgcaagctccgcctcccgggttcacgccattctcctgcttcagcctcccaagtagctgggactacaggcgcccaccaccacgccttgctaattttttttttttttgcatttttaatagagacagggtttcaccatgttagccaggatggtctcgacctcctgacctcgtgatccgcccacctcggcctcccaaagtgctgggattacaggcatgagccaccgtgccaggccagccctatcagatattaacacatactataaagtctgtataattaaaacagtgcagatctagcagataaatagacagatacaccagtgaatgggatagaaagtccaaaaagagatgcaaatacataaggaaaatttgtatatgataaaggaaacagctcaaatgataaggacaaggccttttcaataaaaaggtgctagtacagttccatagccacctgaaaaagataaaactccaaattttttttaacaagaataaactccaaatggatcagagataaaaatgtaagcaaatgaaaccagacaagtgttagaagaaagcaagggtgaattcctctatacttcaaatgtaagaaagattttgtaagtatccagaggcaaaaaaaaaaaaaaaaagatttgtaaattggttagattaaaaaaataacaacacgtttgcatgacacaaaacacgacaagcaaaaaacaaaaggcagaagacaaactgggagaaagtattttcagtacatgtcacagataaagaggtgataatcctaacatataaagaactctaaataattgaagggaaaagaaaatcaaaatcttaatagaaaaatgggcaaaacacatgaatagacaattcacacacacaaaagatacatttgaaaagatatccatcttgactcataattataggaatgcaaataaaaatgacgttgagaaaccatttgttatctataagattggcaaaaaataaaaagtacgacaacatattctgttagtgagaatgggttgaagacagactctctcatatattggtgatgaaaatgcaaattcatacaaattttttgaagggtcatttagcaatatctaacaaagctacctatgtgtttacctcctgactcagcaatcccactctagaaatttatgctaaatatataccttcaacaaataagaatatatgtatatatattaatatatacacagttacccattgtatgtagttccgttagaagcatataatggttgttgaagacaatctaattgcccattcataacacagtgattgaataaacgcaaatccacatatggaagactatgcagtgttacgagaaatgaagatctctgtgaattaatagggagtgatttccaggatattctgttaaatggaaaaggcaaggtgaacaagagaatatgcagtatatttttttgtgaaagagatcaggagaaataagaaaatatacaactatctgagcatttttccaagaagaaacacaacaagattaacctagaaactgatgaaattggttaccaataggggatggataagtacagggtgaaaaagatggttggggtagaaactgaaagtatagaggaatggcatttatttaaatatgttttttgtatagttctggctattggaagcatagttcatgcattcaaaaaaataatcaagagagatttaaaaaaaaaacaaaaccctgagagttccccttcctagtcaaagaaaggggtgacagatggcacctggaaaatcgggtcactcccaccctaatactgcgcttttccaacaggcttaaaaaatggcgcaccaggagattatatcccgcacatggcttggaggctcccacgcccacggagtctcgctgattgctagcacagcagtctgagatcaaactgcaaggtggcagcgaggctgggggaggggcgcctgccattgcccaggcttgcttaggtaaacaaagcagccaggaagcttgaactgggtggagcccaccacagctcaaggaggcctgcctgcctctgtaggccccacctctgggggcagggcacagacaaacaaaaagacagcagtaacctctgcagacttaaatgtccctgtctgatagctttgaagagagcagtggttctcccagcacgcagctggagatctgagaacgggcagactgcctcaagtgggtccctgacccctgatccctgagaagctaactgggaggcacccccccgtaggtgcagactgacacctcacacggccgggtactcctctgagacaaaacttccagagaaatgttcagacagcagtattcgcggttcacaaaaatccactgttctgcagccaccgctgctggtacccaggcaaacagggtctggagtggacctctagcaaactccaacagaactgcagctgagagtcctgtctgttagaaggaaaactaacaaacagaaaggacatccacaccaaaaacccatctgtacatcaccatcatcaaagaccaaaagtacataaaaccacaaagatggggaaaaaacagagcagaaaaaccggaaactctaaaaagcagagcgcctctcctcctccaaaggaatgcagctcctcaccagcaacggaacaaagctggacggagaatgactttgacgagttgagagaagaagacttcagacgatcaaactactccgagctacaggaggaaattcaaaccaaaggcaaagaagttgaaaactttgaaaaaaattcagacgaatgtataactggaataaccaatacagagaagtgcttaaaggagctgacggagctgaaagccaaggctcgagaactacatgaagaacgcagaagcctcaagagccgatgcgatcaactggaagaaagggtatcagtgatggaagacaaaatgaatgaaatgaagcgagaagggaagtttagagaaaaaagaataaaaagaaacaaacaaagcctccaagaaatatgggactatgtgaaaagaccaaatctacgtctgattagtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaaggcacataattgtcagattcagcaaagttgaaatgaaggaaaaaatgttaagggcagccagagagaaaggtcgggttacccacaaagggaagcccatcagactaacagcggatctctcagcagaaactctacaagccagaagagagtgggggccaatattcaacattcttaaagaaaagaattttcaacccagaatttcatatccagccaaactaagcttcataagtgaaggaaaaataaaatactttacagacaagcaaatgctgagacattttgtcacctccaggcctgccctaaaagagctcctgaaggaagcactaaacatggataggaacagctggtaccagccactgcaaaatcatgccaatgccaaattataaagaccactgaggctaggaagtaactacatcaactaacgagcaaaataaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggaggcaggaagatctaccaagcaaatggaaaacaaaaaaaaggcaggggttgcaatcctagtctctgataaaacagactgtaaactaacaaagatcaaaagagacaaagaaggccattacataatggtaaagggatcaattcaacaagaagagctaactatcctaaatatatatgcacccaatacaggagcacccagattcataaagcaagtcctgagtgacctgcaaagagacttagactcccacacaataataatgggagactttaacaccccctgtcaacattagacagatcaacgagatagaaagttaacaaggatacccaggaattgaactcagctctgcaccaagcggacctaatagacatctacagaactctccaccccaaatcaacagaatatacattttttttcagcatcacaccacacctattccaaaattgaccacatagttggaagtaaagctctcctcagcaaatgtaaaagataagaaattataacaaactatctctcagaccatagtgcaatcaaagtagaactcaggattaagaaactcactcaaaactgctcaactacatggaaactgaacaacctgctcctgaatgactactgggtacataacgaaatgaaggcagaaataaaaatgttctttgaaaccaatgagaacaaagacacaacataccagaatctctgggacacattcaaagcagtgtgtagagggaaatttatagcactaaatgcccacaagagaaagcaggaaagatccaaaattgataccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaagaaaagagagaagaattaaatagacgcaataaaaaatgataaaggggatatcaccatcgatcccacagaaatacaaactaacatcagagaatactacaaacaccgctacgcaaataaactagaaaatctagaagaaatggataaattcctcaacatatacacccttcgaagactaaaccaggaagaagttgaatctctgaacagaccaataagaggctctgaaattgtggcaataatcaatagtttaccaaccaaaaagagtccaggaccagatggattcacagccgaatactaccagaggtataaggaggaactggtaccattccttctgaaactattccaatcaatagaaaaagagggaatcctccctaactcattttatgaggccagcatcatcctgataccaaagccgggcagagacacaaccaaaaaagagaattttagaacaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacgtgattatctcaatagatgcagaaaaggcctttgacaaaattcaacaactcttcttgctaaaaactctcaataaattaggtattgatgggacatatctcaaaataaaaagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagaaacccaaatcatgagtgaactcccattcacaattgcttcaaagagaataaaatacctaggaatccaacttacaagggacgtgaaggacctcttcaaggagaactacaaaccactgctcaatgaaataaaagaggatacaaagaaatggaagaatattccatgctcatgggtaggaagaatcaatatcatgaaaatggccatactgcacaaggtaatttatagattcaatgccatccccatcaagctaccaatgactttcttcacagaattggaaaaaactactttaaagttcacatggaaccaaaaaagagcccgcattgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctattcaataaatggtgctgggaaaactggctagccatatggagaaagctgaaactggatcccttctttacaccttatacaaaaattaattcaagatggattaaagacttaaacgttagacctaaaaccataaaaaccctagaagaaaacctaggcattaccattcaggacataggtatgggcaaggacttcatgtctaaaacaccaaaagcaatagcaacaaaagccaaaattgacaaattggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggctatcagagaaatgcaaatcaaaaacacaatgagataccatctcacaccacttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcaccattctcagtaaactatcgcaagaacaaaaaaccaaacaccacatattctcactcataggtgggaactgaacaatgagaacacacggacacaggaaggggaacatcacactctggggactgttgtggggtggggggaggggggagggatagccgtgggagatatacctaatgctaaatgacgagttaatgggtgcagcacaccagcatggcacatgtatacatatgtaactaacctgcacattgtgcacatgtaccctaaaacttaaagtataataataatgaaataaaataaaataaaggctgaataattaaaaaaaactctgaaatgtaatataaaccaaagtaaatgaaccaaacctaatgaagttaataacataatccaagcaaatcaagttaacaatgtaatcaaactacttttgattacagacatttgagtgtatacccttaggctaaaggcaaaacactataagcaagtgttaaactctagtaagtagattcatttttcatggtggtatgggccagcaatcccaaacctattttctgtgtattaaaaggttgaggatatacataaatatgctgcggataatgggagccgtgtttctcactgtgaaagaaaggagctataaacataaaaagagggatagctagaaggaatcctatgctgtgggattggaattggagatatccacatgacaagaaagagagagaataggtttgtgtgtgtgtacaaaggcccaaagtagtgatattctagtagcaatgatcacatctagcacccagattttgctttataaataccatttttcgctaaaataacctaggttccttgaagaaatggctgattgcagggctagtgttgggaatatatgagtctgggacaccttgttgtgccagtaaaagaagatgattagcggggacatgtccaaaaatcatcaagccacctttaaaaggccctcattggccaaatctgggcaagctgaactccaagatcttaactcactaaataagagaagcagctgtaagtccatactaatataaatacataaatggggaaaaagggaaaactttccttacagtagaattccaactaattaatttaaaagaaactaataaatatagaaaaaaatgatggaatcacaaagtcagcatttggtaactatcatgataattgattcacagaataattaacgcatgctaaaaccaggaggtcaatggttgataagaagcaggatacttatatacacctaaagtgttttcctacaaaatactattaattatgaagggaaaaatagtggagaattctggcagacaccaccttcactaagtgatcaaagttaatataaccagtaaggttgttcctgctatgttaccgtaagaacacaacctcacttctgtgatactgctccaaaaaagcataagctaaatctaatcatgagaaaataatggacatacccaaattgagggacagtctatagagcaactggcctgtactattcaaaaacatcaagatcatgaaagctctgccaccccccaaaatcaaaatgattgaaagataatttcagattaaaggaaaataaagacatgtgacaatgtcacaaattattgtgagctgaattctagcctaggaaaaagccttttttcctcttttgctatgaagtacattcctaagacaactggcaatatttcaataaggtctataaactggataatagtattatatcaatgttcatttattttgatatttgaactatacttgattaagagaatgtccttgttttctcagaaaccacatacatatttagggggaaattggtatcatggctgcaacttattccaaaatgactcagggtaaaaaaaaaaatccctacatctatatatgaatgtatctttctattgagagagaatgataaagcaaagaaagtaaaattattataacatctgtgaaattaggatgaaggatatatggcagtcctggaagctgttctataaatttgagattatttcaaaattaatttttttaagattaatgatactgactagcttttagcagcttgaaggtttaggacatgtcatattcgtaattttctaaagcacatctatgtgccatgccaaagcaggcctacagagtatcagcaaaacatcaattagtaagacatcctgtcagcccacagtccatacctacttcccactcatccttgactatgcaataactcttacgaagtaattaaatctttatttctttgtgaaaaatggccttgggaagagacctaacagttggttccagtaacatgatctaaaagaaagataatggttcctagccagaaagtagacattttggacaaatgcgagtgtggcctgtcaaatgctatggggacacccatttatgatgtgaataaattcaccatgaactctatacggaaagaagaaaaaacaaatagagaaaatatttcagccagtactttattctgtgaaaaaaactgccttgacatgtaataggtacaaaggttggtgatgttaatttatgttatgaggatatactagagaaacatatgctttttgaagaaaatatgagcaagccaggagcatacataagcattaatgtgaagaaatagatgaacaagtataagaaagagtcccaaattacataatgccatggaggtatctgagaacctggagatttattcagatcccaggacatacctgttgtgaacattggtgtgtgcatcacacaccggggcctgttgcggggatgggaggctaggggagggatagcattaggaaaaatctctaatgtaagtgatgggttgatgggtgcagcaaaccaccatggcatgtgtatacctatgtaacaaaactgcacgttctgcacatgtaccccagaacttaaagtataattaaaaaaagaagagaaattcaatacaatagactcaatatttataaggaaatttcgtgaaaggacatcaagaattgttacaggctttcgttccttgtagcacttagtatatgtacgtatctaatcctgattgaaaacttctggcccttatcttaaattatactaaattggctgctaaaataccaaaattaacaaaaattataaaaacaacaaagaaatgctttaaattaaacattaaatctctgaagactggtatatcagataattatatactaatagctgctggttttcttttcaggaattttaacatattcatagcagcagttttgttattctaaataattaaaacagtagagaactatatttctctatccaattagagattagctagttcatgtatttaaaaccactacatatacaaaaacaaagccaacaatacaaccttgtactttagaaacaggcattatgtaattaatctttgctctctgtctagcatatgaacattttccccactgagatgccttattttgactgttcccaaggtacttggaaatcttttcataaacaggcttagcattgaaattaattcttgtgttaaaaaccaatttgcacccttgaataggcaaaggcaagaaaagggtccagagccaaaggaaatactttataataagctcaggacatttttactgttgagaaactcaataataagctgttttgccctatatcctcacctgcgcatttttacaagccactgccagcgctgaatgattttcccgattttattttatcgatatatcttttataaatttactaattcactatcatcttcattttaggccattagaaaatagagacagagataatactctggcaaatctctgtcctagatacaatgagatgcaacttttggaagtattcattattggtgatgtacatatcttttgtctaaagttgcttacaaaagttttgtaggttgagcagaccatcagtgaaaaattactgaacacacaacaccaatatatgtacatatgcctattttgaaattatatacatgtactaaaaacttgtcactattttaacttgtcaatattttaaatttgtatttaaagtttccaaatcatttaaaaattcttacaatttataaattttatactacaaaattctcgtctttaaagtgtacaaatcagtatgttttataagtagtacattcacaaggccgtacaaccatcaccaccacctaattttaagacatttttatcactcccccaaaaaaaccccacactcattaacagttacaccccattccactctcctctacaccctattattctaccaactggctctatggatttgcctattgaagacattttataaaaatgaaaccagacaatatgtggccttttgtgcctggcttctttcacttagtgtaaggtcttcgaggttcatctgtgatgtagtatatgtcagttcatgcctttttacatctaaataatactccactgtatggatacaccccattttgtttatacattcatcagttaatggacattgggttgtttccactttttggctattctgaataatgctgctataaacattcatgtacagatttttgtgtggacatttgtttttaatatttgggtaaatgttaaggagtagaactgctgggttataggctaactatatttaacttttgcagaaatgccaaactggctttccaaagaagcagtaccatttttcattcccaacagtaatgtgttagggttccactatttacacatccttgccaatactttattattattattattattatggccatcctagtgaatgtgaagctgtgaggttgtattgtgggtttgagttgaatttctagtgactagtgatattgagttttcttttatgtacttatcatccagttgaatatcttctttagaaaaatacctgtttagctgctttgcccattttttattttttgagttatttttatttttattactgaattgtaggaattctttacatattctgtacactagtaccttatacatatgatttgcaaatggttttctctcattctgtggggtgttttcacttccttgataatgttcattggagcacaaaggctttcaagctttcatgtttgatgaaatctaaattatctatttttatatgtttgcttgtgcttttggtgtaaaatccaagaagccattgtcacaatgatttatgcctattattttcttccgggaaatgtatagttttagtttttacatttaggcctttgatccatattgagtgaatttttgtatatggtatgaggtaggggttcaacttcttttttttttttttttttttttttttttttttgcaagtggatatctagtttttctagcaccatttgctgaaaagactattctttctccattgaattgttttggcaccaccttgctgaaatttaattgaccataatcataagaattatttttagattctcgactctattcagttgacctgtaagtctaactttatgtcagtagcacactattattgtgggtttactgcaagttttgaaatcacgtatgtgacacctccaatttgttcttattcaagattgttttggcaatgctaaatgccttgaaatttcacatgaactttcagattagcttgtcaattttttcaaaaaggtagttggggttttggtagggattgtgttgaatgtataggtaaatttggagagtactgccatcttaacaatgctaagtctttcaatccattaacacagagtatttatttatttatatcttccttaatctctttcaaggttttattattttcagcgtaggtatcttccactacctttattaaatttattcctaaatatttaattcttttgatgctattttaaatcgaattgttttcttaatttcattttcagtttactcattgctagagtataaaagtgaattgatttttgtatactcatcttgtatcttgaaacactgctagactaatttattatctgtaatagtatgtgtgaatttcttagaatttcctgcatacaagatcatgtcatctataaaaagaggtagttttactcttcctgttcctttccctttaaaaaatgtatatttttcttgctcaactgttgtggctaaaacctccagtacgatgttgacaaaagtgaactttctcatctcatcactgatcatagaggggaaagctttcagtctttcaccattaagtatgatgtcagcttatatgtgacatctacacataccatttacatggctgaggaagttcctgtgtattccaagtttgttgaggtttttttgttttgttttaattatgaaagtgtttgggattttgccaaataatttttctgtgtcaatgagatgattatgtgtggtttttgtcctttgttctattaacatgatgcattacactgactgattttcagatgttaaaaccaaccatgcattcctgggaaaaatcccatttggtcatgatgtataatcctttttatattgttggattcagtttagtagtatttcactgaggaattctgtggtacattcacaaggaatattgatctgattgatctgtggctttcttttcttttcttttgagacggagtctcactctgtcaccaggctggagtgcagtggtgcaatcttggctcactgcaacctcagcctcccgggttcaagcgattctcgtgcctcagcctcccgagtagctgggactacaggtgcatgccaccacgcccagctaatttttgcatttttagtagagatgggtttcaccatgttggccaggatggtctcgatctcttgacctcgtgatccacctgcctcagcctcccaaagtgctggaattacaggtgtgagccaccatgcctggtccttttcttttcttataatgaccttggtattggtatcaggataatactggactcttagaatgtgttgggaagtatagtaatacattgcttaatgagaatgtgagagaaatgtgtcattgggtgattttgtcattgtttgaacatcataaagtgtaattacacaaacctactacacaaatcatatagtctactacatacccaggctatatggtatagattattgctcctaggctacaaacctgtacagcatgatactatactgaatactgtaggcaagtgtaacttaatggcaagtatttgtgaatctaagcatagaaaaagcatggtaaaaacatggtataagagatcaaaaatgatacacttaaccagctgggcacggtggctcacgcctgtaatcccagcactttgggaggccgaggtgggtggatcacgaggtcaggagatagagaccatcctgactaacacagtgaaaccccatctccactaaaaaaatacaaaaaaaaattagccaggtgcggcgatgggcgcctgcagtcccagctactcgggaggctgaggcaggagaatggcatgaacctgggaggcggagcttgcagtgagccaagattgcgccactgcactccagcctgggcgacagagcgagactccgtctcaaaaaaaaaaaaaaaaaaaaaaagatacacttacatagagcacttaccatgaatgaagttgctctgggtgtgagtggtgaataaatgtgaaggtctaaactattactgtacactactgtggactttataaacactgcgcacttaggctacattaaatttttaaatttatttaaaaataaaataattgtaccatgccatgggtatgactgtgacatcatttggtgataggaatttttcagctccattataatcttacgggaccaccatcatgctgcaatctgttgttgactgaaatgtcattatgcaacacataactgtattcctttctcctatctatttttggggaaaagtatgtgaagaattggtgttaattctattgcggatggtagaactaattagcaaagccactgggccagggcttttctttgtgggaagattattgattgctaaattaatctctttacttgttattgctctatttagaatttcagctctttctagaagcagttttgggagtttgtgtctttaatacaataccattaatcgtatgtatcaatctgactgggccaagaggtgcccagtttaatattgtttctgagtgtgtctgtgaggggttttctggatgagattagcatttgaattcgtggattcactaaagtagattgccctccccaatgttgctgggcatcatctaatccattgagggccagaggagatcaagagacagatggaaaaagaattcatgccttttgattcttgcttttctgcttctgttggaatctcggtctgctcttacccttttactaccattaacaccattggctcctctgattctgaggccttcagacttggatgggaattacatagccagctttcctgggtatccagcttgcagattgtggaaattctcagcctccgtaattacttgagtcaattcctcataataaatcttttcatatatatatatgaaagatagatatataaatatataatatataatatacaattttatatattatttatatatagcacataaaatatatatctatacatatatttataatatataacatataagtaatatataaatatatcatatattatctatatataaatatatcatatattatctatatataaatattttcatataaataaaagatatatatgaatatatattatatagatggatatataaatatacatgtaaattatatatttatatataatttttaatttatattttatatattatataaaattatataaattagatataatatattcatttttaatagataaatattttatttaatacataataaataatatatattcatataatatatattatataaatatatattcatataatatatattatatataatatatattcatataatatatattcatataatatatattatatataatatatattctatataatatatattatatataatatatattcatataatatatattatatataatacctattcatataatatatattatataaatatataaacatatattcatacatatatctttcatatatatgaaaagatttattatgaggaattggctcaggtaattatggaggctgagaagttatatttacataatttctctctctctctctctctctctctctctatatatatatatatatctcctattggttctgtttcttgagggaaccctgactaatacaatgtctttaaaggaatttgtccatctatctgggctaatttgttggcatacaactgttcatagtattctacactccattttatttccgtaaagtcagtagtaatgtcccctcttagtttctgattttggtactttgaatcttctctatttgttacttagtcagtccacctaaagtttgtcaactttgttgatcttttcaaaaagctaacttttggtttcactaattttctctatttttttctattatctcatttatttcccctccaatctctgttatttattttattctgcttgctttaggtttagttttctcttctttttctactttcctaaaatgtaaggttaggttattgatttgagatttcttattttctattaaataatataaatgtttatagttataaatttccctgtaagcattgctatagctgcctctcataagtttggatatgctgttttcattttcattcatctcaaaatattttctactctcctttgaagtatcttctttgattctttggttatttagaagtatattgtataatttccacctatctgtgaattcccaacatttccttttgttatttataatttcattccattgtggtcagagaacatactttatacaattccttaaatgcctgtaccaaatgagtttcttatactttactgaggggctctgtgtatgtgtgtgagggccacaggccttacatgctcaggcatgcagtttataactctgccttaggcttcactttctgcttccacagagcctcaaggtcagccagaggtgagagcttagggccttctcaatcctttcctgagcacgtgcattgccctgggccgttgcacacagccctacacagacccatgacctttcagattcccagggatatgttggaagtttctagtgcccactaggggatctccttcctcagcttatcctcttaagatttttagtcagcttcttgctcactcaactgttactgcctcttcagtcagctgtgatgctaaataaatgttgctgattgtttttgataaataccaggttttttaaaaagtctacttgcactgagcaaggtctgagtcaggtgaaataaatataagtacttagaatgggagtttaaagggaagtgccagacaggtcaaataatgacaatgtgagaactgtgggacatgggagccttaaccctgatctgctccctccaatggctgctaggctgctggttttcaccctgatttgagcagctgttggcttttaagattatcatggagctgagaagagggagatgggtatatggcaagttaaaatgccacaaagcttgctattcttaccaagattcagctgtttttcttgattaaacactccttggattgttacaagcctttagttaatttccccatccaaagaagttgattgtgacaacttttgtcagtatttttgttgcttttatgtaggactatatttttggagatccttcctctgccattcctgctgatgtcctaatttcttacttttaagctaaaaatatacagacttggaaagtctattattttctacccacattccagtacatcatccagtgcaccccatttgggaggctaccagtataaaataaaaacttccttcaaaatactcaattcaggtttatattctatctgaaggtcatatcatgaccttcacatgattaggatgagtccttctgccttttccagacctcctgcagcagctccattctcttggtccattggattgaaactcagaattagctgacacttcccttcctctcctgcttccacatcccctcaagtcatccctcataatcttacccacacatgatcctccttttccattaccagtgcacctttgtctcttgcttgccaccatctctaccctgtttaccaacagtaaatgaatcttcatataaacgtcagtttgatgaatttgctccaggggctcagagggtttccaccaacctcttcttgccttctggataaaacctagccttcttagtgtggctgtccacgttttcacaatctggacccaacttgaactagaagtcatacaacttgggttctgattccagcttagtttgtaatgatacacaaagatatagagcaaagatatagagcacagagatatagagcaatattgagtgcccactatatgctgaacccatagttcagggagctatagataggtaaacccctagttacaatatattgtagccaagaactaggtagaagaatcaattaagaacacatctgaggctgcacatggtggctcacacttgtaatcccagcactttgggaggctgtggcgggtggatcacctgaggtcaggagttctagacaggcctggccaacacggtgaaacctcgtctctactaaaaatacaaaaaaattagttgggcatggtggcgcacacctgtaatcccagctactcgggaggctgaggcaaaagaactgcttgaacccaggaggcggaggttgcagtgagctgggaccacaccattgcactccagcctgggcaacaagaatgaaacccagtctcaaaaaaaaaaaaaaaaaaaaaaaagacgtctgcgaaagtgtctttgaaaagtataaaaaattgtatccagtagataaagaagaacaaacaactataatacctcataaagatgattgttattattaaaacaactatatataaataaaaataaatagaaattacaaagatgctcggtttttattacctatttagtcttggtgtcttcatttgaataatggtttgggcaacttaatgagaataaatactttattacaggtgaacattttgtggggtaccttttataaacagagttctataatcacactgtgaaaacattaatgattactgatacctcaccttcataataaaaaacaatgatatgagaaaaaaagcagttacttacgctctgcttttaactgtccaaggatggaattttctcctctgcacatggttctgaaaatatgtaaaggagaaaataattacagaggtttcaaaacaaccaatcccatgcagtatctgtaggtttaatcctaacacaagtaaaaacagaacaagtgcttctatgagaagatgctacatatatatctaaatgctaaaaacagttacatgaatatcacttttgtaatgctactaatagggacatgatagttgttttgaggtaggtaaatggaaaagttataaaattcgtgttagatttcagaaagagaggctattaaaaaaagaagggtcatgaatgaactttccctcttacaaaactgggtaacagcaaagataaatttagaatgcatcagtagataagaatacttagagaatcacattgctctcagaggtgaaaagggcaagcacttagcagaataatttacaaattaaactattagaatggactgtctttaaattcagcaaaaccactaaaaacgaaaaatatagtctcaaataaaggactctgctaatgattttgtttcttaagactctgataatcactgatgaattataaaatctgacaaaaccaaaaattctatgcttcatctgcttgctctatgagagtaataaagagtatacttatgcctgagaaatgctattattaaagatgatgccagcaaatagagatgtttttgcataataaaaggttatagtttttgtttctgaacaaaagccaaatgtgttatttcattcagctggttcgaaggcaagaaaatagtcatagaaaacaattacaattaacaatattacaaaaataatattagaatggcgaatgaaattgataaaattcaattaaacattatgtcagagccttaaatacttgaaaagctttatcattttataaatcagataatattagaaatgtgcaaatcttcagtccaagtatataggccaaagcacagttaaagctctcttgtactgtaactaggcagaagcaccctggaggaaacaaacaaacaaaaatctttccttgaaatcctggcagataaacagatacaagcttgaaacatcagtaagaaaaaagaggattaaaaaaaaatttccactacaatggtgcactcgaactgtgcacagatcctccagcaggagcatctggcgagggggcccaagcaggagggcatctaagtctccacccccgatttgaccaaggccctgacccctaatctgctttacttaccaaaggttctatgtaaagtatcattcgtcctctcccacctttcagaagggtttgattagaaaggtgagaaactacaggtggttcagaaaaataagagattttggttaagtgaccctgagagaaggtcagaggtgcatttccatccccatctatgcaggctttctagcctgtgctcccccaacccaccagctagcactttccagcccttttcacaatgctccactggccaaatctgaagcctcaagaggaacccaagtgtgcccttttaaataaatataaaaactcagcttttaaaaatatcaagcacaaaactttccctaaaattttaacaaagatgtggtagagaaaacaaaattccgggaatttatttactaacagaggctatcattatcaaccttgttgaaggacttgctacctaaagaatcataaccaaacacaagcaaatcttaccatttcaggcatttaattttttctctatttactgcaaagtacatgtaaagctcaatagctatttacccacttaaagataagttttaatcaacattatacatatatagaaatagacagtaactatacaagaaggactaatattttagttcttttatgtttgccatgtgtcttaggccaatcatttatcattgtaggctccatttgaattttatcaactagcaaacgggccaagatttgaaagtaaaataaagtgttcatttgttccccactccaccgaatggatgtggagaaacactgccattcccttcatcagcttacatgatgcatgaccgaaagctcaaaatagaccatttagagttttggcacctgtagttgaagtgcatgattgcctgtagagcatttcctccgccggttgaaatgtctccttcgaaccctggcagaagtggtatcacgacatatacccggtatttctggttttccctgcaaaggtcagatgcagagaaattcacccaaaaaataaaaggtagtatcaattttagatgacagccaagcagttcacatggtttttgagattgagtgaatggcttcctacaacacgttctgtcacatttcaggacttgggagggtgtgctgttggactggaagacagaagctgtcatccaggctatcgcttcatagcctgaataacaagctaaacttggcagtaaagtagaaattgtacccattgtctctctacagcataatcgcttgtaggacaaaatgcagtgtaagaaatccttgcttggatcccatggaaagaggcgggtaggggaggctataacaaagttttggaaaaagaacttaatagttaacacagtacctagctagagccgtggaaatagtagacattcagttaataattgttgagtaaatcagttctcatagcctagatcgcaggggcaaaaagacacactggacccattacattttccaaaacagaagtcatcattatctacttagaaactctgagttttcagctgtaaaatgttaccctaggccctttaagaattctgagtggccggccgggcgtggtggctcatgtctgtaatcccagcactttgggagtccgtggcaggtggaccacgaggtcaagaaattgagaccatcctggctaacacggtgaaaccccgtctctactaaatatacaaaaaattagccgggcgtggtggcgggcgcctgtagtcccagctactcgggaggctgaggcaggagaatggcgtgaacccgggtggcggagcttgcagtcagcagagatcgcgctactgcactccagcctgggtgacagagcgagactccatctcaaaaaaaaaaaaaaaaaaaaaaagaattctgagtggccagtatgtatatttaagtcccctgcacatacaacacaatatttcatgtcccattctctcaagtgattaatgacaacctttgaaagaaaatgaattctactcaatgatataacaatagaagaagaaagtgtagctttctctctttgacgggcattcagaaaatcagaaatttgaagtatgctccaaataggtaccatttattcagaatcaaaagctattaacgttcttgtctctatttataggatatacagggagaagaaaaagcctcgaaaggaatgtgacatacactgtgatcaatgaatctcgctgggatatccgggaggactatattcacacaaaggtgttgtcattggttaattttcaagtccgatcctacttaaacttctcatttctaaagtgcattttcttctaaacaactaaatttttctttcatgtgaatattatcagtactctttgggggatcagattttattactgatgtctctaaagtcgatgtcagggcaagtggaaagagaagttcagggcagaaatgactaccaacaatgaaatttggaggcctgtgagtttggctgccatgctaagaaacaaggatcttgagtaggttgttgtaatggcatggattattcactagatggcaaacatagtttgagttggaaagaagacattaaaaaatgtaaactgttcaagtttgctgcttggtaagaataaaaggctcacatccctaaatggtgagcaggatagcgaaaaagaacagacaaaaaaaaaaaaaaagaaaagaaaacctaagctattaagctatttccccacagccaacatttaaaagtcaaaaaattaaactggacagttaaaaatggatgtcatttggcctcaactgccttttcagaattcaggattatactgccttacagtataatcctcccatcaccacagcccagtgacaggagactaccaccctttgttcagaggtacaccttcctactaataaagcttggctcatcagccttctgggcctccagtgaatcccacttcttctaggtcaccttattggctatttcctctgccaagccacttggctcttccagtcagagttgttttattcttgcctcggcactcatagcacatggccaggatgtctgttctgcactctttctgctttacacgatagtgatacacacatctgctctctaggctatgtgataagctcctttgaaacacaggatgcctgcccacatatctttctggttttggtagtacccaatcaaagacccttgcacatgctatgcactcggtattatttgctttaggaggatgggatcaggttggaaaaatgtttctggggaagtttctggtagagaagaggttaagctgaacaggaattttttcctttaaattaaattacattttgtttgtaaagtgtatataatatattacatacatttttttctttaaataaaattatattttatgtctttaaattaaattacattttattgtggtaaaatacatgtaatataaaatttgccattttacccttttttttttattttgagatagagtttcgctcttgttgcccaggctggagtgcaatggtgcgatctcggctcactgcaacctccgcctcccaggttcaagcaattctcctgcctcagcctcttgagtagctgggattacaggtgtgcaccaccacgcccaggtaattttgtacttttagtagagacggggtttctccatgttggtcaggctggtctcgaactcctgacctcaggtgatccgcctcggcctcccaaagtgctgggcttacaggagtgagccaccgcgcccagcccccatttttaagtgtacagttcagtggcatcaattacatatacaatgttgtacaactatcataatgatctattcccaaaccttttcaacatcccagacagaaactcggtgactatccagtcataactaccctgtttttccctgcctgcaccccttggaaacctctaatctgcttgtctctatgaatctgctggttctggattttgcatataattagaatcatacaatacttgtcctttatgtctgacttgtttcgcttagcataacatcttcaaggttcacccatgttgtagcatgcgtcagaattccctcctttttaagactgaataatattccatggtatgtacatatcacattcatctgttaatggacacttatgttgtttccaccttttggctattgtgaataatactgctataatactagcatacagtatctgtgagtccctgttttcagttctttggggtttatattcaggaatggaactgctgggtcatgtggtcattctatgtttagcattttgaggaactaccaaacaggttactttcaaatgagtaacatatgctcatagtacaaaatgtaagaggtagatgattatacagtgaaaaaaaatctctctcactccttcatcctgagggcaactcctgttaacagtttcctccatgttcttttagaaatagtgtaagaatttataagaatatatgtattttttccttctacacaaatattagaatactataaacacttttctgaacatgatttttatcatttaacagggtatcttggaaatccttccacataagaacatagttactttttttttttttttgagacccagtctcgctctgtcgcctaggctggagtgccgtggtgcgatctcggctcactgcaagctccacctcccaggttcatgccattctcctgcctcagcttcccgagtagctggcgctacaatcgtctgccaccacgcccggctaattttttgtatttttagcagagacggggtttcaccgtgttagccaggatggtctcgatatcctgacctcgtgatccacccgcctcggcctcccaaagtgctggtattacaggcgtgagccaccgcacctggccagaacatagttactttttaagaacagggaggtaatattctaccatgcatctatactttaatatttaaaccagttctttactgataggcatttaaattgcttctaattttttttctatttcaaagtaactattttgatatttacgctgactaacaaaagtaatttttcacatttgttggaaaaatcttacaagtggtattgctggtctttgacacaaatgtttgtgatgatgtttgtaagagacagttctattttatctttttttttaagcaaaaatgattttacaagggagatctcatatgtatgatattgagaaatgtcctataaaaatattataaaacattcttgcaaattttagtttgtaggaatcagaatattcacattttcttgtttttaggactctcttagctccataacaagccctttgctattttacaatatggtagctcataaatttcctgaatgatgaaaattttaaactgcgttcagcaaactagtggaaactatttagattttcactgctgtagaaaaaagggctctggaatttcaaacgcaaaattgtggttgaatgtaagccaaagcacagaagattccatgggacactgtgtccaatctgcctccttgatccaatccacagaggacaagagttccagctgctgaggaatccaacgtccttcggaaatactgaatcctcacaacatgggggttgtggaaatgatagcattcagcttagggtaagaatctgagcccctagtgtataaaatatttatgatcttaaaagcaatcttgcttttggggctagtgggcactaagccccggataactacccatcatgccagcaatcacttcatccacattagttcaaagcaatttctaccaaacagcattctcaggcttcttgttaaaagtttttcttcaaaattcactaactcttatggcagtgctacgtataatagctaaaaattggaaataaatgtccaataataaaggaatggttaaattatgttgagccagtcaatggaatgatcaccttgtagccactaaaaatgaccgctatgaaggctcagtagcacaatacttctggtactgtgttaaaatggccccaatgcaatgttataagagaataaaaatgtggcaggccaatgctataaaacattaaatcatttttccctttaaatgtgttaacttcccccactctgtgaccggagaaacgaagcaggcattgctcccggggtggcactctcacaagggaagcaggacacaaaaacatcaacttcttttagatttggggaactggagagattctctaagctgaggcaggagtgtagagaaataagagcaagactcagggcaaggaatcagtcctttggcctcaagctgagttcggggaaaaacaggatagaccccactctcttttcaatgtgaggatatgagagccaggaggatctgtgccttgctttcaggtgaactccagagaaatgtggagcatgtcgttcagcagctatgcgatgtggcaggagcagaggagaagtggtagagaggcaggcctgaaaggtgaaggctgacgtccccaagctacgttaagcagatgccagaacaggccggagggagatcaacatcagtgtctggaagcccctttccaaagatccagggccccatagcattaagatcaaggacgggatgtggagggagaggaggcaggagtagaaccctgatgctgaatatagaagggaaataatgagaaatcactgaatttggccacatttatcaggaagtgccaaaactaaaactaaaacccctcctattgtgtggaaatgcgcttgagctagaaattcagatgaactctaggaaaagaaaataaattacaattcaacagaaaatagtagtgtgtgtgtattagccaggcgtggtggcgggcgcctgtagtcccagctactcgggaggctgaggcaggagaatggcgtgaacccgggaggcggagcttggcagtgagccaaaatcgcggcactgcactccagcagcccgggcgacagagcgagaatccgtctcaaaaaaaaaaaaattaattttaaaatttttgtgattgctataaagctgtttgtacctttaaaagcagagtacgaatgtaccatgtagatgggtcacagcagtgatgtacctctactttccttttcttgtttttctctgctgcataagcccctcctccttcacccacagtccctcctcagcatgaaggacagttaggagaagcttgatctgctcacaactgggtctcagggtctggcaagaaggccccgaggaagcttgatatgcttcgctagtgacaagacactttatttttttgagaatttgagatttatagtttgtatttcattactgtaaacttcaagagctgctataaatcgtctcgttgtagattttgcagcagtgaatactgtcagaaataggaagaattgtggttagggcttagggtgtgtgtgtgtgtgtgtgtgtgtgtaaagagaattttatactatggtggtatcaattatgttggaattggatctgtagcttcttggtcgtttgggacataaccccttttattttgtgcttggcaaatcctttaaaaggagaagatccttctgggcttcagtttcctcatctgcacatgaaagaactggctaaaatcatgactagtccactagaaatgctggccctatttagcactgactttacctatcctctatgtgacttcatagattatgaactattatatattgtgcacaaacacacatcagttttctcattggttatcttttgaaaatggcaagctttcaaacataagaatgctgagggattccccagcatgtttgacttagacttcaccctgggcttgatagtctttggcaagcctagccctgagtggcccccaaatgaggttatatagaaccttatactaaactgttcccactatggcccagacggttttcattgtcatttttaagtctccttcttccttcctctcttttccagggcacatgctcaggctcaaaatgagtgctggcccctgccctgtgctaatctttacatttctctatctgctgaggttaccattttatacaatttttagaatagaataaaagcatttacatgacctaaatcaaaaggtctcctgccacgatctgttgtcatctgtgtcccaaggtaacctcttctccagaaatcgtacagagcttgggagttatcccacaagaaaaaatgtgaaaccaatgattggcatacttagataaaatgtgttttggccaggcgcggtggctcatgcctgtaatcccagcactttggcaggccaaggcgggcggaccacgaggtcagcagatcgagaccatcctggataacacagtgaaaccccgtctctactaaaaatacaaaaaaatagccaggcgtggtggcaggcacctgtagtcccagctactcgggaggctgaggcaggagaatggcgtgaacccaggaggtggagtttgcagtgagccaagatcgcgccactgcactccagcctcggcgacagagtgagactccttctcaaaaaaaaaaaaaaaaaaaggtactgcagttgaattttctttaagacaaggcttctgaaacaagcccaacatgtcttttcagtttggtacaaaattataggatatggtaattatggacatagatttttctttaaacccaagaacttttaatctatcaaacattgcttttaaaaaataaaacattcatctgattttttttttctttttgtgacagggtcttgctctgttacccaggctggagtgcagtggtgcaatcatggcgcactgcagccttcacctcccaggctaagagatcctcccacctcagcttcccggatggctgggaccacaggcatgtaccagcacactcagctatttttttttttttttttttttttttttttgtagagactaggtctcactatgttgcacagactggtcttgaactcctgaactcaagtgatcttcctgcctcggcctcccaaagtgctagaatcaaaggcataagccacagtgcccagctcattcaattttttatatttcaaaataaagtatttttcatagatttctgggaggcttaccattcgaaaatttctacatcccttgaaatgggggaagctttgtagcttactggtaaaaagcacaagttgaggtcctacagacatggtttgagtcctactcctatccaaccatagctgtatgacttggctaagttatctaatttcactaggcctcagctgcctcatctgtagaatgggagtaattacacaaccaatcccataaagttgatacaaagactgaatgaggtaacacaggtatagcactgattatgtggaaagactcagaaactatttggtaacatttttattcaattatatcaattgctgatttcaattagaaggcttgcatatcttcaaataacaacaaagtaaatagcatctaaaattaaaacaatactaaactaaacacatattatgcttcagaatacattttgttttactttatattttggggagagtgttatcagatcaataacagggaaatcaaaaattgattcccaggaagagtcagctataggtttctggcagcaaacctctagacagagtgttgtaatcgtgtgcctaaacaagtcacatgatgaacaacagccagtcgtgagaaaccaaaacaaatttttcttatccagaagtagccgtccaataatttaaaatacggaacatttaagcatcttttaaattaaaacatttctttttctagcataaatactaattttgaaacagctgatttgaatatgatgcctctttatccttgcttcaatttacagtgaacaacatatttccagatgatgaatatcatggaaatgctataataagttcttacatgaactggtgctttacagcttacaaactactttcacatatattcatataagctacgtagaacagataatattattcgtggttggtgaagaaacagcgtgtcagaaggacaaactgacgtactcagaaggtcacatacctgtggataacagagctggagagaatccaggtctccagacatctggtcccccaataatttcagatttcccagtgtggtatttcccataccacccacttacaggcaagcagtagctcttctacagttataagaagcatgaggggcactttgggaggccgaggtgggcggatcacttgaggttaggagttcaaagctagcctggccgacatggtgaaaccccgtctccaccaaaaatacaaaaaaattagctgagtgtggtggcgggtgcctgtaatcccagatactcgggaggctgaggcaggagaattgcttgaacccgggagatggaggttgcagtaagccaagatcacaccactgcacttcagcttgggtgacagagcaagactgtctcaaaaaaaaaaaaaaaaaaaagaacatggtaagtttgaacaatgttcaaaattgttgttttaatgtagtttaatagcatatttttaatgcagtttaatattaaaacatagaagcattaagtcaactgactattttcattgtgtgtgtcaactgtttgttgctaacactataaaatgcactttctcacttcctgactttctaccaaagcagaaaaattatgcatgtcaagtttccatgtgcaaagatctgagaatctcctcagaaaccattcattcatggcacacagtgtttaaaaatgtgtctacctggatcagttggtcctatcttttggcttagtcaaacatggcataaaacagtaaattttagactgtggattatgattttttttctctctgatcgccaatcacatttgagctgtcaaagaaaggtttcaagtgggttgggcagctggcttcaactctgagacagttttacttattagagtgaagatttgttttttgttttttttttattctgattcccccggctgttctgaggtcagcatggggtaaacatgagtctgaggctctaggtcatgtcagaacatgaaggctttgcaaaacttatttctataaagaattatggctgttgagaaggaaccagaggaagtgagaggaactgagaaattgcttaggggaattgttgtgaggctggattccaacgctggcagaaaaatacttagaccagtccagggagttggcaatttgaagactcagatttctccagggtaggagggacctggcagagggcctgtattctttggtgaggcctggctgactgcggactgtcatttccctccatctgctttgggctgcattctattctttttcaaatagccaaaattatacttgttgctaagaatgtgactttggcagggaagttctgagtctcagaaaagtagagaccagagaagtctatggagagagaggggtaagtttgggatggcacatcatggcacctaattagtgaaaaggggtcaccccagggtggcaacctgcaaaatatgttgtttctttcattttttatttatttatttttttagagatgaggcctcattctatctcctaagctggagtgtagtggtgagattatagttcactgcagcctcatactctcaggcttaaggaatcctcttgcctcagcctccaagtagctagaactacaggcacaccaaaacatctggataattttttatttttttgtaaagacaggtggtctcaaatttctagcctttagaaatcctcccgcctccgcctcccaaagtgctgggattacaggtgtgagccaccacacctgcccaagataagctttttaattctgcctttaccttgcctaacacaagctcacagaacacaagctcacagatttgaaattaagtgaaaatatattttacagttgcaattaacatagggagattaacaagaatgcagagacgccaggggtgaggggaacataaaatatgttttgagaatgtgtgtgtgtatccactgaaagtctaaatgtgtgacatatgtaccattttgaaaatgtgtctgtcaaaaaaatgagactattgagagatcagagctaaatgacacaggtttatttgaaatttgatgaactaatttcccatttttcacaaagcaaacttgaaattgccagtctttaatgtgctctgtcaaactccaagtgtaagatacaatctgcaacaggtgctactttaccataatttttaaagtcacagatcccttttcctttcaggagcagctcataagatcactaggaaatgttctatcagaaaatatcttgaagtttcttgtagccctaaaatactataattttatttatttatttatttatttatttattttgagacagagtcttggtctgtcacccaggctggagtgcaatggcatgatctcagctcactgcaatctccacctcctgggttcaagcagttctcctaccgcagccacctgaacagctgggactacagtcatgcaccaccaagcccagctaatttttgtactattagtagagacagagtttcaccacactggtcagactggtctcaaactcctgacctcaggtgatccacccgcctcagcctcccaaagtgctgggattacaggcgtgagccaccatgcccagcctaattttattattttagaagtccagatttttaaagacaaattactacagtaaagaaaaatattctttcaggcttccaaacacttaaaaacacatctttggaacagtataaaataccggggccaggccccgatccaggaaattatgatccagtaagcctggaggtgagtcaagctctctgtaatcttgcaaaagtcagtggtgattttgatgtgtagtcacaggtgagatccactgtacacactgcaggatatgatggatgctgtagtgtgctgcctagatcccctcaccatgggatcaagacatccatcccatcagctactgagcatgtaggccacggaatactcacagtgaagtcctccaggtatgaaaagtatggagtcctccataggtgaaagggacttgcctcactcaaggtcatccccactccctagggtcagcctgcatccaatggctggtcaataggggaagggaactacaggcccaacacatttgcctcagcttggggaagccctgaatgggtttttaatcctaaccatcaatgcactagagtcatgtggtgtgaggggaagcattgggttgaaagtccaaagatttaggctcaaagctgttttttgcctattgtggttagtggcctagacaagtcacataacctcttgaatctcagtttttaatcctaaaaatgggaacagcaacaacagcaataataacaacaataacaacaacaaatacatgacctactctcaagtgtagttgtgaagattcagtgagataatgtagttataaactgtgaatcacataaaatgctgatagttactgttataatatgtccttaagtataaaagtccccaaatattatgtgaaaaaagatatcaaagtaccacatgacactggaagtaaaaagtgttttaattcccaaatgcatatgcacttattcttcactgcgtgcattcaatgacttaaagtaatgaaatataatggttttgcttatgtgtttgttctgctacttttaaatggagctgaaatcagccataagaagaaattgtccctggtgccaagacaattcaatgtggaaagaatagtctttttaacaaatggtgctagggcaactctatatccatcaacaaaagaataaaaagttgggcccctaactcaccccatatataaaaagtaacaaaatgagtcaaatatctaaatgtaggagctaacactataaaattcccaggagaaaacaggcataaatcttcatgatcctagatcaggcagtgatttcttagatatcactatctatattccttagataccaaaaggacaagcgatacaaggaaaaaaatagataagttagcttttatcaaaataaaaaaaatttctgtttcaaatgacaccagcaagaaagtaaaaagacaagccatcgaatgggagaaactaggaatcatatatctgatatgagacttgtatctagaatgtataaagaattcttacaactcaaaaataaaaagtcaaataccccagtgaacaaatgggcaagggatttcagtagacatttctccatagataatacacaaatggccaataagcacacacaaagatgctcagtatcattagtcattagagaaattcaaatgaaaatcacaatgaaataccatttcttaaatggtatttcacacctactagaatgactataatcaaagagagagataataataagtattggcaaatacagagaaactggacctctcatatactatgggaatataaaatggcagagccgctttggaagacagtctggcagttcctcaaaatgttaaacatagagttagctataacctgacaattctacccctagagaaatgaaaatatatatctgcacaaaaactagtaaaggatgtttatagcagcattatttataataggcaaaaagtagaaacaacccaaatgtccatcaactaatgaatggataaatacaatgtggtatatccacatcatggaatattatctggcaataaaaagaaatgaaatactgatacatgctataataatagataagcttcaagaacattatgctaagacaaatcagtcataaaagaccccatattgtgtgactccatttatacaaaatgcccagattaggcaaatctatagaaaaagaaaaatcagtggtagccagaggctaaaaatagaaggaatgggtaatgactgctaatggggtttctttctgagtggatgaaaatgttctaaaattgattaggtggtggttgtgcaactctgtgaatacactaaaaatcactgaattgtatagtttaagtggctggattatacagtatgtaaattctatctcagcaaaccaattattaaaaaaaaaatcccatgagctgaataaatatgacatacggtaacaagaatttaaatataacccatagcaaaatattatgtctgttttgcttttttaagcgaacacagctcatagtctgctattaaataaaacaaatcacaaacctcatgtgtgggaaacagactggccaggaagaaatttttgtgccttggaagaattcaaattccctagaaagggcagtcaaaaatctttagcaactgactcagactaaaggcatcaataacctattgctggctgaaccaaatttaagctgctaggaaatgacagtactttaaaaatgggctttgcaaagtcattttagtaataaatacaagaacatctgcagcgagaactctcagccaaaggctgttacctgtgagctttcaggatcctctgggcaatggcatcgcctatcttgttgaacacaactttgtcatcagcacagcttatgaaaaactggttctatgagaaataaacaagacaatcatgttagtctttattttcttagcaatatacgtaagaacaatactgtaatatattttttaaaatgtttcacacagcagatgtgttctgatcactgaaatcacatcaagaaagtcaacgacacagaaaaaaagccgcctcatctcactcagggtctcatctgattccaggtcatatcacctgtaacacttaatcaagtggaaagttacactatattatttcaccatgagaattccttataggtgattttctaaattacattctcagaatacttaggaacactgcaaatttaatcaatggggaaactagtttttttcagattcacatgttgtataaatgcttatgattaaaaattctatattggcaaacattctatctcatgctaagcttgcttttttaacagagtagatggtaaagcctggtctagttttctccaccctttctccattatttcctggtatctgctttcaccttgtcttgtttgtctgggtctcttattatctctgaacttctattttaagtagcctcaactctcttttgtatgttgcatatatataagccagttaataaaataaaaaatgtttttttcctctaagtacttctgctatttatatatctacaaaatagtctttaaaactgttactagaaaacaagttacaacattatcataacaatgcaaaatattttgttgctgcataaaggaatgtgaaaaatttggtgcaaatattactaatgttatgtgttcaaatagaatagattgttataacacatctgtaatttataaggacaattatcacaaagtaatatttgctaatcatctcaaggtaaagagatatatatgtaacaactcgtaattatcatccctttgtggcattatcatttttatgactatataagcttttatacttaagtgcataaatctgtaaaatgcctccagaagacaaacttacaggaagacacggtgcagaaagtcttttgagaatgtgattccccttagggcatcagacaatcaaaatctcattggcaaccaaaccatgtttctttttctgaattcatattataaagaagcttagcatgcctcagcagctgtaaacacagactggctacatgtcatgtcctttacttctccttttttggaagagtcggatgaatgctgactgcttatcttgactagaggagtgtcaaccaggtctatgtcccaactatgtatacctacatggcgttactgacatcatttaatactactgtcacattaaaaagaaaagctgattattttattttttattttttttatttttttgagatggagtctcacttttgtcaccaaggcttgagtgcaatggcatgatctcggctcactgcaaccttcgcctcccaggttcaagtgattctcctgcctcagcctcccaagtagttgggattacaggtgcccgccaccatgcccggctaatttttttgtatttttagtagagacggggtttcaccatgttggccaggctggtctcgagctgctgacctcaggtgatccacccgccttggccccctcaaagtgctgggattacaggcatgagccaccgtgcccggccagaaaagctgatgttaatgctactaaaaagagatgaagcaaaatgattctgggcaatagatgagccagccttcacatctttccatctctatggtataattgtttaaattaataatactaatagcattactaagctccagactttatgcagagttcgctcattttccactaatgtcctatatctattccatgatgccattcaggataccacactgcatttagccagctaatatattatatttaacttaggtttctctagccaggctcatgaaacaaataaagctccaattcttccctgcttgtctctaatgaattgttgctgtgcagagcgggagagggccaggacccaaggggaagaaaaacagggctagaatggttttcctcagttaacccattcccctatctacctttaaaaaattcaatgggaaagaaaagactcaaataaggaaggaaattatgctatgatttattttttccattattgtgactttttattttctcagggtttttcaagttctctgaactatttttatattcactttgaagagtaatttaagttcccaaactaaactcagtgtccccagattttctcatatgctctaaaaattctgggatgaaaaaaagcttcctaatcaatagtagttcacacaggattgaagaaggtggtacctgctcttaatgttctcacatcttccttttccacgttcttttccctgcactctccctactccgccatgcccaaaccagtggcatccagtggtctctattttagcaactcacccctgtgtgtgctctcctgaaatagaacttgcttcacacttaaaccctccaacccaagcgaaaacaaaacttacctatccatgttggggtatttctgtctaatactattacaatgagttgatgatgcattttaacagcaaagatttgtgagactcccaatagaatcttgagttaatgacaatgcagagccagttccaggtatgcttgggaggtcaaaattcaggtgatatgaaccagagcttctccagcacttttcacgcctcaaaatatacttattaatatgaggggtcctaagtttggggaccctgaaatctctgcatgatatttaagggaaggcagtttctcacacgaatttacatgagcaagacttacttcgatatagatatagtgcctgctgttctctatcacatggacgtaagcggcgtggatggactcttcatggtactttataccagcagaccaatcagcagcagagcggagcaactacaaggcagcaatcagaaatgaacaagtattagcaatggagaggacatcagatatattaatacaatgaagtcactcctttttcttccagacgactgaatgattacagtggcttgagtgtcatgtgtgaaccaaaggagagtagtggggtggggaatgctgctaaggaagaggggagaaagggggcaactggtccttggatgtagtccataaggaaggtcctcagctggaaatcacatcctgaatataccctctttcatccaggattattttcattcaaaactggaaaccacaaattgtggtttctacaaagactatttcagaagtacctcttctgatggctgtgagtatggtaaccatttgtattcctttcctatgacagtccctcaattataccagaatccctgttgttctggtgcatttattcagagcacccatctttactcttaaaagggtactggtttggaccatatggtatggccatcctagctctgacttaacaatgtgattattccttttcccctaaatagatattgttcagattaatacattctaaaaggtaggtcatttggcatgtgatcttcattctacctttaatagctgtctgttccatggcacgccactttagtctaaactttctaatggcataataaaggaaattaatcacaggaaagagaactggggctcagagaagcaaagaaacttgcatggtgtcacagaggtactagcatcagcatcacagcttgaacttgctttttgtcattccatatccgaagtttttctactatgccacactgttttgccacttcatcacatgtgtgtggcatgccagtcaatttgggattgatcccatcacctcagattaaacccatcgaagtggagctcctgacttttttctctaaaccatttcccatttcaaataccccactggccaggggcataccatcattctattagtctttggcatgcctcttctccttagcgtctatattcaatctcacatctacttcagtttattctttggaggatttctcagatttgcctctttctcatcgctcacattgcctcgctctacgcagacactcacctgtccaggctgtattactcgagcttcttctcgctcagacacctgaatataggttatatacactgatgcagagcaggactgtctaggttcaaagtctggctcaactatttactggctgttgatcgtgtttcttaacctctttgtgcctcagatttttgttctataaaatggagttctactttatagggtcatagagaggattaagtgaattaccgtgaaatgtgtagcaggaggcctggtatctattaagtggttataagtgttatattaatgagcattagaagatgtgtttgagctgtggcaggtcatgtcagggatgctgcagagcagactgtggctgtgcacagaagaaaggatgagagaacatggaaagaaggtgttctcaacactcagcaaccattggtcatcacttttttccaacattctaactagcattgcagtatgatgttggcatatagtaggtgcttaaacaatagcatgacacacagaagaattagtataaaaataatacttgctatttctggtttgaaatgaatattaaaactgtcccttataaggtcaactgatattgaaaataaaaagaatgctcccatactcattaggaatatacaaagcgatccaatacataatcagttctatgtctgctgtatataaaaggcctggaaaaattcttgttcaaatcaataactttaaaattgcaactatacggccattaaatccaaaactcacacttactaaaaatcgctgactgtgccatcctcagtagtgttatttctttatccaatatgaggtatttattacaaaatatcgccaatcaaagcattaaaaaaattatcagatgaatatgtgcaacaaaatttcaaaatttaattgtcaacatgaatatattaaatatcatagaagagaactcataaggaaaatttagataaatattatccacactggaaaaatatcatgattttacatcatctccaaggagctgcattattattcatcaggtagaaaaaacaaaggttgaagaaatagaagttttaattcttagtccactcaaattaatgtttaattttgttactaaggaacatagcactgaaaatgcaggctactttgagaagattctcatgctatcctgatgtaattctatacaactctggaggcaacgtatacaattgcagattacactggaaagaagggaacctccaggattttttttttttttttgagacggagtcttgttctgttgcccaggctggagtgcagtggcatgatctcagctcactgaaacctctgtctcctgggatcaagtgattctcctgcctcagcgtcccaagtagctgggattacaggtgtgtgccaccatgcccagctatttttttttatttttagtagagacggggttttgccatgttggccaggctggtcttgaactcctgacctcaagtgatccacctgtctcagcctcccaaagtgctgggattacaggcgtgagccaccacgcccggccggaatctccatgatgtttaaatgacttgtccaaggtgtaagagaatttacatataatttaaatatcatggaggttcagtttcctccactgtacaactgagacctctccccatcccctaaagctgctgtgaagaaaaaaatggcataacaaacacaaagtgataataatggtatgtggcacttagtactagatattctatatacagtatgtccacctctgtaaaaagttataggcaaagtttataacccacccttgctggtaacatctgagtttttccctcgaatccaaaaaccttatactttctttcctttctcactctcaaaatttgctctgactcaatgaactcattcacataagattcaataaattcattcacataagatacacatgaggagaattacatcaatgtcagcttgcatatgaagtctaatagattcagagtggcttcctggacagctgggttaagaggcgattcttgaaagcaggtgcactggggaagaattctgagattgatcctcaatggctttcatggaaggggacgcctgaaggtcacatatttgccattttttctgtgaaggataatggtaaatgtttctctatctgtaggcatttaagtatttaaaatattaaagcttcaagccaaaagaagaccattttatggccaggggcggtggctcacacctgtaatcccagcactttcggaggccgaggtgggcagatcaactgaggtcagcagttcaagaccagcctggccaacatggcgaaaccccgtctctattaaaaatacaaaaattagccgggcttggtggtgcatgcctgtaatcccagctactcgggaggctgaggatggcgaatcgcttgaacccaggaggcggaggttgcagtgagccgaaatcatagcattgcactccagcctgggcaccaatagtgaaactgcgtctcaaaagaaaaaaaaaaaagaccattttatatatcagcctgtgggagagcataataagaaaaagcggagggggctccctgatacctgcaaaaccatcaagtatgaggggtttcctacctcctgaggggcttcagcatcatctatcccattgcctgagtccaagccccgtatcctttacttacaataaaaactcattaattaaaaaatgtcatcatttgtggctaaacttgaaacatatctttcaagcaacacatgaagaaaatcacttgggattgttattcatttactactattctaattagttaaaatctccctatcaccacaagaaaaatggaaaatacgaatttccttcttgctctgcctagaccattgaactacaggcagggaaccctgaggttatataaaaatcaacttaactgctttaaatgcttgatggcctaggaagttttatcaacagtcaaataagtcaaacccattgtattcgtctgttctcatgctgctaataaagacctaccagagactggataatttataaaggaaagagttttaatggactcacagttccacatggctggggaggcctcacaatcatggcagaacacaaaggaagagaaaagggacatcttacatggcagcagggaagagggcatgtgcgggggaactgccctttataaaaccatcagatctcatgagacttattcactatcacaagaacagcacgggaaagacctactctcatgattcagttacctcccactgggtccctcccatgacatgtgggggattattacaactcaaggtgagatttgtgtggaaacacagagccaaaccattatcacccattttgattgatttccttttgttttattttttcacctttttccattgccactgagatttccttttgttttaatatttactctcttcattttcttcactgacttcaccaacttgtcttgcatttctgttttaaaccaatgtaactgagataaccctcaaactgttccctcacatgcaaaaatatagcttatcttaccgtcccaaatgtgctgggaatcaaatctaatctatacttttcaaaccacgagtttgaatacataattttaaaatatataaaaaatggcatatttctgattttatggtttaacctcaaagctgtaacttggactagtcattttcttcgtgctacgtcttattttttaacctaaaatatagccttctctttaaccacaatccctaatcaccttccatcctatgggcccaagtcaaatgtatggattaaataacagaaatttctttctgaaggaaaacctttggatctttcttagtatttgtcccaaattcccttcctttctctcatcataatgcttttattccctataaattcagcacatatatgaattcctttttatttccctgagattccaagtcaatcatggaacaaagactatttaggacaaaagcactttttatatgtttcacaagcagaggccaactgtgtagaagctcacaagtggtatgcattggggagagaagggaagcctctgattgtcgggcctttttcttccagactgtactgagaacagcaggcaaggagcatcaagaaattgacctagttcaagaacctgtctcatcttatcaagctctttcttttcatagccacttttctagttgagtgtcagccattcatatcacagtgtgcagttattcacataggatgattcctttcctgaacaaaagagaaaagttaattttgaggctgaaggacagaaagaaaagataattattgaagaataggacttaaggtgaaagaagtcctaggaaacacagtattagttgggtgttcttgggagccagaaagaagcaaaaggagagttagggatggatttggggctgtggcaacagaaggtgatacccaaaggcaaacaggacatgaaactttgctctgctagagccccagcagttacaaccatcctggtcttactggaaacagtatccatagctaattaacctcaggcactgaagccaaactgcttagaagcaagtcatccccaccacttactgtttgtggttttgagatggagtctctgatgcccaggatggagtacaatggcgtgatctctgctcactgtaacttctgcctcccgggttcaagcaattctcctgcctcagcctcctgagtagctgggactacaggcccatgccaccatgctgaactaatttttatatttttagtggagacagggtttcaatacattggccacgctggtttcgaactcctgacgtcaggtgatctgcccaccttggcctcccaaagtgctaggattacaggcatgagccaccgcactagacccccactagttaccgttattttaacctctcaaagtctcagtttcctcatctgtagaaacaggctgcacaggagtttagcttacagactgctgaatgtatatgagataatgcacaaagggttagcacagtgccaagcacacagcaaatgccctgttcatatcagctcttctagccaagacccacagtaacactcacaaacgtgttagtccatgaaggcctggcccatacatggaaaacaactcccatggtaaataacttccatggaaatggacaaggtggattccttttacccccacctgctcactttatttttcacctatctactttattctctcacaccattctgggatacaaaacattttgctgtcctttcagatctaacagatccttgggaatatcctttggacatttattccaagcgtgaaaacaattttttttcagtggtataatttggatgttatttatactttcttgaaaattttctttttttttccttcctctctccctctctcctttttccctttcctcctttctcattctttcttccttcctttctttgttcctccctcccttccttctttccttcttttcccataagtaggactgaagacattattccagtagagttatttccatataggcaggaattctcagcatgactgtccaaggaatggtttctactatgagctttaaaaaggattgttcccatgtgttgaccccatgttgatgctgacacggcattcagcattttctttcagcttaatagacatgtcaaatatcctctgtctttataatatatcttaaatgccattaagaccattctggaactgagtttattctagttccttcaccttctctgtgtagaagcagtttcaggaccatctctcccacttcctcctgctacccatgccttttcctgccatgtcttctctgagtgctcttggcaggcttctgagaaggcccagcactgaggggaaacatccaagattcttttaaaagtacagtggaagctgctgaagtcagctgtcaggtctagataactttttcaggagcagcaattcgtgctggtgggcaggcatccatactgcctgccgtagctcccctctccctggctggctgtgtctccccctctggaattgccagtggcgtgtgaccaatgtttctgtattaaaaaaattaataactaggtgcccttctccagaagaaagaataacttgaattttatctattatttactttattatgtcaaatactctttctccccattccaatagatttatggcataaaaatttctatctagaacaagcttggtgacctacccagagaaatgttaacttctttgttgcaaactttttttgtttttgttttttagacgagttttgctctgttgcctaggctggagtgcagtggtgtaatctcggctcactgcaacctctgcctcctgggttcaagcgattctcctgcctcagcctctcaagtagctgtgattacaggcatgcgccataacgcccagctaatttttgtatttttagtaggacggggttttgccatattggccaggctggtctcgaactcctgacctcaagtaatccacctgccttggcctccgtaagtgctgggattacaggcctgagccactgcgcccagcctgttgcaaacttttgaaacactagcgaaagcttgaaggctgtttttgatggaactcaaactggtatactcttctaaatgctttgcatggattaatttaaccatcaccacaatcctgtgagacagatactgtcatttatgttttttaaatgaatgaaacatactgcagagtgaagtaattttcccgaggttacacagctcatatgtcacagagctgagatgttaacacagtctggctctagaatctatcccttaattgctaccttatatttttcttcacaattaaataagcttgtggcttctaagttacattatgaacagtcaactatgttaaaatcttgttctcactcatatgtggaagcttaaaaagtcaatctcatgcaagtagatagtagaatgatagaaactagaagctgggaagggtttgtgtaggcgggtacagggaatagggtggagataaagagaggatggttaatgggtacaaacatagaaggaataagttctagtattcaatagcagagcaggttgactatagttaacaacagtgtattggtatttcaaaagagctggacgagaggacatgaaatgttccaaacacatagaaataacagaagacttgagatcatgacactccaaataccctgaggcctctttaataaaatcaatgcaaatttacaaatataaagctgagaacaggtctagaaaaggcctgggtggctgagggtcctaaagctaagcaagggcctgaagctgcaaggaacatgagttcctgaagggagcaattcattccctacttacagccttaactccagccagtctgtaggagattttactttaggcactgagatggcaaaaagctaattatagaaatagcaggttttcaggaccagaggaataaaataaattataatcttataatcttggaatttaagagttcatcagtgatgtcctagtttcttaactcttatccttccttttaatttttgtcctatttatcactgccatgtggctaaatgtacctatgatgttttaatttacttagatattttccttttctctcaaagatccatagaaacaagtttaatgatcaaggtaaaaattctgagcaatggcttctatttctatttagtgataagtgtcattctaactactttaaaaattaagaagtgtatctgtggtggccatttgagttttattttgtgagggatcataactatagcaggaggattaaatagaaagtcattaacacctgtactttgaatgatacctcttgtatgaaagacaatgaatgaaaattttccctttaaatgtctgaagggactcagatcagattcataccaaacataagtctttcagatgacaaaactgggctcagggaggggtaatggcatgctgaggccacatgctgctatacaatcttcataccacaccaccttgtgtgcttttatgatttgttagcgtgaaaatgcatgttattatatttagctggatatttccagcagcactgcctagcgacacttttatatacccattttatatatccattatcatgctgcaaaatttatattaccaagaactagatgtactacaggagctacctgagtcctttggtgatctcaattagtgccctggcccatcagtcatgacacagttcctatggttctttggagactttgtgacactaaactatctttaactttttcctctgtcccaaattttcagttagttcctagtcgtgatgtccctttgtctctttcctcaaaaatacctcctatttgttccttctcttcatttctagtttaggacttaattatatgtcagaattactgtaatagcctcttcacttgtccccttgctctcattatctctctagtctaataagttcttcatgtgtataaacatttggtctcaaggtatttgtttggaaagatggaaacagataagaatgcataaaacaagagattctctgtcaaataagcttgggaaatgcgcacatcatattccttcttggtggttttataatacactgtagcataaaaaaggtgctaaggagtcctgtattaaagaattctgcaaaaccttatctgtccatggaaatctttgtggaatagttatcagcatctcacaggtaaattcagtttggaaaactctctcctccattaatcttcattgaacattcctgcatcatgcttcttgcccaatcgaaaaaaaaaaacatccaaagttcactagcacttctaggaccaggtccaaattcactaggacagcactccaggtgtagcccccaccccgcccccgccctggccttatgctgtctaacttcatcagtgcctctctaagagcgaatgggttactgcagtcagtccttttgtcttctgagcaagcaggactattccttagagtggacacccagttctgtccctctggatttccaaactcttacagcatgctggtccttactgtcacaccagcatttactcagagaccataccttgcactgtaactgaattattcatctcagctatctctccccagctaactaagtttccagaggcaaagaactcctttgctgtctgccctctcgacacccaagtgtgctttgatgacttcaccatgcaaacggacaacacttagtaaacatatgttggctgaataaatgaatgaatgagtgagtaagtcttgttaaatatccttggctttgtagattcttgagtccaggccacctgaacatgtgagggattaacatatgagcttatcagatctagtctcatttcttttcttttagtttttatttttattttttttttttgagtcagtctcgctctgttgcccaggctggaatgcaggggtgcaattatggctcactgcagtctccacctcctgggctcaagcaatcctcctgcttcagcctcctaagtggctgggaccgcaagcatgtgccaccatgcctggctaattttttaagaactttttgtagagatggggtctcactatgttgcccaggctggtcttggactcctaggctctcctcctgccttggcctcccaaagtgctgggattccaagcgtgagccaccacacccactctagtgtcatttctcacacaacatcagtgatgcggaaaaagcgaacgaagagaagcattttatagagtctctattgacctcaccaggcagcaggatgagactatgtgagtcagggctttaccaacagtgaagtggaaaatatatgcatatgcaacgctatgctaaaacttccttcattgattacaaaaatacttaattcccagcaatccattttcaacagatacttattaacatcagctaactttgaaaaattgaccaccacgtcaataataatgcaagttcaaatcttaaattcttattttcctaataacaagtttcttattttatattctagcattggtaattttttctcctctacgtagaataaaattaaacaggttcataaaatattcatcaacttacatataaatcatagctatctctatgcctctgagtttaaattagttttctttttagcctgggatgactaatatttgctgccgatatttctctcaagcagcttatctttttttttttgagatggactcttactctgtcacccaggctggactgcagtggtgtagtctcggctcactgcaaactctgcctcctgggtttaagcgattctcctgcctcagcctcccgagtagctaggattacaggcgcacgctaccacgcccagctaatttcttatttttagtagagacagggttggccaggctggtctcgaactcctgacctcaggtgatccacccgcctcggcctcccaaagtgctaggactacaggtgggagccaccacacctggccttttttaaaaaaagttctattatttgatctacagtctgaaatgtcttatttcttatatacacatacctccaattgcacacgatgcaaaataactgatttaggcacttcatttatataatcacattccctaggatccatgtctgcattatataagtccctactgatggtccctactgatgatatgtagcagtagcagactgctggactttacttaaacaattcttctgatgcccatattgatgacttcaaacaaaaggcaatgccaaaggtggcccatcctacttctgtccccacatgatctcaagatatttgagctgtagttggtaaaggaagcagattgggtaacactggaccagactaggatttcaagctccacctctgttgataactagctggccggccctagataggcctcagagccccactaggtctgaattttcttatttgtagtttgagatggttaaactggatgtggtaaactgttgtgactctattaagcaaattccttattccattaaaagggcctctagaagacatttggttaatcaggaactaaaattagactgaactacaactagcttcctagctgctaagtttcagccacattcctggtgcttaggcagtatcaggtccaggtttactgggtatcatgttgctagggtcacttcagaaggaattacaggaatagccttggctgtggccttttctaaggacatgcatttattatatttataagagttttaaaaagagactgaattgaatccatttaacataggaaatataataacaagtattaaaagatccatttagttttgctttagaaaagcagtcattgaaaaatctgaagccaatgtaataggcccttggtccaataacagtaattttactcagtagcattttgtcaaaaagaaaagccagaacttacttacctgtacgttagcatggacagacccaggcacttgatatctcaactcatgggctgttgtttgagactttggaagcagaaaaggataagaaagggaccgatattttgatttcataatctaaaataaagaaaaaggataaaatattcaaatgagaaaaaagattcattctccctactttgtgattataaaagaaattcatgcccaggtgcagtggctcacgcctgtaatcccagcactttgggaggccaagaagcggggatcacttgaggtcaggagttcgagatcagcctggccaacacggtgaaacccccatctctactaaaaatacaaaaattagccaagcatggtggcgggcgcctgtaatcccagctactcgggaggctgaggcaggagaatcacttgaacctcggaggcagaggttgcagtgagtcgagatttcatcattgcactacagcctgggtgacaagagtgaatctccatctcaaaaaaaaaaaaaaaaaaaagaaaaagaaaagaaaagaaattcaggttaatttgaaaaagaaaaagaaaaatgttaatggtggacatttctaagtgaagggctacagattatttgtgtttgttttctacttctcacagtcctgtttttaccttttgtaggggaaatattgttttatatttgtaaagacaggttaaatataatctgtagttacagaactttataattgcaaaaatgagactattgttttataaactaattttttactgattatgttctagatatcttgtcacagcaatatagtgggatatcattatttttaataacttcatagtaaaatggtataaaagaatcatttgtttaataaattcctattagtaaggatttctgttatttctaattttatttgaattattagaagccatatcaaaataaattaccttattggattatggctttagtttgaatacccggaaatagtttttctggatcaaagattgcatactttaaaaaagacttattggtgttgtacaaatttatcctccctggggtagcatgtatgagcacaccacaaaaaccaccccaaacctaactacaggtatcagcagagacttttatctttgccagtatagcaggttaaaagtaacaccccatttgtttattcatccatctcccctaaatttttgttaaaaaatttcaattagaatgtccactaaatttttataatcattatgtgaatgaaaaacaaagttagactctaagtggttgataaaactaaattctttttccaaacgaccaaggggaatcatgactcattatcccttcaagtaaataaagtgaaactttaataacacctgaatatgtactttttttttttttttttgagacagagtctcgctctgttgcctaggctggagtacaatggagtcctctcagctcactgcaaactccgcctcctggattcaagtgattttcctgcctcagcctccagagcagttgagattacaggcacccaccaccatgcccagctaatttttgtattttagtagagacaggttttcaccatgttggtcaggctggtctcgaactcctgacctcaggtgatccaccagcctaggcctcccaaagtgccaggattacagtcgtgggccaccgtgcctggcctgaatgatacgtacttaacttatgaatgttaggtttgaatgttatgtcaagttcttacaagtaatgaggacacaatctggataaaaggaaaatggccccaccttcttaatacttcttggtttgctcagaaccagctctcagaatcctgtaccaatataaacccagtgcaattccagtcccatccaactggatgggactttaaagctcaagccctctcatctaaaccaggctcctatccccctataacagccctgcaaatgactaccgagcccaggctactaaatgcttagtcaacactgtgtccaagatgttaacaaggttaaaatcaggacccacacagcagcacctgtccctaggcactctgaattgtctatggtgtggacattcgggaatgtttccctttttttttgcccagatgcccaggcacccggacatcaatgcagccaacagcagagcagtgacacagttgtggccacaacagtctcttcttgctaccagcctcctctaaacctcttctctagttaggcctgcctctcttcatgtggataaatcatgatagcaacatccaagtacttttgtgaagttccagcgctggatgaagtgacgtgccacatcacgagccgccttcccgtggactgcagaggcaatgtcatgccagggcatccggggcgtggagtacctgtcaatgaaatctgcccgggtgcaccaggcaaggatcagtcattaacttcagtgttggggcaaagtctctctgactccaactatgaaactaaaaggaaacgtgggttagtgcccactaggtatatatttcttggcttgcatagaacaacatttttataatcaagggaaacagatttcacattcagggacatagtctcccaggcacttccccacatatgtttccgtttcacttaggattagataatcactagacatggcaagatgtgagttggtacaaattatctaaggctgtgtatttgatattatattttttattttttatcctgttgaaacaatggcaggcaatgccatctctatctcctcttaaacatataaacccagtgataacctgaaaatatgccattctaacgctggaaatgcaggaaataagcagaatagaagatgatcaaagggagcctaccatttcctgaaaaattactgattattgcccccaaaatatgcctataaaaatctggatttttcagacagttcagctctatttcatgttcttttcttattataactgaaaaaaaagtccttaagcacatgctaatgactaaatctagtctccaaagttttaaaaaattttcaaaaatcaacggaagcaaaacaaaaggcatttagatcatgcacatgtatacttgctgagatgttcaaaggtaaaagacaaaatataaccagcaccccaccattatgatactcaccagcaaaaggtttatcaagttgaacccagtctttgaagacgaaattgcagtagtcctttccatgccagaatctggtttccccatgcagctctcccacacctgtctgtaaactacggatggacccggtatctgtgaatgcagcaagaccccctcagagactgtggttcaggtgagtcccagaaagggaggctcaactctcatttattaaacacctaaaagcttcttaatttcttaagacacaactagggtggcatctgtccattctattacaggctgtgggctaacaaggttttacagtccttacaagtttacttttagtgggcagttagggctacaacaagattcatcattaaacaatgaaatttgaccttctcaggcagttgagtaacttatttccaccacctaccagatcactggaagaactatcacagaattaactgtgaataaagaactcacaaggtggcactatgagagcagtaaagctggtggggggctttcaggggcagagtgggaagggcggggaggggagaggtggagaaacctgagacgcaggggcaataaagacaccatgccacttctttttcctcaaccaacatggtgcacacctgatgcataattcttttgcattaaagcaagaacctcaaatttacagatagcccatgttccagccctggaattaattagctaagtgacactgagcttcagttttttagatcataaatccattatgcgtaaaatgaagaatttggcctagataacagctaaaatctgttgcgctttaacatttatatacttcaaatcatagatggcatttataaaaaatatggtaacaacagatgaaagcttatgatataggtgcaaaagcagcaatctactatagcatttcacaaataactgtgccgagaccattgacttacggctaaatacaaagacaatgaagtaaaaagatgcagaattacaaatcacaaacgcagcacttggcacaaaagaggcatttaacaaatagacactgaatgcaaaaatatgtgttgaatgaataaatggtactgcttgcagtagccagtgagaggactacactggtcctgccaccaacacactgtcccagaactgtctttgtaaaatgcactctttgcttaaaaccctggaaggttcacatactgcctataggaagctcaagtcctaagggcttagtgtgcatagaagactcttcccaaactggtgccaatctatctttctagtccttgtttttccccacccaaccccaggccccatgcaaatcacgtgtttcactgtattataacaggtgtggactgccatgtctccatgcagttggcacattattacttctacctgaaatgctcctttctccctcttggcctgatatcctaatcatccttcaagagccacattagctatcacctgccatctccccataaggaagaggcagtcactagcactgctgtcatcccactaacaactgccccaacacctctgactctgtgacgcaattgtatcaggatgctcccctgcccgcatcaatgcctcaccagtctataaactctttgggagtgggaaccaaatcttctcactgccagtagctccaagcacccaggcaatcaataaatatttgcagaacaaatgtttttatgtaatcaccacacacaatgctaatattctatctcaaactgaatcattaacctttcaaaggctattaaagttttctacagaagaaaaatgatttaaaatgccatagattagcaaaatgaaatcatgttaaaaatagacttctattgacttctcccagtgatttattttcctgctttatgagactgaaaggccaaagtacgggtaggtctgtttgctcatctataggctctttattgtttacatagcactttgttaaaagaagaaaagagggtgagaaaagaaacaaaagggatgaaaaatgagataaacaatatttcaaatttcaaatataaaatacacatatacaatttgctttcatcaactgcaaaactctaagctaaggctttacataaacacatatacactcatttaaaaattatctttcacctaacaaccagttatgataaggaaaataaaggaaattcttagtctcaggaaattatcttggtactaattgaattcaacctgctcataattcaaatttgtttttgtttttagccatggcctaaaaactattccacataaattagggttcctcctcagtacaaatgaactattaaggcaatagagccaaatactagttcctgtgaaaacagtagctcagaattacatgagtgtggtcgagaggacttatggcatcaacaatgctgatccaagggggtctcgttaggctgctatctggctcccaaatgatttcataattgcacctgccttgtcttttggcacagatttgtcaggccaattttctgcatcctcctctgtcagtggctcagattctggctactaaagtttatgagaagggggacttcttgttccttgcctggtgtcctctggtcgtgccacatcctcctccttctattctcatctctcggcttccaggtctccatttttctaccatttctccagcctatccttgttcttctttcctagctcctcctcactaacaaggtttccccctttctcctgtctttttgttttctttttcttcctcttttttttttttttttttttttttttgagactggagtgcagtggcacgatctcggctcactgcaacctctgcctcccagggccaagtgttcaagcaattctcctgcctcagcctcccgagtagctgggattacaggcgcacaccaccatgccctgctaatttttgtatttgatagtagagacagggtttcaccatgttggccaggctcatctcgaactcctgacctcgtgatctgcctgcctcggcctcccaaagtgctgggattacaggcgtgagccaccacacccggcctctcctgtctttttctatacaatttctaaaatgtgcacctgcaaggatggcttctgttttggactccaaatctaaggtcacttccagtgcctcacttgacattgtttacctagttccctccagaactttaaaattatgtctaacactaaaatcatcatcattccataaaatcaagtctttccttgagatttctgctgtctgtgtgtagtaactcaagctcaaacctcggaatcacctttggctcctttattcttcgctgacttctccacccacctccccacggcttcccagatcatgatgaaaatctgctgattctgcttttggaaaaagtttctcccatttacttcgttcttgaactcactgacacaaccttgtcagactccctgtgtctctactataaacgctataaagcctcacccttaattgctccctgcccctagggattttccaacatttaatggaagaggtgcaatgtctcagtctgattttcaaagtcctccgtaaactgctacagatatatcccaccagctcaatctgcacaaatcagcccttaaccacaattccaaaactccaaaagttctaacaattcaaatgttttttcatagctgattttcacagctcatttcataactcacaggtcagcaaaatctgacctgaactgacaagaggttatttattatctttattgatcccacttggtgttgcacaaacataaatggtttgcctacattccaggtatttcctggatcctgctgggagtgtaatatagtagagggtataggtattgtattacctttctaaaatccagaactttctgatttctgaaatctgattccaaggattttgtatgagagattatagacctatatgtatttaccacattctacactcagtctgagatgccgaaataaatacttttgcatttcctatatctgggtcttaagatgtagtatctacctaaaatgcctgtttttctacctttttagtctctacctaccgaatttctacatatgttcaaggccagttccaatacaggcactgaacaagttatattttaaaaaatattttggttttcaaaattttttggaatttagaatcgtggttaagggtttgtagacctgtatttcgtctgtggatcaatgatgactcttgcagtaggagtatcttccctcaatgaattactaaaatattaggtttgtaaaatatttaaaactcatgctcacctattagataacaagctatttaacagcactagatgaatcttacacatcctatccattgcattcctaagaacagtttagaaacagcttaatattatcccttgtgacgagacattcaaatttgaaaagcctgtctcaactaaattgcaaaaataatttttccctcacttacctatttaatattgcttaaaaggaaaagatcagcacatagttgctgaatagcattaggagaaacacttaatgtagatgacaggttgatgggtgcagcaaaccactgtggcacttgtatacctatgtaacaaacctgcatgttctgcacgtgtatcccagaacttaaagtataatacagaaagaaaaagaaagaaagaaagaaagaaagaaagaaagaaagaaagaaagaaagaaagaaagaaaaagaaagaaagaaagaaagaaagggaataaaattcaacactttaaaaatagtatcaagcaaaattctccctcttagaacataattctgaatgaaaaaaaatcttgaaaatgactgagtgattttgaaaaacatatatttcagatatgattcctaaccacgtttttagtgcagtttttctatataaaaacccatagtgatgttcactccacactgatttctgtatgacaccaggaggtttaattcaacaaggagcccaattcaacatggtcatatgcggtcaagtgaaattgatattgcagagaggctaactctctttgcattctcaggaaaaggaagtcattaactcaagttcatattcagttttaaatttctaacgaagagtcactccatgcttaatttgggtttcaagttttataaggcaacctgagtttttaaggtattacatgatttaaatctagagccttgctctttaaacttccttcatttttttagtagaacttttcttttttgaaaacaagttcagaaggaactccaataattaaaacagatacaagtgggattgttctggttgaagaggtaccaatagctgtgggagggtcctggggttcacctacttcaatgttctcctcaaagccttttaaaaactccaggatccaaggaatcgactttggaaagcactgctctagaaggaccccatgatcctttggcttttctttttaggtaaactgttttcattttaaaaaattaaatttgtatttatatttgactataaaagtaaaatgaaaacagtaccaacaatgtgggaaaaaaataaatcacctcacgctccatcttcctaacaaagatagcatcattgaatgtcctttgtcagctgccttcacgaacatattttgatacagtggcaattgtcctcaaattttccttgctcttcccatagccacctcatttcagttcatggaaattccatctttccagtggggccaaagatttggagtcctctccatctctcacatcttgtatctagttcatcggcaaatgctgtcagctcgaccctcaaaatatattcacaacctgcagagtcaccatttgccaccctggtctgctctgaagaatgatccttggaaaatgtaagtcagccctcgcctacccttcgctcaagaccatccgatgacttcctatctcactcagggtcaaaatcttacagtggtctgcaagacctcacataacccaccccagcccacctctctgattttgttcttatcatcctctcctagcccacttcactacagccgtattcctggaacacacccaacccctctacctcatggcctttcatacttgctattccttctgtcggaaacaccctctctcagtttcttatcctcattcttctctttctttcgatgtcagctgaaaactaacctcatgagagatgtattctccgatgagcctttacaaaatagtaactcttctcctatgctcttcctcccggatcatgctcaactattctccgtgataattatcaccacctgaaatgtgtttgactctctatttgtatacacagttcccatccttaccctccaactagttaattgcacttcatctgttttattcaccacatctctagcacccagaatagtgattggcatataacagaaactcaataaacacttatttaattaaataaataaatcttctatgtttatttttgtatccccaactacagttgtaatcattgcccaattccataaaagagatgaaccatttgttaccattcattatgttcttcaccatttccctactctttgacgtttaggttgttctctctctctatctctctctctgtctctcaacaatgctacactagacatatattcagtttatcagtgaggggttgtaaacagatgtcaagggtacttttcatcagcaacaccatacacatgtatgatcagtgtctcagatcaccactgtggatatcacctctgtcaacctggggtaggcgtgagttacttactggactcagcacctcactcacatcttttccacttgctgtcaatcctattgccagcaacactatcagtcataattcagatccataatcttcatgggttggcaacctcctttcctccacttcatttttaacttcagtaataaagcagcaaagttacacattgaaacgataaggcactacctggagctgtttccaaccctttacctctaatatcggccactgcatgcactcttgacctggcttcctagatttcccagaggcctcctacttcccaggactttgaagctttgtcatgcacaggaattactgggagttgtccctgaatccacacatacacccagtactaggtgtatgctaaataaatatatgtctccccatatttgttcttctccatttttatttttcaaaaatttaaaaattgtttttgtgtgtgtgagagagggtctccctctgtcacccaggctggactgcagtggcatgatctcagctcactgcaacctctgccttccaggctccagcaattctcccacctcagctgccagaaaagctgggacaacagatgcatgccaccacactcagctaatttttgtagagagggggtttcactgcgttgccgaagatggtcttgaattcctgggctcaagcaatcctcctgcttcagcctcccaaattgctgggattacaggtgtgagtcactgcacctggcctcttctccattcttaaatatatatcgatgctgttatgatttatagacacaaatttatttaacagttacactgaagttttagttcattgtgtgtagttgattattgcattttttaaaatgcagcgtagctggaccaagcttgtccaacccacagcctgtgggccacatgcggcccgggatggctttgaatgtggcccaacacgaattcacaaactttcttaaacattgtaatttttttttgcaactttttttagctcatcagctatcattagtgttagtatattttatgtgtggcccaagacaattcttcttccaatgtggtccacggaagccaaaagattggacacccctgccctagatgaaagaatgctgggaatcattactcaaagtctagcataatttttcaggttcattagcacctgcaagccacaggtgactcacattcaggcatgtgagctagactgtaactctcatctgctaaacaggacatgagagccctggccttaggttctagccaaaaaagcataacatagtaatctttatttctgctaaatcacaggtcttaattatgggcactgggaggatgataaattggaactccattgggcaggtcatgtatcatctctaaccctgagtttcttcatctgtaaaaaggagatgacaatatcactaccaagcactgcaactactcagggcagtgatggatagagtctgtgcaaaataaatgttagcttatgatcttactagtgtcatttattatgatgattacttatccccatatctgaccagcggccaaatccttctttattcccaccacaagttaaacttattagtcattcattaattcctcgagtatctggagtatcttcttaccaaaggctatcagattgtaatttctgaaaattcacacagcatgacacatccacccaaaggccttcaagatttttaactggccaggagcggtggctcacacctgtaatcccagcactttcggaggccaaggcagacggatcacttgaggtcaggggttcaacacaagcctggccaacatggcaaaaccccatttctactaaaagtacaaaaattagccaggcacggtcatgcacgcctataatcccagctactcaggaggctgagctgaggcaggagaatcgctaaaacctgggaggcggagggtgcagtgagccaagacggccctactgcactgcagcctgggtgacagagcaagactctatctcaaaaaaaaaaaaaaaaaaagatttttaaccaaataaaattccagctcccaaatgtgaatgtcatatatcttcttagtcttatatcaaaaactgcattttagctaaataatgcattttacacaatttgaaagcagttggtgctttcccattccagcacctttgctcaactcacctccctcacttgcaatgacttcctatcacctaccccaattaaattacttccaggcctaacccaaatgtcccctcctcaaaaagtctttctgcatcatcagagaggaattcctccctccttccatagaacttccatgacactattgaattgcatgtgccatgcattttctcttattaggtctgttttgtctttgctgctataagttcttagggagtagggatcttggatactacagaatgctttgcacagagcaggctctcaataatatacgtagcataaaaattgcaaacagaaagccaatctggaaacacattcactatgcccatgcagcagacaacacaaccaaagctcaagcctaagggagttctgccacttcacaaattacttaccagcatgaggtctagtgagtccttgctcagactcactggacgggtgaaagagtttgaagtggggttttaaaccatggattaaattgtgatgacttctatagtgattaaaataacctagagaaattaagaatttttttacaaaaaaatacaaatatcaaattttctaaactggaaagcaaagctgatcatttttaaaaccaggcagggctataacatcagtcttaagattctgtgcaacagaaaattgtagggctttaagatggatttcaaaggaatagtaaatttacaagatgtagaaagtctgatgtttgacgaaataagcttgatatatttctggataggaagataaatgtaatttcttctaagaaaagtttataaagtacatctaatacctttttcttttatggcttggcatattttagaaaccctttgtcattctgctaccattagaagtggtaatcgtggtcgttatgacttttgtgtggataaaacaataaatctgttctaaaatgaggcaaacaaagccaccaaatggcatgaggttgaatagaatgatatagcgacctctcaacattgctcattctactccattacagaaagacagattttaaaaacaggtatgtagtgtctggctatggaagaacagtgggtagttaagataaattctagtcaaggccatgacttactggaggtgctgtcaatgctgctgatgctatctgcgtcgtgcaggtggtgcctgtggagctgcttgtagagactaaatttggagaactttcttggctttcctattcctttcagttttgaatccacatcatcaatactcttctggatgggtaggttttgaacaggctcatttttatctttgagtcttaaggattccatagactccattgcggcaggctgagaaaaatttttttttaaaaaaagacactgcataagacatgctgcagtgtggttctttaattcaagtagagctgaagtataaagtttacaaatgatggaggttctataacagacatgcaataatgtctgaggtcagccacagggtagtggtggattcttgtgaactgtttaaaaactaccaaaggaatatgaggagttctgctatggtcttttttcagtaggccaaattcttgaaatttcactccaattaaacttttaatctcaaatacaattacatgggttacattcagtgttgagctcctgaacttgttcctctaataaacattaagtaagcaaggcttcctctgtcaatcattttccctgttccttatgcactaaattgctatttttgcataagttttgcactattttccagcagtaaataagatgaagcccatcaaattttttaataagtgtattcatattctggcagccatttagttgaaatagcaagcagattgatatacactttttttaataagtgtattcatattctggcagccatttagttgaaatagcaagcagattgatatacacatacagatattttggcagctctatttaaaaggcactttgggaagttattcacttctggctcaaattccctctaaatgaccccagactgacctatcctgtttttgtatatctttaagtaggaactttccaaaaactgtggcagatacttaaggctttttactacctaaatctcaattgccacatatttttgtttatgaatcttatttctgaataaaaaataaatcttaattaaaatggaaaacaaagctgaatatgggacagccaaaattccactgaatctgttttcttttcttacaagagaagaacagactcagcaatgctaagttacagctagctaggtggggaagctggtgtttgaaaccaggtctgtctcatgattgacttaaaatgttcttttcccctccaaggagacaccatctcttattcaatgaatcaatcagtcatgctactaatacaaacttatacaaattatgttcgtgttatacatttccataaaggttaaatatacttactgggagggaacccagagacggtcctgaagtgacccgcttcacactgcccacgtctgtgagtctgtgctcattgtcgtcccaccttccataggccaggtcaatccctcccacaaaggccaccgattggtcaatgatgacaagcttctcatggtgagcccacaaatagacggtggatgacacatgatccgggtgtctcatcaccttgagagggaataatccccactgataatatgcttttgaaatgtccttcctgtcataatgaaataggtctgtgttctccctgaaaagcattttctataattcaaataccaaactgtacaacgtatacaccaaagaaaataattttattctcagcatttagcaaaaagaaaaagaaaaaaaaaagactcctatttactcttcaagctcccacgcccatatactatattttggggcagccgccatttagcttgaggtctggcaatacattagaaaacagtcagctcaatttgaaagctggttcccttccccctgtaaggattatgttaaatctggtactaaaaaaaaagctaaaaatatttaactactatttatctctggaaaaatgtgtaatgaattatattgatattttatcagtcattgaattgaaatattaagcatatgaatataggcatatagatattttggcagctctttatttaaaaggtaccttgagaagttagtaacctcttgctttcaaaattatcccagtctgacctatcttattttcatttacctttaggtaaaaagattacaaaagctttggcaactactttcctcttttccttccttccctccttccttccttccttccttcctttctttctttctcagagactcactctcactgaggctggagtgtagacacgtgatcatagctcactgcagccttgaattcctgagctcaaacgatccttctgcctcagcctcctgagtagctgggactataggcgtgtaccaccatgcctggctaatctttttgttttttgtagatatgggtgtcttgctatgttgctaatgctggttttgaactcctggcttccagccaccctcccacttcagcttcccaaagcgctgggactacatgcatgagccaccatacctggccttactgttttcttaataacacattttttaaaaattgtagtaaagtaagcataacataaaatttaccatcttaaccatttttaagtgtacaattcagtggtatcagggtaatgagttagagagtcttctcttctcctcaatttttgaaaaagattgagaaagattggtggtaattcctcattaaatgtttggtagaattcaccaggtccctggcttttcatctgggggagatttttaattactgatcaatctccttaccagttaaaggtctatttaggttttctatttcttcatgatttagtcttggtagttttcttatttctaggaacttgtacatttcctctaggttatcgaattgcttacagtaatatcttagaatcatttttatttctgtagaattggtagtaatgtctctactttcatttctgattttagtaacttgagtctttttttttcttagcccaccaagctaaaggtttgttgattttatcttttcaaaaaaccaacttggtttcattgattttctgtattatttttctatcctctggttttatttcccactgctccaatctttatttccttccttctggtagttttaggttgagtttgttcttctttttctagttcctcaaactgtaaagttaggttgttattttgagatctttcttcttcttgcaagtatagctgtaaatttccccctttgcactgctttctctgtgtcccataattttggtatgttgtttcattttcatttgtctctaagtattttctctttcccttgtgaatttttgttttatcattgcttgtttaacagtgtgttatttaatttccacaaatttgtgaactttctagttgtccttctgttattaatttctaacattatcttgtggtcagacagatgtttgtatatctaccttttaaaatctattaggacttacttagcagcctaacagatggtcctggaaaatgccccaagtgcacttgagaagaatgtgtatcctgctgttgttgggtagaatgttctgtatgcccattggatccagttggtttactgtacgttcaagtcctctgttttcttacttatcttctgtctggttgctctaaccattactgagagtgagatgttgaagtctccaactattatcatagactgtctttttctcctttcaatcatatatttcgattatctgttattaggtacataaatatgtataatttttatatcttgctgtattgaaccttttattaatatataatgtccttctttgtctcttgtaagcatgttttgatttaaagtctattttgtctgatactagtttagccactcttgctcttttttggttactatttgtgtgaaataccctttccatcctttcattttcaacctatttgtgtctttgcagctagagtgagtctcttgtagataccatatagttggatcatggtttcttaaaatccagtctaccaatctctgttttttgattagaggggtcaatacatttacatttaaagtaattatttgtaagatacttctgtaattttgctactattttctactacatgtcttatagcttttttgtctctcatttcctgcattactgtcttgttttgtttggttgattttttgtagtgacatgtttaaattcctttctcatttctttttgttaaatagctatatatttgattgctattttctttgcagttaaatgtaacatcttaaagttgtaacattctaatttgtatttataccagtttaacttcagtaacatacaaatctctgctcctttaacagctcttccctcacagttgttggtgttgcaaaattacatctttagtgggtacttgatagaaatttggtgaatgaataaataatatatataaattacgcaacctaataaatcattctttgggagaaaacactttcattttttctaaccaagtgaaacatacaattgttacatattttaagcctgctggaggtttgttaattcattatgtcttgatgtacctcaatgactgggttatatttattgataggttttagatattggcaaaatatcaaagaactttttcaaattgcttttcatgtttatttactttattagtattttatactaggtgccattgattttttaaggcattttaaatcctagaggagatctctttgctgctatcagtgatcaggggatgtcacagggagatcacatctaagaggttccaggataatgagaagtgtgagaacttgatagagctcgtgaatatcaaaacaactgcaggaaacatgttcttgtctaaactctcactttcaattatcagagtcagagaagcagaaatgtgagatctgcttacccccatcaatgtagggaagataagaaagtacagtattttgctttatttctgaggacacaatgctatttgatcaaatatacatttgggcattctatagattattactgcccagaacaaaacatacctgaaaaaatcctatagaataataaagaaacattggttatcaagatgaacctgaatacctttatgttgggatgtagacgcatcaaagtcctcttggtgtattcactattgatgccaagagcgagttccacctctttgtagagcattatgaagatcctcactccttgttgctgtcacaggagaaaaccgatggaggaatgagtatctctggagggaagttacaattcattttctttttcctttgcactgtactttctttcttttttttttcagagtctcactctgtcacccagcctggagtgcagtggcgcaatctcggctcactgcaacctccacctctcgggttcaagcaattctcatgcctcagcctcctgagtagctgggattacagtcgcatgccaccacgcccagttaatttttgtatttctagtagagacaggatttcgccatgttggccaggctggtctcaaattcctgacctcaagtgatccacccgcctcagccgctcaaagtgctgggattacaggcatgagccactgcacctggcctgcactgtactttctaacttcttttataaacaagtaagataaaattttaatgaaaaaggcaatacaaggaagtgacacataagtgcgtatattgagacacaaatattaaaaataaaaatctatctcccttccattcttacaactggtcatatcaagaaagaatcaataactgattaaagatccaaaacattgaaaactttagtataaaatggacacccaaattcaattgattcatccttccttagaccttggatctaaaagaaaatagacaaggtcaccgtggcctatttaatcgagtcaaattaaatcaaaagtgccttgtagatgctaacatgctatacaaataatacaattatttaacaatattaataatcaaaaagacaatgtccaatccttttgtagttcatgagcatgatgattgtgtgttcacacacaagcgtgagatgtgccacactcgaaccttcttacgacgtctgcacattacccatctcatctgaaaaaaagatttaaacaaaaaccaaaagaccaggtccaatagctaatagtatagaaaaacactggtattttccattctagttctggttggtgacaggctttcaggctaggctaaactgccccttactggaatgctcctctccttctgcttgcccactcatggatccccctccaatgtatagttcagaatgtattacctccaggaaactgtggcttattcacccccaccttgtggattgctttttttactttttaggcttgaatcctccttatttttgtatagtttgcaccattttaatttgcattgtttgcacccagcagctctgaaagcattctgaaacattttgcatatatactggattatgtatctaaatgacacctggcatttaatatcgtagagattaaaggtaaaaattttccataatactttctagaatattacagatgcaggtgtatttaataaaccataataaaaaataattttgttacagtttatattaagattccatggtgattagtcattgtttataagggaaatttgaataaaaatctttaagatatcttactgggttgaacacacctactttacaagaactaaaactttttgtaatgctatacgatctaacataacataggagttaatgtttttagattctagatcacatcacaagatacaaaatcttagagcaaaccaaacacataaacatttctgtaatattgttctgccaatactaaaaagcacgttttggaccctaaattccttataataacacaacacttcaaaatactaacactctatttttcatggtgttagtaatatcttaaaggtgtatgtatttctggaggtgcacactagatttacattctggtgtgcattaacaagatttgagtactaggagaagactcattcttgctctaaaaaaagcaggatcaagaagaatatatatgtcatactatttctctggttaacagctggcttttagtacttgctaattatttattataattatgcaagtactattacaatcaagaatataaatacatatttcagtaaagaagtaaaagcataggcagaaagtgaacagattaattttaatggtctggccagagagtgctctgtaattaaccactgatgaagggctctaaaggaaaattacaatattattttatttttctcctctactgttcagttctatttttggtatttgaatattttagaattcagcactgaataatggttacaaaaaaaaaaaagcctttcactaaaagatataatacaaagggtaaaacccaaaatttcaacctaaatagtagaacattacacctgacattcttcatcatgacccatttattttaagcagatgaaattctgcttcttaggcttaagacattattactcatgaagagtagtagttgcaaattaggaacttggcctgaatcctacagttttctactcacctgcataactaatggatttttgaaataatagagatattaacactaatggaatacattactactctccatttattaatacctgacatttcttctatactgtcttttctcattgaaataattctaaaggaaatagggtagagactttgtctttttagcttaaagacaaatgaccaatgaggaagcaattaaagatagaaagttcatttgtatgtggtttataattatttacctacacctatagccacaataaacagttaattagtgacaagattcctgtgataataaagcaatgcattcttcttcttttggtcaaggtattgactattataaactctagccataaagggcaaaggcgaatgaatcattccttggggatgaaggcattttccaggttgttatagtgtaggcttatacaaaatgtgggaaatatttctgcaaaatgaaagccaaaggaaaaaaaaacctgatgatgttaattctgcaatttaaaaaatacactttcaaaacatcccatgctttagtgcctagtgcctttaaatacccttggggaaattactttttgcttaaagaaagggacggaaattattaataggagaagtagaaaaacagatggcctggagttgcctatgcaatgcagtgtttcttatctctggtgaactcagctgacccaaagtttccatagaataaatttcataaaacatgacttttaaaagatgaaagttctgtcctcttttctaattagttttttgtcaagtagagcagacataacactataaacagtagaaatctttaggagctttagatattcaaactacatgggaagacaatgaaaagaaaatttttatagtggaaatcagtgactttgtttcttagccaacttttcctccgattgctcaagggagcatagtgaaaatattttctaaatgcagccaagtttgtccactgcctgaagacagtttagcccaccccacccccccaacccaggatgctcactaatgtttttgtcacttgccaaggacttccccaatacaatatattaagaaaatgtaaagatgtaaagtaaaggatataaagaaatcacttcctcaccgtttaaaagcaggcagcattgggatataagagcacaaaagctcatgtgcctttttttaaaatccaattttgtttgaagcacatttttgaagctgaagataccttccctgcaagccactgttgcccaccactttgataagactcatttgattttctgtgtagagatgtgattattcctgtcatttctcagttctggacaactttcccttttattggtcactgactgcaactctacattgtgccttgtgatccaggacagaaaatcaacctgaagacaaattctcccattagtctaagtttcataggaaatatcacaagcttctaaggttgagatacacaaaattgcgtgtggggatttggctgccataagtatgatgcagcttatctcacctcttagcatagcaagtgcagaactgtggaaagccctgagatgctgatttctttgagttgtgaacagtctgcctctgaagattggcttttattattttaaatgatggcattgcagatcagaaggccaaagaaataggagaagttcaacttggttattaatcagatacataaaatattctattttttcttaagaaacagccatcataagagatgtttgccatacgttggctataaggcagagacagttcctaaattcctctcagaatatctgcacaatcagatagaagaaaataaaacattcattttaataaaccttgtggacctctgggacctgttaatgcaaaaaacaaatattatgtttcaacctcatactttgcaaagctagtgtgtggctttcagaaactaaattatttatgtgaagccatatttatgtgcatataaaatgtcaatttggagtgatccgagtgttaaaaaatttatgaacaaagtaataatatggtggaatgagattaaggaagagcaactccgctaaatgtaccaccaagaaatcaatctttaattgtattactatttctttaggaaattttaaatatcgctacccacagtttaaaaattaccagctccaagaagtggatgaaatggaaatgaagcactgttatcaggcaataacgtttatttggccatggtgttcacgagggacctcgccagggttcaagggccaaaaaagtaaagagaagtcacactagacacagaaaaggtaaccagacaggtatgccaagggcagtaaacaagcgcatgccagcaaacaagaggtggaagccaggcctgcaggatcttcctcctgagccctaccgaggcatttactagctttctcaagttaacttagatgtcttgtagacactgtatcttcaagtgatctaaactttagctttctgaatcagctcttcccagtttcttccactatcagagtcaccttccggacacctttttttttttttttttttttttttgaaacagagtcttgctctgttgcccaggctggagtgcagtggcacaatctcgactcactgcaagctccgcctcccgggttcacgccattctcctgcctcagcctcccgggtagctgggactataggcgcccgccaccatgcccggctaattgttttgtatttttagtagagacggggtccgacacattattttgatcagaccacccctgcttccccacaccgccctgccccgcacagtactgccccactgtctcccataaagtcaaaccactagcttggctcacaaagcctctgcatcccagctgcaactagcagttccagcttaatcccccatccggctatgctaacactcagatgtgatgaaccaccctaccgtgcctgacaaagtctttggcactgctgtttacatctactacacctagaaagttcttctttcccttttaaaaatgtttgtccatcctaaatgccccacatccttcatgttgtgtggagctccccaactggaccttttccattgggaaagcccaatgctttccctcttgccattaaatcggggcattgtttctgcatgcaactgacacttctgcagattttataagctccttcaacttaagaatcatggcttttatttatgtacatcctcatatgattagccaaatgccctgcacatagaaaacattcaataaatacatattgattgaaacctaaaacagtgaggtgctgattaaatattataagcaaaaatttactagtattagtacagattgctacgcaaggctggaaaaatgtactaaaatagaatcttgagggaaaatggaaaagatgccatttcattgagagaaacatagagaaagttactgcccattcaataggtagaaagtagtctggtaaggctaggactgagcccaagacatgagtccctcagcaagttcgccactggcaaggttcaaatctgattcatggtggcattcttagtgattaccgtagaagctggctcataggagacagtaaccgtatgatgaattatttaataaatatgtgaataatgttttcagaatcaaaatgtccaattctgtaactggaattctattgatgaaacaaactagactatccatcaaaatgatgttgtttggcagaatgtgtttcaaataaatattatcaatttcttttgctttcaatattagcagtgaggtctgactatatttgtggatatccccagaaatactcaagtaaatgcatggggaaaagatacagaaagaaaaggggaaagtgaatggggaaataaaaagtggaatgcagaggataggaaagaagaaatgagtgaaagctatgagaaacagaaaaatgctaaccccaattatttaggctccacacgttctgctagcatgtttaatgacagaataaaaaaaggttggccgggagcggtggctcaagcctgtaatcccagcactttgggaagccgaggtgggcagatcacctgaggtcaggagttcaagaccagcctggccaatgtggtgaaaccccgtctctactaaaaatacaaaaatacaaaaaaaaaaaaaaaaaagccaggcatggtggtgggcacttgtaatcccagctatttgggaggctgaggcaggagaattgcttaaagctgggaggcagaggttgcagtgagccgagactgcaccattgcactccagcctgggcaacaagaacaaaaccccatctcaaaaaaaaaaaaaaaaaaggttaagacagtttctgataatagcaaaaagttagcacttcctaatttggacatgctaaataataaatcccagatctatttttaatttaaactgatttaattttaagggcctattacattaaaaaaatcactagaaatatgaatgcagtcattagtgagcctaggctgcttcagttatttactttttatacctaaaaagcacacattcaatgttcacccagaatgtacagggtcaactccacaggaaacagtttcacatttttaccaggaactttaccaaaaccagagaaaaaacaccaccaactgtgactattcctccccctttaatattattctacaccacattagccccatctagctgaaaccattctccagatgagttttccttttgcttaaatgacaaaataatgaatacaattaaatgctatgctccatttcatcatttattattcaatgatgaaattttattataatttttttgcctataaaattagctgcccataactgattcaaaaataagaattagagatgctaacataatccatgctgtgaattagtctaaaatatttatgcactcaaaagcaataggaataaaatagaaccaaatgaactggaaaacattagttatcctactttttgtcaaactctaaagtgaaaagttatacgtgtgaaaggctttgaaaagaaaagcatttcagagacaacagacagttaaaaaattatatcagcattttctgggaaagtacatactgcttttcgtttaagaatgcagtccaacctccaacgatttccctcaaccactgggcgtttcaggaagatttctggactcagcctgaaacaatgaaaccaagattttaagtaactaaaacaaaatataaagttctgattgtgtcataggaagcaaaggcaatttcagcccaattcaaccccattatcatcctccattgtgatgggtaatccaaagctttactatgagtctaggaacaacttcgtatgggaaaaatagcctttagctatacaaaacatcaatcttagttctttctctctctctctctctctcccccctctttaactgtctctcatacccacatgctcacatatgcacacaggtactgttggttgcccacccacagccaatctccaacttcttccctgctctcagagcctctctcccaccacagactgaatattctagatacttgctttcccagactcctgtgcagctagagcacaacgtgacacaatcctgaacaatgagatatatgaggaggtacacaggggcttaatgggaaagtttttcctccctgaaacacacacacaaacacacacacacacacacactctctctctctctctccctctccctctctttcgctctctctccctccctctcttttgctctctctccctctctctcagagaaagccctgcccacacttccagctttgggatggatgttgtatgggagtatgatgcttacaggggtgcagcaatattgaaattctaaggggaagaccataaccccagaatcactaaatcactctgccaacctcaggattgcccaactttagacttaacattaaatgtgaaaaatacatcctcagtgtttaagccctctttagttgaacattctgttaccccaaactaaaagcattctaatagatacacagacacatgacttcctatacaaagaagcagcatctgagggaacctggggctttctggacaggggagaaggaaggtcggctgatatatgaaatttttcctaggctcttctccttcagtaaggcataaggcagctaaggtaagctaagcttcacaaggcagctaagagtacaatagagtcatttttcccctggggctgggttctaaagttagtttctgagttaaacatgtacatgatgtaacttccctgtagttagaaaaaagaagcagtagaaaatactcctttctccactgaactgctagacctgaggcagcagaggtagactatgtcaggatgaaagccttatggaattctgcactggagtattgccctcccaggcagccctctaagcatgtgaaatcaacagtgctttaaggagctaaagagattaaaagaaatcaattttatgctctatttcattcagttaaagaaaataaaaacccagagataaagtttctaaaggaaacgttattgggtaaaataaataaggaaacagacaaatggaagagtttggacagtgtaagtcttgcatatttaattgagagtaggaaacaaactcaaaggtaatctatgtccaaacaagcaaacaaacaaataaagcacagcaattgatcagaaaagatcaaagaagcattaaaaggaaatctgttttaaaatagtaaaatgcattgctgtgcactgctagttcaccaaaagtgagagatagccaacaacatatatacaattgcaattttttgatgtgtacattaaatatgggctcaaagagcttcggtatgggggagacttttaatgtcatactctgcaattaagtatttatcatcatttatttcatttaatccacaaacatgtgtacccttgtatgctaagcattctacaagatactttgaagaatcttaagatagctcttgaggagccctcaattttgaggataatgcataaaaagaaaaaaagattttgttatatcatgctataaaagtataaaccatggctgcatggcaagaagaaagcagctataacttaccaagcattattatgtaagaatctttacttacttgtaaacaaagttattgtttaatattacatttcattggatctaggacaccagtgactgtaggatgcatcgttactgcatgtaccactaagaaagaaaacatcatgacaactataactgtaagagcataagatgcatcctgattgcggagatattaagacgtacctctaagtaagtgtaccacttagaagatttaatgactttaaatgcttacatgagaaagacaaaaaattaaaaattaatgatcagactttcctttcttaaaagatagaaaaagaagacattaaacccaaagtaagaagatgggggaataataaatataagagtagaacttgatgaaatacaaacctgaaaaaatacagagaaaattcaatgaaactagatgttgactctttgaaatatcaataaaatttgtgaacttctagcaaggctaaaaataaatgacaaaaaaatgattgaaaggatgggctcacatgtataaacccagcactttgggaggctaaaatgggaggattgcataagcccaggagtttgagaccagcttgggcaacatagcaagaccctgtctctacgaaaaaatttaaaaaattagccagacatggtggctcatgtctgtagttccagctactcggggggctgaggtaggaggattgcttgaacctagaaggttgaagctgcagtgagccacgatcatgtcagtgcacttcagcctgggcaacaaaggaagaccctgtctcaaaaaaaaaaaaggagtgaaagacaggtaatcactatagggcctagaggcattataattatattaaatgaataataactattaaaaataactgtatgccaatatttgtggtaatttaaataaaataaacatattccttgaataaaatattttcataatgaaaataaaaagaaattgaaactgacttcatagctattgaaaaactgaatttgtaattaaaactttcctacagggaaaactacagactttgccaactttacagaatttattaaacatttacagaatttattaaatatttgaattttatcaaatatttaagaaagaaatgatgctagtactacctaaattctttcagtaaacaaaggaggaacacttactatcttatttaatgaggtcagcattatcctgatactaaaaccaaataaagacaatgcaagaaaactaaagaacatcccttatgatcacagaagtaaaaatatttaccaaaaacacagcaacttagaaaaataatactacatcatgatcaagtgggattatcctaagatataaggttggtttaaaagttggaaatcaatcagtgcaattcaccacagtaacaacaaaaaggagaaaaacgttattattcaacaaatgcagaagaaatgatgaaattcaatatccattaacaataaatactcccaacaaattagaaatagaaaaaaacttccgtagtgtaataaagggtacctataaaaaaatctatctctaacatcacacataacataacaaaactgcatgctttcctcttaagattagaaacaaggcattctcaccactttcattcaacattttactggtgatactagccaatgcaacaaggcaagaaaataaaatataaagcatacagattagaacagaagaagtaaaactgtctttattcgtagatcacataatcatctataggacaaccctaagcaatctacaaaaaagctaccagcactaataaattaatttagcaaggtcacaagctataaggtaaatacacaaaaatcaattgcatttctagttctgtatggaaaatgaattttaaaatataatttacaataatatcaaaaaacataaagtactcagtaaaaaatttaacaaaatatgtaaagacctatacatagaaaaatacaaaatattgctgagaaaaattacataagagctaaataagtggaagcctcaatatagaaaaagaagtaccacctaaccagtggtaagtttaacatttttctccctttgattccttgacttggagggaaaacttggaaacaggcattggcacagagagaacttcaaaaatcctctagttcaggcttggggagaaagcaaaggatctctggtagtgacagggttgcagtggaaagcccaaagttactaaaacctctgaggcaggggaaatctcctctccaatggagatgtaaatacacctggcttggctctggacatgggtgccatcagagaaagcacattgcagagcacagtaaataaaaacccatctttctggctagaagactaaaaagggaagccatgggaaactaaaaattggggagaggagctcagaaaagcagctccataaagttgtttctgatttcctggctcattcccaagctgcctatgcatggatttcatcctaaacatcactccaaagaggctgagaactgaactgaggaatagaccaccaccgaagtcccagaagggccactaggtggcacacatatggggcagatctgaatagcaccacaaaggcattaacaacaaaaccggcattaaaacaacactcataaaaggctggttggaactttaagcctgaactgaaattggtaaattgcctgctaaaacaaaaatactaacattctccacaggattcaaacaagactcaagagtcttataacataataataaaatgttctagaatacattaaaagtacctggcacacaaagaaccaggaaaaaaaaaaaaaaaaaaaccttatcttgtacagaaaagggaatcagcagatgtcaataccaagacgacatggatattgaaattatctacttaaggctatgtcagatattataaaaatgctctaataagggtgaacactcttaaaatgaatgaaaagacaaaaaagtcttatagaaaaagatataaagaagaaccaaataaaaattttcaaagtgaaaaacactattaccaaaaacactagaaaaacaaaagcaaacaataaattccccaaacctcacaggataggctcaataccagaatggagatcatagagcagcagtccccaacctttttggcaccagaaaccggattcatggaagacaattttttccatgggtgggagctgggggtaaggataatttctggatgaaactgttgcacctcagataggccagcaggcaccagttagactctcataaggagcgggcagcctagattcctcacatgcgtagttcacaatagggttcatgttcccacgagaatctaatgccacggctgatctgacaggaggcggagctcaggcagtaatgctcatgctcgctacctcccccgacaagctctggctcacctcctgttgcatggcctggttcctaacaggctggggaccagtttggcttggaggttggggaccctgtcatagcggaaagagtcaatgaatttgaaggcaaataaataagatactatttgtgtcactgaagactcagaaggaggagagaaagaggaaagttcagaaaaaatgtgtaaagaaataatggctaacaatttcttaaatttagcaaaagatataaaactacagattcaggaagctcagagaaccccaaacaggataaacccaaacatcataaccaaactgctgaaaactaaagacagaaggaaaatattgaaaccactcagaggaaaaataacacattacttagaggggaacaatgtcttcaagagatggaaaatttctcaacagaaatcatggaggccagaatgaaatggaacaatcactttaactagaatgtacaaatacctcctacaactaaataagaagactaacacaatctccctctcaaaaaaaagggaaaagatttgaacagttaaaccaatgtccaaatagcacatgaaaatttgctcaacatgaaacgatgttgctgatacaagctaaaatcataataaaacactactgtataccctttgaaataaagactgacaacatcaagtgctagcaattatgtggaagaattgaaactctcatacattgctggtgaaaatgtaaaatggtacaactttggaaaacactacatttagctcttagtattgataaaatgtggtaaattaaatctatcttctaagataggtgtcaacaaactatagctcacaagccaaatgttgcccatagactgttttagtatggcctgtgagctaagaatggtttttatatttttaaagagttgtaaaaaaaatatgcttcagagaccatacatgatttgaaaagcctaaaacaaatttactctcttgctctttaaagaaaaaggttactaaccatttttgaaagtcagtggctttaaaacttttaaacttttggaccataagctgcagaaagaaatacattatacacccaaaccaacaccgggtcagtcagtctatctatctatctatctatctatctatctatctatctatctacaactgatataaaagtttccaaaattagtagcccttattaccacttacattgtaccctttctttcttttcccttccctttcctatcctatgccattctttttttttttaaatgctggtcacaacttaccaaattattttaatacacaattactaaagaggctcaacccatcatttgaaaaacactaacaatattaaaaccaacttaaagaatgttgcatttaaaaccaacttaaatacttttaaaacatgtattcttttacctggaatagtctttgtttgtgagtcagttagtaatgcaatgctgatttattttctttataacctttgtctccggcccaacctttgtctcttctgtttctctaccctttacaaacaccctcttttaaaaatctctgttcattgtttttcttttgtattctcctgttttattaattctatttctgacacatttaacatactgactccatacagagactggtagataaccccactctctcagatctacgcatactagtgtttggttaagtttctgaatgctcctttttgcaatatgcttgtacaacaagaattttctttacttgtttgagggaagttactgtgaaggttttatttctaatgatgtgttgtaataaaatggtatcctagtgcagtcgtgaaaaataagtaaccccgattcattctcttgctgaaagtagagaggaaaacattcagagttccatctctttatatgtttaattgaatcaacctaaatgaccatcaatggtagactggatgaagaaaatgtggtacatatacaccacagaatactatgcagccataaaaaagaatgagatcatgtcctttgcagcaacatggatggagctggaggccattatccttagaaaactaacacaggaacaaaaaaccgaatactacatgttctcacttataagtgggagctaaatgatgagaacacatggacacatacaagggaacaacacacactagggcctttcagaaggtagagggagaggatcaggaaaaataactagtgggtacaagacttaatacctgggtgataaaataatccatacaacaaattcccatgctacaagtttacctatttaacaaacctgcagttgtacccctgaatttaaaagttaaaaaaattttggtgttcagacataaagcatgaaaatctaggctcaatagaaaaattatttttagtctctctcacatcttcaccaaactttcagaaatattttttaaagaatatagtactcactggcacaaatttattatcacaagtgttcataaaatattcaaccaaagaaatagctcctaagcatgaaacattttttcctcctagtaactgactgaaaagacaaaatttggtaacaatagaaagaccagaattaagctcctccacaagcatgagcatgctggccaccacataccctgtctatcccctctagatcagtgattcccagccgacaaggatcttgcatcctctcccaaccccaaccagggaacatctagcaatgtatgaagatattatggtggtcacaactgggaacttactactggtacctagtggatgccgctaaacaccctacaatgcataggacagccccctacaacaaagaattatctagccccaaatgtcaacagggcaaaggttaagaaagcatgccttataattatagattccagacaaccgaagcaaaagatgtgtttgcattcttgaattagatattgatattgcccacaaaacctagaattagaagggaataaattatgatgatatattaacagttcctataaggtaccttttggaagaaaaccggatagagtaaaataaggggtaattcaggcaactactactaagttcctagaaggaaaacacattttagacatttccatatccatcgtagccagtgttggcatgtgtaatgggttttaactttccaggcagatgaatgattggaactgaagtcagactagaatgcctacaccaactacaggagtaaatttcccaagagttaaatgagtttccgatatgaggcttctggtgactttaataagcatagcaactcttatggatatttttttaaggtggtcacaaagttgaaaccggatgtatctctagaacagctgaccaggcctagtcattacagaggatatttttacggtaacaggcaagtggaactatttcaacatcaaaaggacaatttagaagaagtatattcactggccctcatgacagacataccaaaattagaaaaagacatccaaagacaccattacctctataactgtacttgcattacagtataatctttactgacatgaaaacttggaagtctgcttccaaatgcaaatataaaacctaattgttcaaactaagtattttatgaatattgttgaggccaaggtttttgaaaaggcctttcactgaaggcttagtcaactggttgagaccctggccaaaccatccacagatacagctgattttcataatgtgtaattcttgaacagcactataccactgtacatttctaaacatagagacttccagaaaaaaattcccagggacaaatactaaccaccagtctgtgataaaaatctcttcatttgcctcttccattgcatttgccacatcttcaaaatatcctttggcattaacatacctgaaagacaagtttattgttcctttttgttattaaaaaagaaaagaaaagaaacttatcttatggtaaagcaaaacatggaagccactgcctagagtctccacataacacataaccaccattgactttgtggacctggaaaacaaggattgaaaataccaagtttcctctgctgcctaggaagggcagtaagtgtaagcagcctgatttttctctgcttagagaacaacaaatttattgagcctcatcatcataaggagccagattaattttcctatcctgttgaacttacatacagtttttcttacatacagttctgagactgaaaacaaactagcttccaatccacgggtagaaaaacatgctaagcatgactttatttaaaagaaatatctagcaagtaaatgctttttcctaaattaggggtaatgacttaaataaaccttccatttgcatcattaaagaaatgtatgaagttagctttaaaattcaaacttcaaaatctaaagctagctaagctcactgtgaaaaatcttaaaagcaacaattgaaaaactaatctataatcaggtagtcccataattatcacaaaaagagaagcccttgttaagtataatgcataatctttcacagttttgaaaactgattccaggtgaatttaggccagtgtaatattagatgctatgactgccttgacaggcttagagaaataataacttaccatttagctaaagcattctcttggatagcagcatatgacccaaatcgatgatctttgagaaagttggtgccatgtttctggatgaattcttctatagcccctccccaccaccgagcatgtctatagctgttgcattttaaaataagtgtcctttaaagaaaaagccaaatattgaaaagactggtcactctgttctatctcatgctcttttttatttggtaatataccaaacacaaactgaaaatttgaggcaaagaacatcaagaaagcaggcatttaacattttttggtagtatttctaaaaatatattcaatataacaaaaataaatgttcaggttacttattcattcactcatgcaaacatgcataaaggtacttaccatagacctagagctgtgtgctaggccatgaggaggataaagaaagaggggtaaggtgaggttctatttttaagtattagttagagagctgttggctcccgtacagcagcggtccccaacttttcttttttcttttttttgagatggagtctcgctctgtcgcccaggctggagtgcagtggcgcgatctaggctcactgcaagctccacctcccgggttcacgccattctcctgcctcagcctcgagtagctgggactacaggcacccgccaccacgcccggctaatttttttgtatttttagtagagacggggtttcaccgtgttagccaggatggtctcgatctcctgacctcgtgatccgcccgcctcggcctcccaaagttctgggattacaggcgtggtccccaacttttttggtaccagggacaggcttgtggaaggcaatttttccacggatgatggggagtagtttcgagatgaaaccgttccacctcaggccatcaggaagtgatatgattctcgtgaggagcgcgcagccgagatcccgcgcatgtgcaatccacaatagggttcgagcttctgtgagaatctgatgctgtggctgatctgacagaaggcggaactcaggtggtaatgctccctcgcccactgctcacctcctgctgtgcggcccagttccgaacaggacacggactggtaccccgagggggttggcgacccctgctctagagggcacttccccttgtgctccctagtatccattccctcagcttctggaaatatcatcccaattgtgcttcatgacagccatcccttctcttcaacaaagctaagcaaaatggcatattccatctttctggttccagaaggtggttctggcatgactatattgtgagttttctatttcactaatcataggaaaactgttctttttttttttttttttttgagacggagtttcgctctgtcgcccaggctggagtgcaatggcgctatcttggctcactgcaacctccgcctcccgggttcaagtgattctcctgcctcagcctcccaagtagctgggattacaggcctgcacctccacgcccggctaattttgtatttttagtagagacggggtttctccatgttaggctggtctcgaactctcaacctcaggggatcggcctgcctcggcctcccaaagtgctgggattacaggcatgagccactgtgccagccttttttttttttttttttttttgaaatggagtcttgctttgtcaccaggctggagtgcagtggctcaatctcggctcactccaacttccgcctcctgggttcaagcgattctcctgcctcagcctcctaagtagctgggactacaggcgcgcaccatcatgcctggctaatttttgtatttttagtagcgacagggtttcacaatattggccaggctggtctcaaactcctgaccttgtgatccgcccacctcggcctcccaaagtgctgggattataggcgtgagccaccgcacctggccaggaaaactgttcttttgcaataataatcaattaaacatattgataccagaaaaaaaaggatactcatgtacatttgttcatcgattcctattaacaaatggacatgagtatcctttcaggcattcctaagcaaatgtgaggacttacttgctcaggaatgccaggaagggactctcttgcttccacagaatttggtgtgagtgtgggaggtggccatcttgctaccacaagggaatcagtcatgctcaacatggctgattagttctctttggtataagccagtttgctttagatttttctgtcactcataactaaactatcctaaactcttacagagttataaatgctaaaaaaaaaaaaaaaaaaaaaaaaattcagagtggattacagaaagttttttcttaatgccaagtgtcagaattctgcctactactaagagggaaaaataagttatccaaatttgaagtttgaaggaaaacagagtgttggagccagctgtatccctgccatgtaggcagaaatctaccatcataccaatgtaagaagactatgcgtgaggagggaggttgcttttttgaggaaatgcaatgatcctgatgagacgcagggaagggggctgtgttcacagattctaaaagaattatttataaagattagccatgtccaacctgctttcctcaatatgtcagaggtagatgctggcttttgtctgaaagtcatgaagacagggagaggctgctgctgctgggctgtggagacaggggaggagagacgtggtggagctgagaggagtgaagcatccccatcgcgtgtggtggagacacgggtttctagggatggagacgagagggcacaggaggtgcctgggcttgacctatcctgcaagcactactccaattgagctaaaaagcctcggaaaaacagttatgagaagactttacagaagagatgagtaacaagataagacattatcacaggatgtgagtcagtatcaagggggaaaacaagaactattccaaacatggacataagaaaagcaaagggaaagaggcaagaaaaaaatgctgccttcatagaacctgcaaggcgtattagggaggaatttcaaataaaggcaggaaaataaatgcccttcaaaaataagtgggggaatttggccttatttgataaaatcatgggggggatcttacaccaggaaggaaggtaatgaaacctggatgtgaatggcctcatttggcaatgacatacgggtaagtgagggtgggaaatgcagatgaagtggccaataaagtaagggaccagtgagaactgtggccagacttctgtggctcactgtaaaacaggaatgcaggaggaaggtgtaatggcagcaccattatatttccagtcacaatcttaaatgttccattctcatagaatatcatcaggaaggtcagcatctttttatacacacacacacatacacacacaaacatgtaaatcagtaagggaatatgaagctatgttggtaactatgtgcacagggagaaatgcatatatattcatatacatgatggtgaatgaactatacagagacaaatggatatatatgtataaagacacacatacatggtataactacaatcttccagaaagatcacatacacatgtactcactaataaaatctataataaatgtacatgagtgtcctttcaagatatctttcttggccaggcggagtggctcaggcctgttatcccagcactgtggaaggccgaggcagacagatcacttgaggtcaggagttcgagaccagcctggcaaacatggtgaaaccccgtctctatcaaaaaatacaaactttagtcgggggtggtggcaggcgcctgtagtcccagctactcaggaggctgaagtgggagaatcgcttgaacctgaaagatagagtttcagtgagtgaaggttgcagtgagcagagattgcaccactgcactccagtctgggtgacagagtgagagcctgtctcagagaaaaagaagatatctttcttaaaatatgtgtgtaacaatttttataaaacaaatcactcttttggtgttttgttaattaaagaatattgatttataaagtaaaagtttcatttattttaaaaatgtgaactattgctctaatctatctgtttagtaaactggcaaattgagtagtaatttctgttaacataggcaaacatctacatatgggattgtttattcagactgttgcacacaggatactctttaaaatatatacaaggaaaaaagtggtttcattactattgattgaggatgagctctaaattacaattttctaacactttttaaactccttttttacttaaggttgagaaaaaaatgtttttaaggcatttttgtagaaatcttttttaaatatttgaaatgtgtaccttgaaagattatcaattcggattccatatttcgtttctgtctccttcttccccaccttaattttgaattctttgtctaccagcaggacgaaggcaatggcaccgctgtctggtttcatatacaataaaaaggaatctttcactattaaccatctgtaagaaggtagtaagtatttttaaaagttgcattgagtaaataaaacgagaagaactaatcattatgacaagtcttaagtaatcactctggcagactgtagacataattacattttctacacaggagatttattttttttaatcgctatgaaacaaacaaaaaaaacccaacaaaacctttctattacgtttttctaagaaacagtgtaccaagtaattcacagtaattcattagctctttaaacactaatggcaaaactggaggaatgtccctaatattggcaggtagcactcacaggatgtacgacaggaagggcaagactgaggagatgggatccatttacagtgaatgcaaatggtaacttcatcaggctgcatataacaacatgtattcctatttgcctgcaattgtagagtgatagactgaatcatttgaaaactgagaagtaacaaagtgggcataatagtgcataccagacaaagtaaagcactctaggcacttccacattatggaatagtaaggttggaacatctgaatataaactaagtaatactgtaaatatagcatgggaactcagtatttaaaatatatctataataaatctttactgaaattgggaattgcattatgttttaatggctttataacttggaatttaatgtagacagacctacattgatttccacatagtttcatttcattaatttttttttaatacataagttatctccttcctaataaaagggcatagagtggatttaggataacttatagcaaagaacatatgtggtatggttcagaaaaggaaaaacgtcaaggtcacagaaagtaaatacctaaaatacctaaccacaaaggtaaatataattacagagatgacacactcatgtgggtgtaagcttcctagtttttcttgtcaaatgaataaattaaagaaataagtggatttcctccaaaactaaattccaaacaaagtttctcatttgggacctaacatgatacaactgaacaacataatgaataatattcccaataacaattttcaaagcaaacacagaaattatacattttataagagttcttataacactcctcaatacgaataccaaggctatgatatcaaagggtaaccccgttttcccagcactgtttactgaagagtgtgcactttccccaaagaatgttcttgatgccctcggaaaaatcagtaggctgtagatacatggattaatatctgagttctctattctgttctactggtcatgtgtctgtttttataccaataccatactgttttggttactatagctttgtaatatattttgaagtcaggtagtgtaatgcctctagctttggtttgttttttgtttttgttttttgctcaggattgctttggctgttcagggtcttttgttgttttatgtgaattttaggattgttttttctatttctgtgaaaatgtcattagtattttgatagggttgcactgaatctgtagattgctttggatagtatggtcattttaacagtattaattcttctgatcctcttcagtttttttttcatctgtgtcttgtagttgttctttttactagtcattagatatcaaggtaatttgatgctgggcttttattgaaagctcttctttattatgccattcataaaaactcctctgatttcttccctttttcttttttgtcaatagatatatttttttcttttaacttttactttgggttcagaggtacacatacaggtttgttacatagggaaacttgtgtcacaggggtttggtgtacagattgctttgtcacccaggtactaagcatagtacctgacaggcatttttttctgatcctttccctcctcccaccccccaccctcaagtaggccctagtatctgttgttgccgtctttgtgtccatgagttctcgttatttagctcccagttataagtgagaacaggtggtattgggtttcctgttcctgtgttagtttgctaaggacaatggcctccagctccatccatgttgctgcaaagtacatgatttcatatgctgtggtgtacatgtactatccagtctactacagatgggtatttaggttgattccatgtctttgctattgtaaattgtgctgcagtgaaaatacacatgcactgagtctttacagtagaatggttatagtcctctgggtatatatccaataatggaattgctgggttaaatggtaatactgttcttagttctttggggaatcatcacactgctttccacaatggctgaactaatttacgctccaaccagcagcatataagcatttccttttctctgaaacctcgtcagcatctgtttatttgtttgtttgttttttaatagccattctggctggtgtgagatgatatctcattgtggttttgatttgcatttctctaatgatcagtgatgttaagcattttttcaaatgtttcttggccatatgtatgtcttcttttgaaaagtgtctgttcatgtcctttgcccactttttaatggaattttttgtttttttgcttgtaaatttgtttaaattccttatagatactggctattaggtctttgtcagaagcacagcttgcaaatattttctcccattctgtaggttgtctgtctactctgttgatagtttcttttgctgtgcagaagctctttagtttaattagattccattcgccaatttttgattttgttgcaattacttttggtgtcttcatcattaaatatttgcccgttccaatgtccagaatggtatttcctaggttgtcttccagggtttttatagttttaggttttacatttaagtttctaaggggtccagtttcaatcttctgcacatggctagccagttatcccagcatcatttattaaggaggaagtccttttcccattgcttgtttttgtcagctttgttgaagatcagatggttgtaggtgtgcagtattatttctgggctctataattctgttccattggtctatgtgtctgttttcgtaccagtactgtactgtattggttactgttgccctgtagtgtagtttggagtcacgtaacatgatgtctccagctttgttctttttgcttggcattgccttggctattcaggctctttgttggttccatttgaattttaaaatagttttttctagttttgtgaagaatgttattggtagtttggtgggaatagcattgaatctgtagattgctttaggcagtatggccattttaatgatattgtttcttcctatccatgaacatggaatattttccatttgtttgtgtcacctctcatttctttgagcagtattttgtaattctcattgtagagatctttcacctccctagtcagctgaattcctaggtattttattctttttgtggaaattgtgaatggggttgcctccctgatttgactggaaagcaattccattcacaattggcttgattgttgttggtgtatagaaatgctagtgatttttctacattgattttgtatcctgaaacattgctgaagatgtatatcagctcaaggagtttttgggcaaagactgtggagttttctagatatagaatcatgtcatctgcaaataggaatagtttgacttcctcttttgctatttggatgccttttatttctttctcttgcctcattgctctggccaggacttccaatactatgttgaataggagtggtgagagagggcatccttgtcttgggccagttttcaaggggaatacttccagctcttgtccagtcagtatgatgttggctgtgggtttgtcatagatggctcttattattttggagtatgttccttcaatgtgtagtttattgagggttgttaaaatgaaggatgttgaattctatcaaaagtctttcctgcatctattgagataatcaggtagtttttatctttagttctgtttatgtgatgaatcacatttatcaatttgcatatgttgaaccatatagagaagattcaaaaccaaacagagaagattcaaataaacacaattagaaatgacaaagaggacattaccattgatcccacagaaatacaagtaactgtcagagactactatgaacaactctatgcacataaactagaaaatctacaagaaacagataaattcccagacacatacatccccctcaagactgaaccaggaagagactgaatccttaagtggaccaataatcagctctgaattagaatcagtaataaatagcctaccaaccaaaatacaaaaacaaagacaaaaagcccaggaccaggcggattcacactcaaattctataagacgtacaaagaagagctagtaccgttcctactgaaactactctaaacaattgaggaggaagaactactacccgactcattctatgaggccagcatcatcctaacaccaaaacctggcagagacacaacaaaaagaggagacttcaggccaatatcctttatgaacatagatgcagagcatctcaacaagattttgctttctttctcaggaatatataaatcaagtaaggcatctatcaaccagccttctaggagtcagcaccatctgcacagggatcaagtgcctgccctgaagtcagcctccctgggctccaattccacctgccactcactgcttgtaagaacttcagtaattgagcatgatgtcaaaatctataacatgaggataacataagacatataacatgaggacctaacagcaacatctagttcataagtattcataaagaattaactgagataactcatgcacatgcttagcacagtgcctggccccaatacatgcgaactattataactaatcttgttctaaaccatgtgagattaccgtctgttttaaaaagatacctcctgcctgtgttactacttgccatggcattcaaatgcagataagcccacttgagccagccctccccttctcagcctcatctactattgtctctcacaatgttagtcaatgttggttcttctttagacttgccagtcttcttctttgggctctatcgttgctgttcctctgcgtaaaaactgtttcttctaggcaattccatggatggtctcttcttgtcaatcaaacctctccttaaaaatccctctacaagcaggctactggattcaaaaaaaagctgttctccaccatccctgcctcatcacccccaactctcctccatcatgttgtcttgatttagcttctttgtagcacatctggaagtatttgtcttcttgtttattgtctgtctcctacagtacagcgtaaggtccctgggaacaggaaatgtggctgtcatgtctactactatctgttcaatgcctagaactatcttctagcagcccagagcaagctttcaggcaaggccaccatctcgcctaaataatggctgcatgaatggattccagagagtaaataaaaccatttagacactatcactgtctaaaaattttaattattggcacagctcatagttcactaaagtaaacactaagtaagaaagtgctaaggaattaaaagtaatggcaaaaaccacaattacttttgtaccaccctaataaatgctaaatttatttgttaacgtctatacatctctttttcttaagacattatttgacataagaaacttaacttacgaccaggtgcagagaagtttctcaataaatgtgctgtttaagcagatgttttagattgtaggatctctgtttgtctttttttaaaactcatctctcagataaggtcattatgagacctaactgaaaattcaatttccttgtttgccttactacaatttgtcaacgtagaataaattaacaagtgatcagaatgtatttttatgggtacaaatgaaaaaaagttatgaaggagtgtcatctttaaaagtaagtctcatttagacattaataaaatagtcgtcttggccaggtgctgtgcctcccgcctgtaatcccagcactttggaaggccaaggtgggcagatcacttgagctcaggagttcaagaccagcctgggcaatatggtaaaaccccatctttacaaaaaatacaaaatttatccaggtgcggtggtatgcacctgtatccctgctatctagggggctgaggtgggaggatcgcttgagctcaggaggtcgaggctgcagtgagccgagatcataccactgcactccagccttggtgacaaggtgagaccctgtctcaaaaaaaaaaaaaaaaaaaaggccgggcgcggtggctcacgcttgtaatcccaacactttgggagccgaggcgggcggatcacgaggttaggagattgagaccacagtgaaaccccgtctctactaaaaatacaaaaaattagccgggcgtcatgccgggcgcctgtagtcccagctactcggagagcctgaggcaggagaacggcatgaatctgggaggcggagcttgcagtgagcggagatcaggccgctgcactccagcctaggcgacagagcaagactccgtctcaaaaaaaaaaaaaagtcttccactgtgagaaactttctaaattatatgttatcatctatatatgctttctggtattttaaatcccaaaaatgtgactcaggaaatatttattaatatggaaccagggctttaatcttcacagaatgatttacacaatttacagtgatgacacatttcattccagggaggatcgtatctttttagattgtcccagttgacttatgatttaatccaaagtttaaaaagagggggcatatttattttgtgtaacaaagcctttccctcacctttcctagctgttgcttctcataagggttaaatccaaacgtcagtttttcagggagcctttccttgactcccagagctaaagtcaccctctgcaatccccagatccctcacaaaccatttttcccctttaaagctctcatcgctacctgaatttatacaatttacattaattgtcggcttagtgcctgcatttcccctctaacagaactccatgagggcagagacttcatcttgttcactactgttttcacaggagtatgccaccatctggcatacattaggcactcgaaaaatgactgaataaaccagaccatggcttccattccttgagtagacgccttaggttgggttgtcccagaagtaaactctgagatacggatatacgtgtataaaagagtttaagacagtggcaccaggaagcaccaattagggaaggatagaaagaaagagcaaggaaggaagccacagagagtgtattttcatgctttttattgtgggcagctgtgctgtaagccagctaaggagttctgggagacagtgtagagactgctgcagagtcaccccaactgaggaggatggggctggactccgatcagttcttggctgatggctgctcctgggagctgttgacacttcccagactgctgtgcacacagacaggtgggttctgacagcctacagaatttttggtcaaagaatcacaaatgcttaaggttacagtctgaaaactgtggttggcatgtagcagctgatttgggcaaagttaacgactagggaggagtggtcagaaggaatccccaagtttctaaaagttagagaagtgtatttgaaggcaaatactttttttagtatattatttcccttcttattttagtaaaacttctctcccagcgacagatcaagactccatctcagaaaaaaaaaaagaaaaaaaacttttttcccttacaaaaattttcagttttctttagtttaatcttctgatcttttccttgtaatttcttctgtcccttcaaatcccagaaagtaaaggcccagcttaatggtatttttttgttggtagtatatcttaaatcggtgtgtgtaaaggtggatgccagtattaattttatatattttgaatatacacatagctcaattccacatttaaacataaacacatttatcattttcaatttgggggaaatattatatacagatataaaatatttataattgatttcttcagtgttttaatagtttttcaaaatcccagtacattgttattgcaacagttactgtctattatgtgccaaacttgggggatacagataagaatcagatgagaatattgttcctcaaggagtttttagttggtaagacgtaagatataaaataatgttttctgtctatattacgcttaccatgataaacatttttcagaaatataagtgtaaaattatcatccctgaagtctgcacaattttacttaagtttttgttaaagtgtacagttcagtttgatttttggtatattcacaaagttgtataaccatcaccactatctagttccaaaatatcttcattggcccaaaaataaaccccataccagtatcaaattagtagaaagcaacctccttcccattccctggaaaccctttatctacttccgtctctacagatttgtctattctgaaaatttcttataaataagaatgataaaacatgtgcctttttgtatctggatgttttcatttatcctgttttcaaggttcatccacattgtagcatgtatcagaacttcatatccttttccatttaatttttagatttttattcagatgtaattcacatatcataaaacgtaccttttaaaagttcacaatgcgatggtttttagcatattgacagagttgtgcaaccggcactaccgtcttatttcagaatattttcatcaccccataaagaaactccatgaccatgaatggtcttcatttctctttttttaatgtatttttaatttctgtgggtacatagtaggtttatatatttatggggtatatgagatactttgatacaagcatataatgtgtaataataacatcaggataaatggggtatccatcacctcaagcattatcctttatgttacaaacaactcatactcttttatagttattgtaaaacatacaattaaattagtattgactatagtcacctgttgtgctatcaaatactagatcttaattatcctatttgtttgtatccattaaccatccccactatccccctccacactgcctttcccagcctctgataaaatctccatgagttcagttgttttaatttttagctcctactagtaactgagaacatgtgaagattgtctttctgtgcctggcttatttaactaaacataatgacctctagatccatccatgttgcaatgacgggatctcattcttttctatggctggatagtaccccatcatgtgtatgtacattttctttatccattcatctgttgatgaacacctgggttgcttccaaatcttggctattgtgaatagtgcttcaacacagatggaagtgcagatatatctttgatatactgatttccttcttttgggtatatacctagacgtggaactgctagatcatatggtagctctattttgagttttttgaggaacctccaaactgttctccgtagtcgtcgtactaatttacattcccatcaacagtgtatgagggttcccttttctccacatcctcaccagtatgttattgcctgtctttttgataaaagccattttaactggggtgagatgatatctcattgtagttttcatttgcatttctctgatgatcaatgatattgagcaccttttcatacacctgtttgccattggtatgttttctttcaagaaacgtatattcagatcttttgtccatttttaaatcagattattagatttttttcctatagagttctttctggttgttaatcccttatcagataggtagtttgtaggtattttctcccattctgtggtttatctcttcactttgttgactgtttcctttgctgtgcagaagctttttaacttgatgtgatttattccttttatggctggataatattccactctataggaataccacattttgtttatccattcatcaattgatgaacattagaattgtttccacttgtaaggctattatccataatactgctattataatactgctatagaaaagttctattgtagacatattttttcagttctcctaggtgaatccctggaattgctgggacatgtggtaactatgtttaacagtttaaagaactgccagactgttttccaaagtggctgcaccattttacatttccattaacaatatctgcggtttctctacagaaaatattctagtttctctacaccctcaccaccatttgttattgtccatctctttgattatagccatccttatgggtgtgaaattgtatctcattgtggatttgacttacatttccataatgactaataacgttgagcatcttttcgtatacttattggccatttgtacgtcttctttggctggccaatttgtgcgttctttgtccttgggttttcatgaatataatctgtacactttgcctacaagttcagctttgggtagaatatttaaatggatgctggaatttggattttaaaatataattaaaaatttgttctgccattgcttttaaaggatttataatttaaaactggtatgtaaaactagcccaaatacccagtgtattaaaacaaacaaatacacaaaactcactaattcctacctttttgaccatctgtagcaggctcttccctgaccacagcaattcaagcctggtattctgtgtcctccagatcttttcattatcataccttctctgaaagagacagaaaattaacccatcaccttcaaatttcccactcccacttagctcgtacagcctcccaacatgggactaaataaaccatctcattctcacatgactttcctccctactctctcctcctcgctctcaactagctcagtgccctgttaggccgggtaccctagaggcgaaccctaaaatacactggtgagatatagccccttcagcattcggggcagtgtgattctgttgtgcactacacaggaccttaagcatcctgtctcctggctctaaatgttgagtgttcccgttaactcgtcattaatgggtgcagcacaccaacatggcacatgtatacatatgtaacaaacccgcacgttgtgcacatgtaccctagaacttaaagtataataaatatatataaatataaaaaaatgttgagtgttccctcctcaacattgtgacactgtgacaaactaaaaaagactccatgcatttccacatgcctgcacagggatggtccacctgctgttgagaccatggtgcatctcacccacagattccaggacatctctgtgtctcttcacacccagttctagcaaactagttgagctagttgagccatgccaaaggaagcagagcacagctactagttttgaaaacagtatatcttaattctgaaaaatttgacaagaaaaagcaataacaaaggctaaactttaaaaaaaactttttttgaaacaactactaacaatgctcttaactagaacttgaaagttaagctctttatgttttcaagctctaatattgtgaaggaaaattataaactttcatctggctataaaacatattttacatagtattattttaaaataatcatcaaaatgagtagtaaacatttaactttataagggattgtaaaaggagatcttatatatttgatttttaatgtattctcctacacatcagacttgctataggtattgaacacttccactgttgggttagaaagaatctgtgctgtaagcacgtgacaaagacagtggagcagttgctaccgttgtttatcacaggagatgctctgatttgtatgaataattccatcagttgctctaactactggggagaagagaagctagcagtaaagccaggaggactccatcaccatggcatgctgctacgttaagtgtgaatgcaaatcaatttttcatacttctcttttaaggtttattgcaacttacatgccctttggtcccaaatcatggatgaaagacagctggcttatatcaagaaactctgtctgaaaagaagcaaaaaatccatctttagcaagcaaaacaattcaaatttatgcattaaaaaacatgtattaggtatagctgtgtgtatatactgtttggtgtgctccacagactacacagatcaataataatggcattgcactaaaagagtgcagattaggagtatataaacaatgaagacacatcctactagatcttctaaatctgaagagagagatgtgtgccttaatacatagagataaaatgctcaagaagcttggagagagagagagagagagtttattctcaatattctttcatgtttgtttttgttgcacgggatggatattgtgtggcacagtgtacactcaaacaataaaagaatgtgagaagcaagtgatattggtgcaggatctggaagatggactggatttgggcccacagtgtgaaatgggagatgaatggggggctagaacagaaggtcaaaaaggttataggatgtacagttgggttacagtgaataagatgaaggaaaagaataaaaaattaaacaggctgaaaagagaatggggagggctttgaacatcaggcataatgaaaagaattatttttaatgagttgaagaggaagagaattttaggcccaccttcactgtattagaaggttaaaaactgtaaatattataacaacaactgtggctgtgtttactgagtgctaactatgagttggtgttatgctaaccatttttcatgcattatctcaaacccctttgaagcaggtgctacttttcccattgtacagaagacgaaactgaggtttagtgtaagggtaagcaaatattttctgcaaagagccagacagtaaatattttgggctttgtgggcatacattccattttgcatctacttcgctctgctgttgtagcacggaaatagccatagacgcatacataaacgaataactgtggctgtgttccaataaaaccttatttatggatataaaatatgaagataatctaattttatgtgtcacaaaatattattcttttgattttttttcaaccacttaaaaatataaaaactattcttagttcacagaacatacaaaaacaggcaatgggcaatgggcaggatttggtccacgggccctagtttgcaggcctctgttttagagaagtcaagtaagttgtccaagatcacatagttaagaagggattaactcagtatggttaactcattatgaagtcagaccaaagtcagcgccctcaaaaccaagctggaagagcaaaatgtcattcaacatttatctaattcaaattgagttccttgcatattctaggtaggtgaaagctagatgtaaatgtggaggcatagaagggaaaaacaaatcaacattacataatgtttagcatatgcagatttgcagatcgttttgaaaagtgaccaacaataagatcagttccttaggccatgtcaatagcagccttgatagaccaacaaagactaaaaagatactctcccagcattaggaagcagacgggagaccagatatggaaaacactaccctcaatgaagttctgtgggatgaaccacactagatacatgtgaaagtagttacagagttatagaatagtggagggcaaccacttcccagctgacatgacatcacagaggcaggggcatttgatctaggtttgtaaatgggattagtaaaacaaaagttttccatgtaagttttatatgtgattggacatatctaacactactcttgtaaaaaaaaattacaaatatctcaaggcgtccatccttgtaaggttcatttaaatgcttgcatttttctcttttcttggggttatttgcagaaaataggtctttaaaattcaaaaggacttaaatatctttttaaaatcctaagtcaaaggtatcttcatacagcattttttaaattgagaatttaaaaagtcaaggtctcagtcaggcatagtggctcacgcctgtaatcccagcattttggaaggctgaggtgggtggatcacttgaggtcaagagttcaagaccagcctggccaacatggcaaaaccccatctctactaaaaatacaaaaattagccaggtgtggtggtgcatgcccgtaatcccagctactcaggaggcagaggctgaggcaggagaatcacttgaacccgggaggcagaggttgcagtgagcggagatcgtgcccctgcactccagcctgggcaacacagcaggactgtctcaaaaacaaacaaacaaacaaaaaacacctcaaggtctttacatttcatttcttatataaaacagtgattcagtatcatgcatttttatctggtttgtgaaaatgcttcttaattggaaaaggtaatcctatgggttattggaaatgattcacagattgccagccataaaatccaaaatattttaaaatcctgagtcataacttttatctctggagagcagacaaataatgtcagtcctagtttacatttgaagactatagtctactacagaggcataactaacttatgcaaagtcccagaacaaccgaagggaagaataggaaatgaaaacaaaaatcaaggaagccactaatctaatgcctggatattttcttatttacatagctgttatcatcaaatagttgacaacagaaatattctctgaaatcattcagaaatcataacttttggagtatatcataacaaaattgctaagcgtaaagaatctcagctaagtagacacattaataatgtagaaaattgaaagttacacattaatatgaaatttaatttatcctaatggcttagtaaagtttgactggagagagatttccagaaggaaccaggcctattatacagaaaaaaaaatctggcaataaacgtttttctaatacagagttatcaaattgaaagtaaatgtgtcagggtcaactgagaggcaaacctaactaataaaaattgaaatttaacaaagatgatgttgtccaaacttcttagtacatcttcagtgataagaattccattatccatttgggcaagtgattctcaggaataagaatttaaagatcaatttagcctaacggcatttcgcagggcttattccattgatcttttgagtaatgtataatcaatacctttttgtctttgtttttttggcaaaggaatttgtaaaatatgaatacaattgaaataatgttgcaatgcaataatgttcttggcactaggtggaaagtggtctcaagtaaaaaattccaacatgatctaccaattggatactaaaaacgttagagaaacagagaagcaaaaatatttccatgccaagagacaagcaacaagccctaggggtaacaaaaaatcctgaaaattacttggcaatcacgtacacactgccccttccacccatccttgtattgtaagagaagggtgactttcagaggctccttttatttaccaggtagcaaaaactcaagtaaatggccaggtgggaaattatcagatacaaggaaggtaagagcattgagttgggcaatgtccttgtagactcaggtactccaggaaaggcagggaacaaagaggacatctaatctatgaaggaaactgggaggctgggcaaaggcctaaagtccttctcaacgctaagactcaatcataagaaagaaaatatttcccttaatttgaagatgcagctgttcaaattagtatagcttttccctgttggaatgaaaacactgtgtgcacgtttattctttacctactcttcccctcaagttaaagttcattctacaaaacaagggagaggtgaactcagtattattgatctgtgggatgttttacccaaggatttcaagctaatcaccttcttggggataagaaatctgagtcacataagttaaatgatttacttcaaggtagagatacgatcctatcaccttagggcccttctcttggaaattgtacaatttgttccatttctagattttaatctcaggtatgaaaaaggtacatttattgctccttattcctctgattttaattccctggaagataagcattttccagttactaattaaaatgcctagctagtgagttctctactacagccagcactaatacaatttcagaatacaaaaggaattcttgtttgagatttttttgtatgttattacacaactcagatattgctatttttttacatatttatgcttagggtaaagaggaaatacatttgtccccattttacaaatgagcaaagaaaactgaacaaatcaccaatggtctctgaggcaactgtctgatcatgactacactaaaacactaggatgctctcctttgcagaaccacaagaaggaaaaaaaaaaaaagaattaaaagcagaggaagtcttcataatcatgggagagaaggtctgagcacaaacccaaccaatggctgtataaaagtgagaggaaagaactgtccatgtctaatttcagaggctacttaagaaaaataatgtcagtgcttagaaccctaaaccaaattcctttggggaaaatcctattatacaaacacctttataataaatctatctccacttttttttttttggcagagtcttcctctataacccaggctggagtgcagtggcgcaactgtggctcgctgcaacctccgcctcccgggttcaagcgattcttctgtctcagcctcccaagtagctgggattaaaggcgcccaccaccacgcctagctaatgtttgtatttttagtagagatgaggtttcaccatgttgtccaggctggtctcgaactcctgacctcaggttatccacctgccttggcctcccaaaatgctgggattgcaggcatgagccactgcgcccagccctgtctccactttttaaagtggtctaactttaccaagacatttctaagctgatcatagcattttagtttagttctcaaactcctgatgataagaatcacttgagctatttgttaaacacacttattccaaatacagatctggatggccctatagagattaagaacatatcctattcagtcccttgacctatgatccatgattctatctgcttatggacctgaattaacttaaaataggtttgttttatacttataaaagtataaatttattatatacatgttaaaataacttttaatatgctttttacagacagtaaagcattttttaacagatacttttttagtatttctcacaattattgaagaaaacatgtaaattccaatctcatttcacaaatatgaggcagaggtctacagatctagtctttaggccagactacatttaaagaaaaagaatgttagagaattaatgtatatcaaattgtatcctatgcttgaatcatattgaacaattcagctgttggagagaataatctcagtaaccatcgaaaatgagagggaggctgggcacggtggctcacgcctgtaatctcagcactttgggaggcagaggcgggcggatcacaaggtcaagggatcgaaatcatcctggccaacatggtgaaacctcgtctctactaaaaatacaaaaatttgctgtaatcccacctgtagtcccagctacttgggaggctgaggcaggggaatcacttgaacccgggaggcggcggttgcagtgagccgagatcatgccactgcactccagcctgggaaacagagcaagactccatcccaaaaaagaaaaaaaaaagaaaatgagaggagaatctattcacagtcagttgctaatgaggctttcccttccaaaggaaatgtttacaggtcactctgggatttctaaatacaacatggcctaactttgaaaatatttttatgactggaaaagtcattaaaaagaacactttttaaatctaaacattctttagtcaacagtagaatcccaaatgtagaaaagtacatgaaaagagaagaatgaactcaccaagaatggttacagccaaaagaaatagtaaaagtaaagtcacaggcaggcagaaaagtaaaagaaatggaaaattattgcatatggatactaatacacatttaaatagttgtctgttaaagaaaatagcatgtcggatttcagacaacacaacaggaggtatcatttttattaacaatagtagtagtatccttattcattgttatttcaacaatacaagttcctgagtcctagaagaaaagaaacccctgcctcccatcatccttctcttgagatcctctggtgcaacccaaattcctgttttcctgagaaaacccttctccaggtttatgaagacatagaagctccctcaagtccattgaatgccccagtgcaagctgctgctggaggcaggtagtgacctggatccaggtcacctgtgtgtaatgggacagctggatgtatatttggaccagactccaaaccatgtgctgcaaggcagcaggaaggcagctcctgtcatgagaaactcgcagagccaaatgctcttgcatcctctccaaaatacactaaagtctttactgtttcagtttatgtgtttatgtgatgccattctctaaactagcggacaaatcacaattgcaccaactctagagttctgcacatatataatatagatgcatacagcccccataaccatacaattcatacaaatgcatacatacatacgataaaccatgcattctcagttatccaggcctctgaataattgaaggctaaacctttaaaaacaccccacctttaatagtgcagagctacttgtttgctgacactagaaaacccactccctccctgcttgccagctgcataccccaagcttaatctctgtggctgcatctaagccccatcgcctcttctttctttacttggattcctcaagggttttttctttcctagcttttctcatgcttctcactttcacatgaaaagacatgcctttaacaggcatgacaaaccaatcagatggcaatcgccctacgcaccacaaaatcttcaggcattcaactccactcaactgttttcatcacttactactcaacagttactctttgtagctaaaaaatgctttttggcattatcctggaaacctgagaagagaagaaggttgatttctagataatctagcctatagcaggatttcaagttcatttaaatctattgttatagacatattaagttctactcaactttttaaaacagcgtcacaccactgtaaactggatccttgctgtaaaatcaactttgtattcacttaatttattttaatgcaaggacgaatgtaggtgtggatacaatcacttgtgttattaaaatgatccaaaatttagctgacaatttactatagtgaaaattactccaaacttaaatcactgactagtacttactgtggcatgatagtttctatacatgggcatttttagtatctttgtcaagtaatcttccagttgtttctgtaatgcaaatattttagataagtgttaacatggtcatatttatttttaaaaattaaacagtagtgacaatgatgagatcatcattttcatcttaacttctacaagttattcaattatttattaatataatcatggagcaaggaatcctgaatagcattaaggtgttatttccatatttctcttgaactattatttaaatatcttcttactgtttaactttccatatgcttaggtcttctataaactgctgacaagccctattatatgtatatagctattatagcaggacttgctataagttgttttaaagcatttgttgatattaccaaaaactttcatttttttttcaattctaacactgaacttactgaaagatacactacaaattttaaacagcttttcaggaaacaaaggtggagaaaggttaaaagactttctagtagaatgtactgattttaaatatgctaaactgtgtgtggaggcagcaggggagtagagggatataggcttggggcactggagcaacatatgtcaatcatattgaccatgatgtaaaatccagcatgcttttgctgaatcactaagtgtcattttcagttgaattcatacatgtgcacacagtaaaccaaaactatataattttatatgtctaggtatcttggaaaatatttggtccagatgcctacaaagattttaaacaagatgacaactacaaaggagaaatcaaacattccctctggaacataaacatttcagattacaaaacagaactgacagaaattaacaaacacttgttcattttctagtaaaaaaaattaattgtccacactctgcagcacccatcttggaagcagagcaggcagaagtgcccctcctctggagttttctgtcccagtgctgtgcctgtctgtactccgtcagactcttctcaggccctaactgctccatctatagtttaggaatgagattttacatatatttaagatgggctattacaaacacggaaacttatgtatggaaaatattattttaaaagagtagatctcaaaacccacaacaatgagttcaatctttgactcacaataagcccaaggagattctagcagggagaacagcttcttcataatgtcaaggcctaaccaagaacgctcttcctcttctgagaaaatgcactgtatggcttggggaaagaagggactgcctaactagttccagaaaagctaaaccagcctggggatcaatgagtggatgagaggagttgtagccaggcctacttcacccctcagtagatgctgtgtttctacagcactgcaaaattaggtttaaaaccacagaatagtgaagaaacttactcttctaccaaggaattgttcttctcttatcatgttttcagatgaacggggcaaactgggcatctctcgaggctcctctctgacgttttgcctcctaaacgtgtgtctaaaacacaaacacacagaatgcaaacacctactagattattctgtgactatgactttagtatgtctttcatgagacggcatatttttaagagactatttaattgaaaatatctaccaacaatagactagttagccgatattgtgaattaaatacactttttatttatttattttaaagattggatgtactctgtcacccaggatggagtgcagtggtacaatcatgctcactgcagttttaaactcttgggctcaagcaatcctcctgttgtagcctcctgagtaggtagaactactaactatcaccacgtgccaccacgtccagctaaatttttaatttttttatagggaggaggtcttgctacgttacacaggctagtctcaaactcatgacctcaactgatcctcctgcctcagcctcccaaagtggtgagattacaggtgtgagctaccacacccagacaaaatacactttccattcaacttgtatactggcataattaattccaaaatggttaccttctagtgggaatggggatgcggataaaggctttgtacttgagcagctctctgtgaaattcttgaaaatgcttgaatttcctcttaacttgccatttaaattccccatgtgttaattcaatagtgtaaagattaatacttggtacctacagtgatacataaaaatgtttgatattttagataacaacaaaaattccaaaagctttcagtgaacaatatttaactagtaacagagaagtatacttaagtccagcctacttattttgtgtaagtacttaagtaaatttgtttcaaaagcagccaattgcagaaataatattctctaaatgttcacttgatgaattacataagacaaactttcaatcacacgagacgattcctacaaacgctgttcctccaacatatgtgcgtgtatgcatccacgcacacacacacctgaaatgaagaactaggtggaggagacaatgagaaaggccctaattagccttcaggggtccagtccacaaatataagccgtgcaccaggcaattggcaggggtgagacgtattgtatactaacagcaccatcttggctgtttttgttcttcagaaatggcacgacatgccttctctccttctcttgtgaaacacattccaaggtccagccttgtctataccacccacccaccctaaggaaccaccagtgttaaggaggggtgggtggaaaaagtgactgcagtaatgagtatacagtgtatacttgtataatataatacatatgtattattattactaaatctttgtaataaacctataatgtaagcactgttataccctttattcagaagaggaaacaggaacagagaggttaagtcactcattcaagatcacaaggcaaagatgaattaaaccatgcagtctgcctctagagtctgtcatttacccccacatgttattatctttcaatctaaatgctggcaggtgaaataagaaaacaaagctcatcttagagacatttctgagggagttgtgctcagtggtgtatcagggagacatggacccgagtcacagggaaagcctaaaccagaggctgacaccaaaatgagtgtaagctgggagtcagtacatgtgcaggtaggctgggacacagcaccaggcaaaaccacccagaaagcaatgcagcgcatgccacctccaaaagacaaggaggaagggaaggcaaagcatgccctgacagctggttattaatctgtgcttcccctgaggcaggaggcagtggtggccttactctgccatggctagatcttagcctgaagggacaaaggtcaccaccctgcagcaattgtcctcccccggagacttaacaactgcaaaatccagccaggaacagagaaaagtagctaccctaacagcttcttctagtccaatccatttcaaagggcataactttgattgttgaagacattttactccaaagccttttcagcgttcagtgaaatatcacgtgaatgaggactaaaggatggttttctaggaaccaatcagagaggcagagtatggctgcagaattctctcaacagtattttgaggtaatggcactggccgatccagtatcccggctttttttcttaagagccaggtagcaccaacattttcatgctaaataaacattaggaaagctaaaattcttgttgacttatacctgccatgcaaggtggaataaatatgcatcaagagtccaaatgaaacagaaaactggggagagaagaagattaagagaggcactttgcaatttattaaactgttaatttgccttacatgcctttttaaaagaaagagctttggctcaaatgaagaaagaggaatataagaatgaagattaaatgggaaggaggcaaaaacttgacaggtgaaaatgacttggaaatgatagatacataaaaacaaacaaacaaaaacctacaaacatgatcatagctaagagggaggaaaatgaaaggctatgtactaattcacatatattgacaaaagaaaaaagggtgagtccataaacgctctgacccttgttgtagatgtgaagcgttccacttccagaacttgtgcttttattggacagccggagagatacgtctgtatattaggctccttaaatccttgagtgttataaatagcagagaaagggatatacactaaaaaaaaaagtaaataaagttaatgcaatatatgattagcataacttgtcttttacaggcattcttttaagaatcacgtgttaaaacaagtaagcctcttataaaatgatctgagcccggtgttacatctgcaaggaaaatcaatcatttgctggttacttcaaatttgtggtcttccgaccaaccgagataaactcttttcttccccgctcagatcatccgtctttaccttcttgtatcttgggatcgctgggagacacgtcgtagtctacctcctctccctcaaagtggagttcccgcgtgtccagattttctatgatattactcatgtcagcagcaattttctgcagtgcagaggtatttacccgtggctcgtttttcagtgacatgttaactttggacagagtaaaagcaaaggggctaggaaagaagaaaacggttacaaagacttagcattttgataacataaaatgctattccacaatttgaatccagacttagatacagcatatggaaacaattcagcctgctctgtgtgagcctcagttatccaaaacaaccttttagtttacgttcctgtttaacatttaaaggattcctaacttgtaaattaaaacagagtgcttaattgaaaacaagagaaaaaaaaaagaaaaaaaaaagcaacaccacattgaatgccaacatttctctcatccaactttattaacttggataagtaattcaagggagattggtttgggaaagcttattcagagaaagaaatagattatttgctgtaataaatacagctgaagaaagaatatcatgaaaaataagcaactctaaatatttcctaaagaaaatttagagtatttcacatattgaaatatatagatttagaaatatttttatgatagcataatatttctacattttctctgtaggtgatatcccaagcaaagtgtatattacctcttcaagaaaggagattttggccatgactttacgtgaggtataatgacgtatgtgtcttgaaaggaaattgattaatatacctattccgaaagacatctgaggtgctagaattatacttccctcctttctttttctttaaagaaaaccagttctatttcattctgacatttaataacacaagtcgttgcacatcagtacccagggcagaagagttcacatggatattatttttcatgtaaaatattgagattcaagctttgcacactgtcatcagagttggatgaaacatctgttttgcctgatgtagaaataatctgttaaaaccaggccctagaatggaaggacgctcataccagtaactctttggcacatgttcctttcttactgcaaatcacaaacactgagcatccaccacatgtgagatgagatgaatgaaaacgtgaaggtgaataaggcaggcccctgtgattaaggagcacctgatatgggtgaggaaaatgaggcatctaacccaaagttcacccctggcctcctccaaggtcttaggcttcttgagaatgaaatttgcccaggggaagacacttagctgggtctctcctgcaggtgctatcaaaaagctaagtggctatatgggaaatgctaagaaagtctcaggcaaacttacacagcccttattataactcaatgagtctcgaaaacctatacttttatgtctgggagaaagagactgtgtttggaaattcaaaaatgggagcgaaggagggaggttctggtttggccagacatataaaattcatatatctaagttccctggaactatgtaatcaatcatgtttctttctctatgttgcctgtaagaaagcttggagccaaatttgtggcctactatatagccaagtataggactatctcttcccttcaactttccctcccacttctaatttatatcataatagttaatagttactaatgtttagaatgcacctcgctggtgataattgtttacatacattgtctcatttgtcattaataataaatctgtgagggcttgttttttctattttgagcatgacaggagtttgccatcccctctttatagataaggaaactgaggcaaagaaagactaagtaacttgaccaatattttaaacaatctgtcaaggtcacacagctggtaagtggtgaagaagggactggaattcaggtttctctaacccaaaagttgatattctcaaccacgacctttatcttgctctctattctttgtagatatgtaagtgctttggaatagatggaacagttaatataaataagtaccctggggcaagtccatgtaagagcaaaccctaacaggaagaattggaaataatctcctgcaactcggttaccacaggatgaagccatttaaattcccagggtctttgtttcctctctataaattgaggaggttgagccatttcatctctagagttcttttaacacgaaaaccctaactgtagataagagatgccataaaagtattcagcctcccttataatttaattactttaacccttttcctatcccaagagattaatcagagtagttttgcatttgggtaagagaagcaggtagcagaatgttttctaacctggataacttaattaagatctattcagcctccattgaggagccattgcccttggtcaaaatcaaaatatgtatgtcctttcctcttcattcaacaaacacttaacaatgtgtcagattttactttatttaaaatacaaggtaatgaaaaatttagaggaaaagagacaaggaaaaacagataagaaattacatcatatcattgcagcttgttaatttttaaagacttcagatattttttattgattaaacagacttattaactttgccaactttcttaacatagtgaagaaaaacaaaggttactccaaataaccttccttttgaactatgtgctgatcttaaaaatgcctgttaattttaagaaatacaaagactacagtaatctacacagtgttacagagccaatgcaccaagctgaaataaatatctgacttcagatagagaaaaaagaagcatattcacttatgaaaaacttgaagagtgagacatgaaacaaagaaaacatcttatcatttatcaagtgtttattacatgctaaacacaattttagcacagttatgttatttaatactcacaatgaccctacctggtaggtatgattattctgagagattgagttaaacaatcgtccaaggtcactcaacttgtgtcagtgttgagtttataaagcagattttgtctggctctaaaatcttatggagttggttacagaggcccataattacttttattttatgggcttgaatgtctataaatctaaattcatcttttatatgaagtttaagtcctgtgacaagacatgtcctctactttagtcaccataccttggaagggatcatactaatcccacagtcacctcaattatgaaaacaacatatctcaacagcttcctgagtttcttcttagccttttacttttatggtttataatattttataagatcatgtggaacttcaatggacccaatgcatttgcagacttgttcatgcttttgtaaagactttactatttaataatagacaatgaaagaagtgatttgtctatctctacctttacttatgtccatgggcattgtgtgctgacttttcatccaaccattgtattgttggtttcattcttgaatatcaagctgcaaaactatctacgctcctatgttgtcaaatcttcatttatcagtcaatgttttctttcatctaaaataatctataatagggggtgagcagctgccacaggcacagcctatattagccagcaatgggataagggcttcagtgtttacacttgagataatgcaattgattttgttacctccttataaaattatactgcaagatcattatctctttcagtaccaagaagagatggtgcccatggagagataagagcagctgtgttttatttctgtttgcatttgtatctggaaagcaaataagggtttttttattctcgttttgaattatagaactgaaaatctttgcagggaagatttaatgacctccagttattcagtgatgaaatcagataattttctattcttgattttcaacaagattgggaagtagaacatcaaagagaagcagatactttccttttcagataacaaatagataaacattgccttagccaaaatacaataataatatcaactataattattgatattaacataaatatgaacattagccagtatttgctaaatatgtactacatgccaggttttgtacaaagtgattaatatcatgatctcatttaatcttcacaataactttaggagctgggtcccattgttactagcatttttaatgagtagcttagagaaggtagaaacttggcagggccacacagctgggaagtgatgaagctggtgatcaatttgatctgacctcaaagcccagctacttgccaatccagaggtgggactggggtgggaggaaagatgggcactgggagacttttacaattttcttcatatactcttaaaacttttttttaaagtcagggtcttgctctcttgcccaggctgcagtacagtggtatgatcatagctcaatgccgccttgaactcctgagctcaagtgacctgcctgcctcagcctccagagtaactaagactgtaggcatgtgccactacgcatggctaaaaagtaaaacaatttttaaaataaaaacaacccacattcactctatgaacatagttacgatttacttattgctccctttctaacataatatgcaaaaattcatttttttctagctgctattgtacttaactgagataaataaatgcaatggattcctaagccaaaaattatatcataatgtatgaacgtaaaaaaaaattatgattagatagtttaaacccaaactgagttatggggatatcttgttttcccattttttcatgatgatgaaataaattaaaggatccataatatataacctatgaaaacacatcatacagcaactctatatctggaactgacttgatgctctctgagatataaaaattataaatgtggattcaagtactaaactcaatctttagtaatataatacgacttggataaatattttttgagtttagctgactttgaataaagtaaatgatattaacatattttacattccagactatatattttgagaaaatacattttaaatatcctctgatgtttacttggatctttgactttttttttaaaaggaacattgcttctgcaaatattaatggaaggtgattatgtaccttggacagaaaatgagatgtcaatggtataagggaaagatcaaatgacctagaattgttctatccttactatgagtgtaacctgggcaactaccagccccagggttgcagtgtccctctgtgaaatgttccactcatgcttcctcccttgggaagctgtgaggagcaaatgtgatcatggatactcatctacaggcaaaaatcatcttggttgctagtgtcatctttaattctattaaaagctgacccctgaaaaaataatcttaggagagtttatcctgcttttcatctcttatttagctcccaaaactaacataccatcttgcaactgtctttctggctgggctactctaagaatgggtctctgtcattcaaccagtcctgaaatttctggactgtactacactaagtataagagaaaccagtaagccttcctctgcaaaaacaatcatggaaggcattagccagtcagacccagctaatgcttccttttccctgcatgtcttcctggcctcatccaacctgctctccctggctggttatgcaatccttccttggcatccccatagcgctctccacttttctcacaacagtggctcctgctccctttgaggtccggcatcctttgcaactttgatgaaatctatgaacccacaaccccagaaaaaaatgagcacgggctcacacacagcattttgcatatattttcataggttcatggttgcactctcaagacctttaagtgaagaagcacgtccactgagccgcaatcatgtgctgatgcactgacacatctgtcttcccactagacagggacactctttggggaggagggttagagtcatgggcattcaccacagacacccagccgagcacccactcaatacgtttgttgattaagtgacataatcaatgagctgtccatagagaaagctgtcagctccaggttattcagtaaatgacacaaagagatattattttccctcgcataccacagacacactcagatgtagaagccttctggttgaaaagcccctgagaggcgtgtaacatgttagaaacagattggctgccaacgcaatcacagctaacacagcaaactgctagtgaagcttcctgtgtgccaggcttttgctgagggcttttcatgcatcatgtcaaatgatcctcacagcaacttcatgaggagtactgtcatcattcccactttgcagacagtctgacagaggtgaagagtcagaaagtcagtaagtcagctctcagcctggctctggctgacccaaaagccatgcacctgctcctcttctgccttccacctgtgcccgtgccaagaaaaggagattccaagacatggaatcacccagccgcctttcctgcccataacctgtgagtccagcttgctattatgtctatggttctaagagtcagaagtctgactcccaaacacagcccttccactgagctccacatctagtctgatctcagggagcccagagcccagcaatcttccacttacttatccttctctcctggttttatatcacaccctccacgtggcctaatgctgacgctgcttttatccctgagatatacagactggtgctaaatactttggactcactgtgcccacagaatagaagttgaactcacgttctctttttttcccctagctaaaaacaaagaaacaaacaaaaacacatctataatgacataaagcaaaatggttacatagctcttaaaatttccacaatttctgccattagctaatctcaactagtaagtatgtcattaggatacttctgataatgatctatcccagccatttttaataataacccaagaaaaccaaggcagctttatgccatggaggcaataagaaatcccataagacatcatggtttccagaaaggacaaccttgtagacagctgtttcactatccaatactgaattaggatataactcacacgttttggggcattaaaagcatttcttgattctcatgacttttcctaaattctttgacctctttggacgaccttttaaaaacatcctcggcatttgttctctggcatgagctttctaatttcctttaatatatcctagagttaaatatttccctctttgcagtggtgtcagcttctagctcatctcagtcatatctttgaattcaaactttgcttccagagtcaaatacaaatgttaaaggaaattgacatctatttcaaatgttgatggttaagaaaatatgatctgtcatttcctgagtgcctgtactgaaaggcacgttacaggtattacttccaatcctcacaacaatctcactggggccatgggagcttactgaggctgcacagttgtgagtggtgggactggtccctgtatgcaggcctccagatgggctgggtccatctgcatccctggcctctgctcagtaaagatccccagtcacaactgctctcacttcttctcctaatgccaccaacaatctcagcctccttctgggcaagagcagggctttggcacagcctccatggcatgcagcacagcacgtgggctccactgacctccaaccagaccctcagaggcactggcacatccagatgtttttggattcagttgaagtgctgcaccagggacgtgttctcttgcttcctcaggagttgtacatcaggggggtaagaggagtacagggaagcaagtcacacagcgtgtgatactgagaggtgacaacgtgctagcagtcctcactcgctcttggcacctcctcaggccatggcgtccacgctggctgcgcttgaggagcccttcagcccaccgctgcactgtgggagcccctctctgggctggcggaggccagagccaactccttctgcttgcagggaggtgtggagggagagacgccagtgggaaccaggctgcctgctgcactcacaggccagcgcgagttctgggtgggcgtgggctcggcaagtcccgcactcagagcggctggcgccaccggccccgggcagtgaggggcttagcaccgggcaagcagttgcggagggtacgccgggtcccccagcactgccggcccgccccactgcgcttgaattctcactgggcctcagccgcctccccgcggggcagagcttgggacctgcagcctgccatgcccgagcccctcccctccgcgggctcccgcacagccggagcctccacgggcaccaccccctgctccacagcacctggtaccattgactgcccaagagctgaggagtgcaggctcgcagcgcgggactggcgggcagctcagcctgcagcctgggcacgggatccactaggcaaagccagctgggctcctaagttgggtggtgacttggagaacatttatgtctagctggaggatcctatatgcaccaatcagcactctgtgtctagctaaaggtttgtaaacgcaccaatcagtgctctgtgtccagctaatctggtggggacttggagaacttttatgtccagctggaggattgtaaatacaacaatcagcactctgtgtctagctcaaggtctgtaaacacaccaatcagcaccctgtgtctagctcaaggtttgtaaatacaccagtcagtgctctgtgtctagctaatctagtggggacttggagaacctttatgtctagctaaaggattgaaaatacaccaatcagcactctgtgtctagctcaaggtttgtaaatgcaccaatcagcaccctgtcaaaatggaccaatcagttctctgtaaaatggaccaatcagctctctgtaaaatggacgaatcagcagaatgtgggtgggcccagataaggcaataaaagcaggctgcccaagacagcactggcaaccagctggggcccccttcaatacggtggaaggtttgttcttttgctctttgcaataaatcttgctgctgctgtttaggctttgggtctgcactgcttttattagctgtaacactcatggcaaaggtctgcagttttacttctcaggccagcaagaccacgaacccacccggagaaatgaacaactccagacgcgccactttaagagctgtggcactcaaggagcaggtctgcagcttcactcctgaggccagcgagaccacgaacccaccagaaggaagaaactccaagcacatcagaaggaacaaactccggacacaccatctttaagaactgtaacacttaccacaagggtctgcggcttcattcgtgaagtcagtgcagaccaagaacccaccaatttcagacacaatactagggcaggttaagttgctggcagatgcatgcctctcccctctccttttggccttggctgtgctgagcacactgatacaaaacagtcgatctggatgatgttctatgtgatggagcaactggctgctttttgtgggaagctatggccagccaggaaatgactgctttgccttcttccctgcctctcttctcttcctctcttttttttttttttctcctctagaattataactactcccattcaaccctactatgcaaccttagaggctctatacaggaaacttgagctaggatagtgttagaaccaggattccaaagcccatgttttgttcattgtttttttctgaaccatcctggctcctgcagaaattcatttatgctgaatttaacagtaatttttaaaaagcagacttgcatcatgtttactatgtaccaggcagtgatccaggtggtttgcatgcattaactcaatctgtccttacaacagacctatgaagtaactgctgttcttagccccttttaagcaaggaaactgaaggcacagacaggtaagtgactgtaagggtcacccaacaatctgatctaatttgctattatttctgccttgattaacttgggcaaagtaactttaggtggtgctcaacttcctcacctaaaaactgaaaattaaaatatctgttttacatgaatatgaagttgtctgtgtttaggactttacaatagatagattaaaattttaaaaactcctctctcaacattactaaatgttagaaaaacaacatattctaagtgacatcacccagaagacaaaaactagcccaaatgccaagggcatttagatgaggattccgagtcaacgtctaagaagatttattcctgcccctgtaaatgacaaggcacattataaagatttgtatttgaagagaaaatatgggaggattactcctgacttcaaagcctgttaataagtttattacgtgtaagtcagactttgtacaaccgctggattgacttaagtcaaagggaaaattcttctttataaaagaaaggtagttaatattgctaaaaactgtggtcagacttctaaaattaacatccttggatgttaaatgaatactcagtttcttcatggccaagaacggaatattcatgcattcctttctttcacttcccttcaaagcaacagggaagcaacctctgttggtgtgagttttggcagtacagagagtgttttcaatgataacccatgaatttcacgtatgagaagaatggatctggcaaactcacattgtaatctcctccaaacactctccagtgctgattagcttttgaattctgtcacaactgctagtagacatagcacaatttcaattttttggccatctatgtaattactaaaaatgtttgttgaggcagtacagtaccatggtagatatgtgattttgagtgaagtaacttgaaatatgactctccttatggtgaaacaagttatttctgtctttctgtgtctcagattcctaatgtgtaaaatggaagtaatattgcgtggcttagagcttgggctatactagatgctaaaataatgttagttgttcctatgcccctagttattctaagagctatcagtaagacccctgcccaaagtccatatattcctacctgaatcatgtcccccctaagcacaggaactagcagcaacagttggatttgggaatggtctgatgttgtccactatagaaaacactgctacaaacttctggaaacaaaatgaatcaagctaatacatatgctccatttctactgaaaacacagaattgttaggtaaattgtaattgttttaagaaaagatttattcaaggttaacagcagtggcagcagcaacaaaaacaataatgaagaaaaaacctacagtgtctaagaatgaagaaactaaagtctgatgggcacactggaactgaagctgtagggcccaaagggttctggatctcagataagcatctgagattacagttctgttgcctcacataaattttaggagataagatctcagaatcatgggaggcagcagcctggaagtgacactcttacaaaaaaacccagagcttcagcgagctacactgcctatttaaaagggactaaataaccacacccagcatccctgggaagaaactacatggaactgtggttaactacaaaatgaaaaactgtacataaaaattatccaagatcacaatgtctagctttcagtaattgaggtagtgcttttattagatttaccatcccacagataattacatattctggaatatatatatgaaactgcaaggaaacctacatttggaagaaagaaacagcattgtttttgtataagggctggtcccagaccatgtcaacttgagtgactaaaactcggatagaaagtccatagatttccagcttgaagaaacaaagaacaaacttcacagcaatcacagcagctgaaaagtgaggccagaaatcctagaaaggagagagccacagagagggagacagccccaaattttgcataggctgacgcttgaactacataggcatgggatacattccaatgcaactcagctagtactaaaatgactttaacagatatttctgctactgcccaccacaggacagatggggtttggtgtttgagtccaagcaagttaaatgactggaaaacaaaactaaactcaacaaaaaatcccaactctggaaagaagtataaaggaattcagagtctctacaacatgtcagtcacaatgtcacctaaaactactacacatagaagaaacggaaagatgtgctccattgtgaagagtagagaccaatcctgacatgttgaaattagctgagaaggattatttaaagtgactattataataatgctcaaggatgtaaaggaaaatatggttttagtgaacgaataagtagaaaatctcaccagagaaaagaaaaaatttgcaggatgggcttaacagcagaatagcaatgacagaagaaagggtcaataaacctgaagacaacaatagaaattatccaatctgaaggacagacagaggggaaaaaagatttttaaagaaatgaacagagccttagtattgtatgtgataatactttaaaaatctaacaagcatataatttgaatcccagaaagatagggtaaagagaaaatggggcagaaaaaaaaatgtgtaaagaaataatgataaaaaattcattaaatttggtgaaagaaataaatttacaggttgaagaagttcagcggatcccaaacaggaataaatgcaaagaaaattacaccgaggtacattaaagtcaagctgctgtcatgtaaagaaaaaagacaattttgaaagcagccagagaaaaatagcttgtgttcaggagaaccacactaatgacgataaacttctcattagaaataaatggaggctataagattgaaacaacatcctaaagcttaattaatgtggttgaattagtaaacaaaggttgcttttcctcaaaggaaatctactgattcaaattcctaagaatttcttacagaacctgacaatatgatcctggaatctgtaacagagaaattataataggtagataagacttgccctatcaggtagatcaataattattacgaacctgaaagaaataaaattttacattattggcacagaaatagatgaactgaaccaagtagggaccccccccaaaacaaacctattcaaatatgagttcttggcatatgacaaaagtgaaatgaaaaaaataatggagaaaaataaactgtttaataaacaatgctgagactattggcaattcagagaaatataaaataaaattagttctctacctcaaagctccaataagaatagtttccatattatagtcccaaatatgaacaacaaatatttttaggattaaagagctaaacatgaactacaaacatgtaaacatttgaaatatagaagaatgttcttaagaccttagagtcagaaaggaataaaaagcacaaaccataaaggaaaagctataaattcaactactctaaagtttaaaacgttcattgaacaaatgggaaaattacacacacacacacaaaatttgtaagaacaccagattgggagaagacataagtagaatgtataaagaactcctataaaaacataagaaaaatgtaaaaaatacaaagaacaagggccaggggcatatacaggtaacccataggagatcaattctaaattgtcaataaaactttaaacatgctcaacctttccagtaatcagggaagtcgtattgaaacaatgagatactattttacattcattggatcggaaaatttttccaagtataaaattacaatgtattggtgaggaaatggaactctcatgcactgctgtgaattaaaataaccttttagaaagtaatttcatggccaagcgcggtggctcacgcctgtaatcccagcactttggaaagccaagacaggcggatcacgaggtcaggagatcgagaccatcctggctaacacggtgaaaccccatctctactaaaactacaaaaaattagccgggcatggtgatgggcgcctgtagtgctagctactctttgggaagctggggcaggagaatggtatgaacctgggaggtggagcttgcagtgagccgagatcgcgccactgtactccagcctgggcgacagagcgagactccgtctcaaaaaaaaaaaaaaagaaagaaagaaaattagacaactgaaaatatccatctatcagagaataggtaaatgaatgttttaaatggaatgctatacagcagagaaaataagtgcattagaactacatgtatcaacatgaataaatgtcaatacaaagtttggtgggaaaaatccagcttacagtttttgtttaggatttaaaaacatagaacaatcctgttaggttgtctatggataaatatatatggaagtatgacataaaaactaattgaggaaatgatacacaataactttagaagagtggtaacctttagcaagagaggtgggaggagaacgcagttagcaaggagtccaaaagggactcagtgaatttttatttctgtggtctctatcatacaaatctgacattttttctggctaaaccgaagttatctatttgcagctctttccctcttgctgagctgtaagctctttgagaactcagaatgacaataaatgaaacttgtggccagacttcccagttacatctccatggcaaacattaatctgtgatcacagcctactttctctgagcctgcacagacctcctagttcttcttaccccacacttcagaggctttaatatcttgccatctctgaaagaaatcaaatctgatctctctcatatctttagtatttgttgagaagaaatgaattaaatgagggaaatgaattacataaccagtgggcagtattttactatatgtgtgtatgtgtcttagaaagaatagaaattaatgcaactcaattcaattcaaaacctgtatggtgcacatatttggtggcagacactgagtaagaactgagcatacaacttttagactgaagaaaccaatgaatacaaaacctggtctgtaatgcctggcacacatgatgatctaggcattcatttggtccaacctcttcaatgcactgagaagacagaggctcagaagcatacagacaaaggattgatgagactagaactcacacctctgttgcactctgcttgcccatacaagcctgtttcaggggtggattatttctttataatgcagctttgaaccatgtctgaaatgtgtaagaaagacaaccagatgggctggataaactgcttttgtctgagctgcagccagactctgctcagtgggtgtggacaggctgccagcctcactgagaaagaactagtttggtctttgttcaaccgctgctcctatgcatagtactaaggaacagagatattctcaggacacctgaatcctgtgacgacattcccaagggtcagaagcacatgggttgcatcaatactaacaagaaatggcaagttaaaaggcaggctgccaaactttgacgaactggaaagagagtcggtgtgcaccagccagactgataagccaccttgctttccagtgcagccgctttgcagggcttcttaagcagcttctcaggatgacagtagttcactcaatggatatttattgaacaccttctatgtgctgagcaccatgctaggcactgagaatataaaataacctcatgcatttcactttaccatgacaagggaggctttaagggcagaatctctcaatgtccctcaccttatttgtgattttgactcctttcccaccaaaacattggaagaagacccctcctctgcctctcctgtctcccacctttgcttgtttccaaccgtcctctcattatttcatcagtcaactccctcatcaacttctcctgatcctgtgactttcccctattaccacttaaaacattctcaagtatctcaattacacatatgttcccttctaccgcttctctctccctgtgattcatagttgaggtttttgtattacgtttccctgctcagctggactgaaccaaacatgctccatgctctccaaactcagcctttcaataggctgctccgtctgcagctttgcgttcctccaaccccatctttgcctgattgattcctatcatccattgggactcatatcaggtgtcacctcttccagaaagcctcccctgacagcccaggctggtttaggtgccttttctctcagtgtttctatggcatccaagtgagttcattgagtacactcctttccacttggtctctgactcctctggaagactgagttttctgaagggagaggctgtctctaaatcctgagtcactggtgtctattgggttctcagtcactgtttctgaatgaatcaaatgggaatgaatgaatatgaataagacttagaactgctcacagtttgggcagcacaaggaacatgtgtgtaatgctttctgggttacaaagcattctgtacacatatctcttaattttcctaataatcctacaggggaaactattatttttaaccttcttttcattgaagaagtaataactcaaagtgattaaggtcatactgtgaaactgttggtctgagactcagtcctgacccctcaacttcatgttccctgctttttccatctcctgtaagttactgccttcatattcagatgtatacaattctccataaactatcctcatcaaaatctcatatctggaaaccagtcttctcaccttgtgtctaaccaaactacttattagaattgaagataagtcaattctggctaattttaacaaaagaagtaaagctagaaaaggaaataatacaaccagaacaatagagataacacttccatttttctccagtgtgatggatgaacataaatattagtgatattacatccttcttccaagtggcaaaacatctcaaatgtagggcttatgacaaaatgaccagagatttgccctgtgactcgctccttattaaaaccaggaaatctccatcctatctggtgagacagctgtgcaggcaacttttatccaaggtcacccttgagactcagctactactatatctccaacaaggtgttaactcgccaccagctccttctagacctcacaccctgttcatccaactgagagcatgcagtccatctctgactcttcatttgcccaaaaatctctgcttgtatgtccttcttttgcagtcatctggagaaattcaatcctgggccacacgaactatctgccttcttggcacttaccccaaggcttctaaacaggggctgcagaaacagcactcaactacatagactggtatttatggggctttccagctatgtctctcacccccttttcaaagtcaacttcctaagaaagttgtctacttcctccttctagttcatccctcctccttctttaacttgctgccactggcctccatttgtacactccaccaaacagctctctccaaagttcataaccacctgcatattccagaatacgaaggacacttccccattcttatctcacttaatctttctgttgcacaacccttgactgcatccttcttgagggtctctttcctcagcttacatgttctcacactcctctagttttcctcctccctctctgccaactgagatgaagtcttctttgatgctgttcttcttgtgctcaaaatttacatgctaatattattcagggtcccaggattattctttctcactcttctcagggtgatctcatccactctaatggttaaaatacatgctgatgtttcctttactcagggataccactagtgaatacattcctttcctcttggcttctgtctcccctaaaagactgggagctccctgaagagagaggccatctctgtattgcccatcactagcatctactgggctctcagtaactgtttccaactgcgatccttgtcctgatcttcagacctatctatccagctgcctaggaacttccccactgggtgatcccatagagcatctcaatatgctcaaaacagaattcatcatcttctaaccacaaaacactccctcttcctatgttttcttcttgaagaaaattggaaacatcatctacccagctgcataaaccagaatcctggaactcatccttagcaattctctttcctaactctctatatccaatcaattaataaatccagccaaattctaaatatctctcccatctgaccactgtattttaactccataaccatgatatgtttgaagaaatgaaaaaggtgcagtgtacctggacatagagtacaaggcaggtgatgttaaggcatttagactttacctttccacccccttctgccagagtggtcttgatgctgtggtcctagagctaaaaagtcttcagtaaaaataagtttgggctgccccaaatatgattttgtaggataagtaacatcacttttacttggttatttttaattacccagctaaactatggtattctatcacaaatttatattctgctaaacagaaaaccagctctctataaagttgctacagggaacaatgatttccagatgagtttcagctgtgtaaagtaatgccttaatgggaccaccagaattctgtctgtcacatttaagaagcaatgcaatatttaaggtaaacaagctaaactggatgtgtgtcgacggtgaggttcggggggaagaaaggatggaaggggtaatgaagaacatgccaggcttaagaatgcataggcatagttgacagattattgattcaccattaaaatggcattaatataaagtgaataaaaacatacgatgtaatcaggatgtgccttaagttagtagctgttaaaaagtcattgttatggtacttacatctgcccaaaactataaatagtggcaaaattcattaaagaaatgttaatacagaggaactaaagcatacacagtagaaagagaagggaacaacgtgctagcaaaaatctgcaaagacaactccgtcaatacactaaaaatcttgaattgttcactttcagtgggtgaatttcatggtttataaattatatcccaataaagatttttttaaaatcagcaatggcataggaataatgacctgagttgtaaaaatcaatcaatattcaaagaaagggcaggtaattttccttgatcccatggcagaaaaaccagaggcaaaaaccatttttacatttcttataacaaaaatagacaaattgcctatactaaaaagaaaaggggaaaagacattgtcaaaacacttaaagaaagcaatctaccgacgtctacattgaatattactttaattccactgttttcttctgaagactctgctcagtgagataattatgttttcacaaacacagaaatcatactgggaactattatcgtctttaaaaaactacaaaagtatgtgtcacaaagaaaactattgtaagttcagagaaagtatggaaggctcaataactagaaaaaacaatcagataaagaaaagagaaattctgggtcagtgatcatttcctttttaagacagggttccaaaaaaatgtagaaaagatggacacaaagcaggaatacccagctcctcaaaggcacacacacactcatgctgggcaattgttggaaaagacacgggatgcaaaatttttagtctctattagagaaacaagttagctcatgtgaaaacagagtccttttgaaatcactttccggatttcactttcagaaagatagatgccaaaagtggaaggcatgtatatgctcagaatttgatctgccagaataaaaattgattatacctgcctttgatatcattcagttctagttacccaagaaaaagtttcagctgataaagaaacgaaacaaaacaaaatgaaaacctgccctttgatttccatcttcagagatacctcgctcaaacacaggaactaaatgtaaatcacttggtcttaaaagtcagaacatgttcaattcactgattcagcacatggcttttacttaattaaagctggtctgaaaccagctttgtttccttatagctacccaatataagaaatagccaatgagcatgtggacagaaagggcactggccctggagtcaaaagttttagatcttagctcaactctggggactctcaaataaaccaattaaatctcctctgaaattaaagagctggcttttaatctttccatctctaccttaacatgccaggcatgtggtagatgttcaataaatgcttcctggattattactactaatagctaatagttagcaaacccttattaagtatgtacattatattaatcatcacaataaccctatagtgtaaattttcatattatttgcatgtcataacttcagaaactgaggtttagagggattggtcatgtgctcacgtgactcagctggtgggtggcagaaagatgaccgcagggcccaatttcttaatcaatgtgcactgccccctatctgaacttaactggacactggccaaagtaatcatagtgatcaatgaacaaatgttgctcctccatttaatctctgttttattgctcacctttccccaccatctgtctctctgggactgtcgacaattaaaacctagagatccttgctactgagagtgtggtccatggactagcctcgtaggcatcatccaggagcttgttggaaatgcaaaaccttggccacactctggaaacagaatctgcattttaacaaaacatccaagtgagccatatgcatatcagcttccgagacactggtttagactagatccaaagtaaaacacttccttcatgataggaggaaagaatgtccaagaaggaaaatatgacagaagcgttgtgcccagagagaacaaaaccagctggctttggctgtatcaggaccttccttctcctggatagtgacatatggatatttgtaagtcaggacctatgaagatccccagagaactggtgacagaagcaataactgaatctatagggagtgtatctatcattctacttctctctgaaatttccaaacctgtctttagaagcatgtatcatgtagcaaataaaaatacattaagtctttggcaaatacagaatcactcatcaggcaaagtagagctgccctgtggattgataaaactcaacatgtgtatgatattaccaccttccttcacaatccagcagttgcttcttgtcaaggccactttttccttttaaatattaacacaattttttttttagcacatatacaacactaaggctaacaaacgagcttaaactggatttaaatgagtttttttcagtaaggtttatggttttctttttaagcggtatgccttattcaggcagaaggtcctgcatttttggctgagaggtgcaggacagtagctgtcctctcacaagagagttcattttgctcaataactccacctataaaagtcatgcaaataatggaatgaagttatattttgatgatatccagatactgaagatactaattactgaagatactaatttttttccttttcattcaagaaagataattttacacttattctttgaaagagaaattctatggaattttcttcttctaatttaattccagaatacattctctcaaccctatgccctcatactagtaacttgatggttagcgggtaagtaggtagtagtagaagaacagaaagggaaatttggggagcagaaaagggagaaaaagaagaaaagggaaccttctagtttcctaatagaaaagctagagaattccattcctgaaaattaaagatattttacacgtttgtgtatgtacgtggctttgtgtttatacacataccgttttgtttcatgtagcataatcaaatctattgctaattgtttagttaatatttacttattcaaacatctttttaacatcttgcccaatattcaatttacattttacttagcaattagcttgtctggccacttgctgttttacttcttttcttaacaaaaacccaacactgatgttctaacagaacagtcttactgtcctttcggttattgtcatttctcttgcttccccaagggcagaagctctgctattttgcttgcaaaagcaagactgatatttcattgttgctacaaaagggtcaagatagagttatcgaaccctaataactccacctataatagtcatgcaaataatgaaaggaggttttagtagaagccaagaagtatatttgacttttttatttattcccgttttaaaaataaattacatttattttttaaaattacatttttacagatctacacttcctagaactaagagaatgacacagtatacaggtagaaattctttcttttattgagttttatcctttttgtgatttaaaatctagcaggtggtttcttttccttaatgccttcaattacacattcttcacactttctgctatcactttccctgccttcatctagtgataactagaataattagaatggatttcttgctaatcaatcatctaggtattatcttctagaaagtttgcaagacatccctccttcaaccaccgtggttctataaaaagaattgcttttaattctcaacactcttattctgttactgtcatgagacatcctctagtttcagagaatttctataaactgcctaaaataacctaggattttacaatgatggaaaaggaagaaagtgagcatgctcaaagtcagaggatgagagggaagcacagcaaagtctggggcagtgcaatccaaggtgtctggctcaaggcggagtccagaggccactgcaacctggagacacatgttaattaccaagggagcacctggcagggtaactcaccagcctgagtcagcctaggatgggagcttaagggggacctgaggaactccaagagagaatcacatgcatgagttttccacaagggacccaagttcccagcccaaatgagacaagcaatggatcgtattaaaagctagtaacaattgtgctgaagcaacctcttgctggtggcattgttaatggagacaccattctcaggcaaactttagtaggatatttgaagagcaacaaaagcatttatactttttgatcgggtaatcacactgtaaaaatatggggaaagggacatacacagagttgttccttgctaaataaaagagacaaaatttaataagataaatgtatacatcttcatttaagtttaaacacacgtatacatgtataggctggcagttgcctggactagcagctattcttgtgagaaagccctgggaattttggatcagccaacatcacagcagggctacttgggagggagcagagcaagtggtaggaacacactttatagtcaggcaaagaagggtctggatatccccttctacagaccatggcaagtcactcactttctaatacatccagccatccaacagttaaaaggcctttgaaaatgcagagcttcctaaaaaaggagatgcttcatcagcccctgagtttcctagagccagcactctccaggagagcctccttggtctcagaaaacacacgctggcatctacctcaacttcagaattgcacacctgactcttcctcctccagacctaggcaagacctccaccagagcaaaaccagcaaaaagcaaggagaagaaggtggttttaccggggtgtctggtgctgtaactatgcacaagggaggcagactcaacttggatggagaagcctggaaaattcaaactcaggtgtcaagaagcagtgtttcctaggatttacagagtgggaaagtattaagtctagtgctcagagtaggcacgtggtaagtcctgagactcccagataaaatgaccagcacctgggctcattctgtgaagaatgttccagttgggcctataattaatccatttaagatgtggaccagtttttatgaatcacaacaaacccttggtaagatccactttctttcctttagatgcaggccagcctctttgtttcccccgttaacacacattttcttaaattaaccctctatccacacattaagaaaaaatatctatacatactccatgaaaactgcaaaggtctcagattaatacagaaacgtaactttggactctatcttcttatcagcattcatttgaacactggtattaagtttactgtgaactttatcattcaaccatatgtaaaatgttacaatcattttatttacatttctctgagcaaaggtggtgggtatcaaccttgtccaacagacgagcaccttacttacatcaggatattagcagacaccaagtgaaaatgaatgatgcagtaaccaagtgcaagggcttcacagtcttattccccagatgatgctacttttggtctaggagaagccataggctttttggtcatcttcttcagccctcagttaatcaaggtttgtctacacattttatatccaaaaacatctcttatagttgcaaactctctaaaatcagatatagttaaatatccacatgaagtaagatcaagttccctcttccactgtattgagaagctactaagtgtcaggggctgggatggggtttaggaacacaagctaaacagagctctctctcaggggctcacaagccaggggaggacacagtgaattctcaagagtgtgaacagaagtgtagcggggacccagaggaggagctgctcaacatctgggcattggggaaggttgccgctgataaagcaccttggacaggaatcttgaagaccaattaggagctcacgtgagtggaaagcccgttccaggagagaggaaggggtatggtgggtcggactgtgcaatctaaggaacaatatatgcatctctggatgtctgagcaagaaagtgagttaggtgaggataatgataattgttttcagatatctgaaggactagcagattaggcatttggttctccatgtagaagatattactagacttgggagggtaagggggcagctataagagtgtaaatttcagtttaacatgtgtgagaacattctataaaacagaactattaacaagaaaactagttgccttaagtaagcaattttacttcctgattacatagttttggagtcattttggattctaattctaacttagctcatagtaagtgcttatgatacatataaatagtagctattcatattgtgagatggtgaactcactctcacactctgagttccagcaccataccacagcaaattgtcttctatggcaaagtctcatgccccagtgtgagtgtggaccagaaaccatcgaaggtccttcccagcctgggactctcatttggttgtctctgctcatttatgatttggcattattccctcaactcacatggaaagacactgaaagaaaggtttattaaaaacatgctatagaccaggcatggtggctcacacttgtagtcctagctactcgagaggctgaggtaggaggattagcttgagcccaggaggtcaaggctgcggtgaagtttgatgacaccactgcactccagcctgggcaaaagagcaagactctggctctaaaacagagaagaaaagaagagaaagaggaggggaggggaggggaggggaggggaggggaggaggggaggggaggggggaggggaggaggggaagggagcggaggggaggagaggggaggggaggggaggggagagacaagacgaggagaaaaaaggagaaaagaaaagagaacctgctgtatacatgttggctatcattactactgttattatttcctctgatattatctttctattaacacaattattcctgatccctgattttaatgttttattcttgggtgtatgtatgtgtatatgtttaatgttatgcaaatattcttgtaagccaattcaaatccttggtatagcataaagtcataaaaatagaataaaataacattatacagcttattttctttctttcttttttttttttttttttttttgagatagagtcttgctctgtctccatgccgatgaagttgataggtcttcctaggaagcagtaatcagcctaccacctctttctcagacatcattaggtaaatgctgaatggcattagcgtttagtttttaccaacctaggagaaatggaaatataatttcatacatcattactaaaatgggtgatcaaagctcactgtagcgttgaactcctggcctcaagcaatcctcccacctcagcctcccaaatacctgggaccatagtcacatgccaccacgtccagctaattttatttatgtttttagtagagatggagtttctctatgttgcccagagtgatctgaaactcctgggctcaagtgatcctcttgcctagactcccaaagggctgaggttacaggcatgagccactgcgcctggtctacagtttatttttgatgacacataagaatcactaatattcatttaacacttataatgtatggggcattatgataagctttttatatacattatttcatttaattcttacaagaaccctctaaggtaagtacaattattatccccattttataaggcaacgaagttgagtcttagagaagtcatgtaatttgctcaaggtcacaactaataagcaatgatctaacccagtaattttgcaacatggcctacaacacactcacattaatgagtatgtacttttctttaactttgaaaagttaaagagttagacactccagaggccaaaaacaagtcatttaatccaataaaacagttggcagcactgacagagttcatttggtcttaatctcacactcaggacactgttgggaagatggggcctgcagagtaaccaggtcatgtttgtctacacggtctttgaaaatcaaatcaaaattttcaggattctcacatattgcatgattccattcatatgagatgttcaaaatgggcaaatcaagaaagaaagaaagagaaagaaagaaagaaagaaagaaagaaagaaagaaagaaagaaagaaagaaagaaagaaagaaagaaaggaaggaaggaaggaaggaaagaaagaaaggaaagaaaggaaagaaagaaagaaagaaagaaagaaagaaagaaagaaagaaagaaagaaagaaagaaagaaagaaagaaagagaaaaagaaaaagaaaaagaaagaaagctgcctagagctaggggaggaaaagagagaggtagggaggatgggtacaaagtctccttttggagtgatgaaaatgtttaaaaaatggactatagttatggtcacacaactctgtagatattcaaaaaaccaatgaattgtatactttaaagggcttaacttgatgatctgtaaattatacaatatcaataaagctgttaaaaaacgatttccagagctcagtatcaagtgttctctagtcactccatgaggctgccgtcttccagaacaaacatagtaaccagatgtgtgtaaagtaagcttgtacccaagaacaaaatgttccaacaacaatgatgagagtaatgagcatgctggtgaagttggtaggtcttcctaggaagcagttatcagcctaccgcctctttttcaaacatcattaggtaagttctgaatggtgttagctttgagtttttaccaacctaggagaaatggaaataaaatttcattcatcattactaaagtgtgtgaaaacgagcagaatattataaagagcagcagagggggaatcaaaggaccccaaaagcttccattcgaatctactacgaccttgtagacttgaggactcaatcattttgggcttcagtgacttgatctgtaaaatgaggaaggggaagtatgaagtcagctactctaaggttttcttctgtcttcagcattccagtcaaatcgtcccttctaaggattgtcttggtatgctgacttgtccctttcatcacatcatcaactgcgtttagaccaaagaattgttatccagacatctggacatattgaaaatctctcaaagaatctttcctggactgatgtttcaggtatttacatgaacttcctccgtatcctttattaaatacactatctaccttatagtttaattagctataaaaacctaactgaaattttaagcttgacacagaaaagtcaaaaaggtgtttcctaacatgatgtataagggcagcaatataattgttctccaaagtaaaatgattctgtcctttataaaaattcattttacctcaactctaacctgtcacttctaatcaattttaatttttattataaaaatgataaattctcatctaagaaaaccttaaatatatacaaatttgaggaaattaaaatcagttttagagccaataccttaaatagattaagagtaatgttagtctactatttctactattatatgttggtatagtctcacttttttctccatgaatagtttttcccttttttaaaatgaatataaagtaatcatgtttaaaataccaatatgtagaaaagtataagaagaaaatataaatcatcagaaatcccaccttcaaaataacccctaaatccctattaacttaaggtgatcatccgttctattgtctctgtaagcataacacacacatagagaggtatattttaaacacattcagatgtgtgatggagagatagtttaatatccattatttttacttaaatatctatcatcaccatttcctcctattacaattttccataaataaaattgtgatggtccgtcatgcaattttcttctgctactttatgtttttattatttgcaacttttcatggtaataaataatgcttcaattaacatttttatacttaaagcgtctacactcctacctagaaaatttaaatctattgactttttccttttgtgatttcctctattgattttgggaagagaaagtgcttacccattcaaagatcagaatttttattttttcgtttcttttctttcttttaagttagctccttaatctgtctgggttatcttgttctatattgttaaaggttctaaacttatttgtaacacgtttaaattttagccaaattgggtagaagttatttgcccaatatttttcaaatgcacatttatgtcttttaaaaaaatatatgtctcataatcttggttatccactaaacttaaggaaaccttcaagactgccaaataaccagagctttgattactagcaggaagtcatactgggcagaaataaagaggacactcctactggccaaattaaaactaaacaatcagaaaagtccaagttcctagctttagtggctttattattttagccttaaaaagtctctaaaatcccaaaagtagcttaagtgtttaaaagacagtattcaatgcagtgggctattctccatacggcctggccactactggtctcatttacgggccatgggcaacctctatatcctgccattggtcaccaggttcttgccactggtcacgagcagagtaggtgagaaagtggagcacaagcttaccaacccaagtagagaaaggacaccaatggcttgccttgctggttgacagtaagtcaacagagcatcttctaaatgaagagcagcacagatgtcagtatctacatggttgtttctcaataataagtactgggttatattggacataatacaatccaaaatgtattaggttgtatttttttcttatatttttctaatattggattctattttcagttcttccccctccacagcaccttctgatgcacaacactgtcatagctgcctactagttgctctgacttaggtcaatctaactttcttgaatagtttcctcaactgtaaaatggagataataaagaaaatcaacaacttaaggttgttgtgaggattaaggaaaaggcttagaacaggccgggcatgtttacaaggctcatgcctataatcccagcattttgtttacatggctcatgcctgtaatcccagcattttgggaagccaaggtgggaggctgacttaagaccaagagtttgaggttgcagtgagcagtgatcgtgccactgcactccagcctgggcaacagagtgagactctgcctcaaaaaaaaagagaggggggctggggcttagaacagtgactgcacttaggaaatgacttttatgtgttcattattattattattattattattattaccactattctaccacttctgctatgactattactactaactggggtagtactactaccccagaaatgctgggtcaaacttaaattgggttcttcagaatgaaacaggcaactggggagctctgtggtcagatcagctccaggagtatactctatcctcaacttttgcaatccctctgggaagttaagtatttactgacattactaaaatagtgaatttccagggtggatggcatcacaatctcccacattttctggtacgtaaccataagacctatgtgcacacaagcacctggttcttgaggggggcaagaaccaggaggttaggcatggaaaaggcagatgtggcacagttcattttagtcaatacatgaagctgacaaggctataaactgcagatgaaaagcctgcacctcccaaaccgtacgctgcaaagatcaagactatgtgtgatcacacaggaacaaggagtgatctgggctgtgaagaacggaactggtccatcaggtgaaaatctaccaaggttcgacggtcagaaaattcatctctaataccactactactcctagttcttcaattctttcctcagagtcctgatcttctactgccatgcaacttcctcaacgtttggggcgtagccaattcaagttaaaaaagtttgcctaagaatttctctccagctttgaaactcagattcattttataagaaaattggcatcacgcccttctgggtcacagcgaggtccataaaccatctgagatgtgtgagacatctaagtcactttgactatcaacaagaaagcatgttggataaaaattaattagcacaaaactcaacttaaaattagatggtatgttatgagacaaatgctcatctcttattagccaaaagacccagatataacaaaattaagccagtccagcagaatgagagcaagaatgcaatgtgtgttccaaacctagaatcaggaataatctaaggtttgcttagacactttaccccaaatttacagattttgaactctctactgtacagtccttttttttctcccacgtttggaggaaacattttaacgtgtatattctctgggaaaaccctaaaatctggtttttagggagtttccctcttatctaatcctttgccacattatttttgtttcgaatctgtggtctttgctttgttaccatctctagatgaaaagctatgaagcacttgggaacacagaaactgagatccacaagatacaaatgagtttcatgtaagcttttaaagacctttatctgtacccatcaagcacaaacaagtaatcaacgactaaaatgtcttaatatttctctctaaaatcatcaggcagctacaatcaggtggacaagtcgttccttaaaatttaatatcatttaataattaataattgcacaatagcatatatgcgtagtaatagcatatatatggcatgtatataaaacatagcaaagtcatagcaatctttgcacttttgggaaagctaaaatgatgtaataaacttactgttaaagaaaatatctacagaggcaggggcaataacacagctgtacaattgtgccttagggggtataaaatacagtccactttgtaatcccgaaatggcatgcagccataacattgtaacttcaacttagcactgatggggaaagggatccttaaagtttagcatatcacctcagagatcttttttaagtacctatttctgtctcccttccccctcaattttttttaagcagagaagaacatgaaagaacagaccctttctaatacactgtatttcgcagtggggaaaaaaggagaataaaatggcaataacagaagcatattagcatatttaaaacactagtacattaccctgaactaaagcatccttaaagtaacatgaaagcaagagaaactatatttcataaagtgttgcaaactttaaaacaccaaattgaactactcctatagaacaatttcatgccagattgctttggtggcaaattaataaaggcagaattgctctttagatctttaaattaacgagattaaggaagacaatgtctttctctgtgcttaattatattgacttaatttcttaattactattaactatacttttatgttttacaagtcacactccatttttacagctgttctttaatcctcgggtaatctcgtattctgaagaatcacttgagaataaaaacagcaaaactgaagacaaaattcaattgggcttaatccacctgtacattctgcctgaatcaattcttatgccagtattttgaggcattccagaaaagtgccagacttttcaaagagaaaaattaaaatgatattctggttcactgaaactccaaggagtaggcctgaagaaaaaccgtgcatcagacaagcacgcaccagtggggtgagggaggacaaccccaactggggcccaacactccactacttaacgtttcaaaaaataaaatcaactgtgtataaaatcatatttatacctagaaggtctagtgcgacgacacaaagaaagcaattataagaaaggaactaggctaggcaaggtggctcacgcctgtaatcccagcactttgggaggacaaggcaggcaaatcgcttgagccctggggttggagaccagcctgggcaacatggcaaaacctggtctctataaaaaagtataaaaaaaaaaattagctgggtgcggtggcatgcacctgtaatcccagctattcaggaggttgaggtgggaggatcgcttgagcccaagaggttgagactacagtgagccatgatcattcaactgcactccagccttggtgacagagcaaaaccctatctcaaaaaaaaaaaaaaaaaaaaaaagggggcgggggcagggctgatatttactaacaagacctctggactgcaaatccaacacagatactaatatgtcatttccacttggcttccagttgtatttaatatggtcaaaaaatgcatatattataaggagaaacataaccccctaaacctctgcaggataaacgaactcacattattttctaaaagaacgcagcaacccagtctgtcctatcatcacaccgtgagctcagaaagaaaatctgacacacgcagcagaaagtgcaaaatgttatttactaacctggtgcccctgtgaaagcagttgctccatatcaccttaaagaaagaatccttactatgaaaccaatctccaaggcagctgatagccaagaggtggcaaaatcgactaccctgagaatccaaataaacgggcaaagccttcctgttcccaagcccagttttggctgactccctcaaggcaacttaagtcatagccaagcccacaaagcactttagcctataagctttagtaatgaacttgaaaccactccccatatgttaaagagacaccggactgctgtgagaaataaaacccacatacagaatgagctacagcttcaggctgcacttttgtacttgctgcccaagaaaaccataacacaaacttaaacaaagagaactctcactcccttctctcccctcagacactgcaataaagtgaatgattaattttaagcaaggggatacagtctgccctccattagggccatgaaatgacttttatattgttcaagttgtgtggcagttatggaacagatagcactgtaatttcacattgcataagagggacatatgaagttatcatttctgagaatcaaatgtagatagtattactattttcagataacattgaataagcttaaaaacctcatcaaatccaacgattaacataagttcaataggaaattttgtcaaagaaccttctaacttctgattctgacttagtgtctataaatcttaaaaacattcttataattcagtttcaccacctacatttagaatggatgtataagctaagacacgtcttttaacatggatctttaagctgccttttaaaatggaacttaataccactcactaagatttcaaaataagaaatttatgtttcattctagaaaaatgtagtcaatcaattccttaaagcagttagatcttaaaacagagtcagtaatgttctagcatattgttagaacatcagctttttaacacaatgtgttcacagtatacttattttcccctagttttcaactccaagaacagttttaattctaatggcttgttgccatgatttgtattttgtttaaatgagacttatttcaacacaataaccaaggtttttgaactttaattattgtttctcctaaaccataagattggaccaaatatgcaggcaaagcttgattcacctgttgccaaactgatttacatgaattactggtaaaattcaagttactcaaaacctgtgaaatataagccattagctcaacaaattcacccatgaaaatcctggagactattttagatctaatacacaccttgcccacccctctacccactcccaggtcagggctcaagaggatctcatggggtcaccatagaatgagggggcaagataatttcttttctcagggaaaaaagaaaacgagcctcaagacctgtggctgatgactttaaaaggagctagtaccccacctgctggcaaaaccaagcgaaagctggatgagctgaacaaacctcaggggaaatgttattactttgatgttggaagaaaaacagagaaggagcagctatgcgagcacattaatgtcacattcagtatgtcgttaaatattattaaatttttccccacaatagtgatatatttctagaggatataaaaatgctcatgcaaaaaaagtagattcaaaaccatctattttacatggatctggtttgcaaacatatatgatgatttgcatgcccaaggaaatcctctgataaataatattgatctctcctctgcagaaagagcttcaaaaaatactcctgggagaccaacacaatctttgaaatggaagaaatatgaataaatccccaactcagctagataaactactggtggggctgtgtctccatcagtctgtatgtctgtattcccagaatttctcttatctttcagcaaaaatttatttccttttgccacatataaattaattcttctaaaatgaatatctgatattaaccttaatgaagatgaagaaaagttaagtggtgggcaccaaattacactacattctttaataaaaccccgcaataataagagtatagcaggatatgacttttaaatgagcccaagctgtactactaaaactaaaatgaggccaggtgcagtggctcatgcctgtaagcccagcacgttgggaggccgaggcgggtggatcacgagtcaggagctccagatcagcctgaccaacatggtgaaaccccatctaaaccccgtctctactaaaaatacaaaaattagccgggcgtggagtagtgcacctataatcccagctactcaggaggctgaggcaggagaatcgcttgaacccgggaggcggaggttgcagtgagccgacttcgtgccattgcactccagcctgggcaacagagcgagactccgtctcaaaaaacaaaacaaaacaaacaaactaactaaaatgaataaggatagctattatataagctcttccgatgagccaagcttggttctaaagtgctttataagtaccaactcatttaaacattaccactctattattataccagtttgtttgtttgtttgtttgtttgagacggagtctcgctctgtcacccaggcgggactgcagtggcgctgtctcggctcactgcaacctccgcctcctgggttcacgccattcttctgcctcagcctcccgagtagctgggactacaggcgcccgccaccgcacccagctaattttttgtacttttagtagagacggggtttcaccgtgttagccaggatggtctcgatctcctgacctcatgatccgcccgcctcggcctcccaaagtgctgggattacaggcgtgagccaccgcgcccggctattataccagttttacagatgataaaactgaggcgtccaaaggctagtaagtacactgccaagatcacacagttagagacagagctgggattagaacccaggtcggtgctcctagccatgtactttaaaaactctttcttcctgagtgcgtaccacttaaaccctgccaggccctggtcaaatgcaagggcgggggagacagtggataaggcctgcactgtgaacagtcctcataaaggctttccagagaagtggccacagaactgagacctggaggtgacatggaagggaaagggtccccagggagagggcactcactcagtctgccaaggcaaagggtaaacggggtgggggacattggagggactgcctgcagggaccttagtaaggctgagggaccagcagaagaaaatgctgtgaggaaggcagagtcctcttatgtcacatcatggagcaaagaggcatcaccaacggatgctaaaccggaaagtgtccagatatgcatgttgaaaaggtaagtaggaggaatgaggcctttttgggtgagtaggaatttagacattccaggtaaaggcaagcacaggccagtgctgtaagacatacaagtttatactttcataaactgtatcaaggaggcttgtgccgtaaaccccgcagcagcatgcgcactggctcccttgtcaagccagctcggggctggagccacgtggtggttactaatgccattcacagagttagggacaaggaggaagggcagggtggtgggaggagggtggggagatgctcaagccaaggagttcactgagggaggctgggtttgaggtcctctgagctgttcagggaggatatccagcaggccccaggagatgcaggccaggtgctacagtcctttgcctagacagcagaggtgcacatttaggagtcactgacactgaaggagcagctgcagctgggggacagtgggacacagagtttgtccctggaaaatgtacagcatgagaagaaagagtgaaatttaaggcaaggctaagggtgtcagacagaattcaggctgttgataaaaaattttatttttatttttactaacttctaactaaaattatcatttccttctgtaacttgtcatcaaagatattttctttgacgtcaaagatattttcttagacatcaaggatttttcatatcacattagttattgcaatatctcaaagtatcatttccactcatcactatttcaaaattacagtagttattagacctgccactagatactggtaagtaatgcattttaataaaggacatgtattacaatatgacatatttacttctttgcatattgataactttatgtcagtataattggtttcctttgtaatcctatgcattttaattttatgtgtttaattttacagaataaatattctgtagagtggttcattagcttaattagaatgtcaaagaggtccccatggcacaagtaaaagtaaagaacatctgatttaaagagggaaagagcccagcgcagtggctcacgtctgtgatcccagcactttgggaggctgagaggggcggatcacctgaggtcaggggttcaagaccagcctggccgacatggtgaaaccccgtctctactaaaaatacaaaaattagccgggcgtggtggcacacatctgtaatcccagctattcaggaggctgaggcaggacaattgcttgaacccaggaggcagaggttgcagtgagcagagactatgccactgcactccagcctggatgacagagggacactctgtctcaaaataagtaaacaaaaaaaattaattaattaattaaaataaaaggggaaagaaaaagccacaggaaaacacttaaaaatagctctgcgaaaagggggaccctagtatgagatggagacagctttcaaagctaggatgcaaacgcaggacttctgactttgtgttctttctaccacgtgactccacaccctaaaataataaaaacagtaaccccttcatttgcgtaaacaaagggctttcacatgtattagcctgttagttcatcacatctattcagagtaggaaaaggcaggaacccaaacgtgccttgaagctgccatctaagaagacactccttcctgggcctcagcactgcgccagtgctgcagcggacggtggtacctgtcaccccactctatggagctgtagtcatgggcacagaagagtaagatgaagagcccctccctcataccacactagctagaacctgatcgcaagaggtgggcacagtgggtgcccacccaaatgatgagttgcacttctctccaggcttctatttacaggtaaggctaagaatttgtttccttgctcaaagctcttttatttagttctgattggtgatccagagtgaattacaagatttgcaatatttcagctctttaatttgccattggctctaaccaagacagaagactttacttaagcaattggtttgaaattagatggacaagctgaaacaatgggctctctgttctttcctctctgtgcccaccaactggcattcattatttaatctgtgacgtgtgttgccagggctgcggtaatgacaacggcacctattgtcttcacatcccttccctattctgtaacatctgtcatggctcctgtctatatttcattttattttgttttattttgcttcttttacttttacaaggttattcttaattactacaaattgctctgaaatctattctaaccctgcaaagtgtagcatcattttgtaacttggcaataacaataaactgaaggcgcgtgtgatagcacccttttaaattactgtaattttacataaaactgtataatttcaaacaaattttatctcaaggttaactagataacctctctttttaaatacctgatcagttcacagacgactttggccccttctcatataatacatgacttccttttacacaataatgagaatgtgggtttatatgactaatctgacacaatacagtaacttctgcttaaaaaaaaaagctgaacatttcttaatatgcagttacaatgtaaattactatgttcatggatggatctttaatttccaagtttctctattattttctttcttttttaaataaggagccagagtgaaaattgtcacttgccttgtaatcagtcacctaaaaactagagtgaaaattgttgtgtgtgaaaagagttcaaaattggtttctatgtcccaggaaccggagagctggtcttcctactgctgtctgtctcaggacacagcacacccatccgctgtaggaaaggcagaggtttcgcttagagctgcttgcgtgtaagggaagagggaactcaacctggcaggaacaagcccttgatgatttaccttctttcctaattgcccagaggcatttccttccttgcttacccaatctaaggaagggtttcctactgccctagcagttcctttaacctgaagccattttctctagttcctaccctgttttttgtgttgctctcaatctgctttctcacaagacctcactttccagccaaattggtttattctgtttttcaaattacctagttcttccttccttttgagtttgtgccactgtcccaactgtggcaatgcccttccccctcctcgacagtaaaggagtcaaatcctccccagcatttcaaggggcggcccaaacccatgtcctctacaaagcattttcaggtcaccctgctttaaaaaaaaacaaaattgctcaacaactacagcaatcatcatcagcagccgcaaatccattaggcaacaaattatgccttgcgactttctattttatctggatgggttatttaaatagtgatggcatttaacttttcatgcatttataactacttcctccaacttagtaatcagtaactacatattacaagttatacctctgaaatcaaccattgtaaaaagcatatagcaaaaattctaccttacattgcattcatatatgtatttgttgcttacaagatatttaaattatttatgttacttaatgataattacaaaataatagccaacactattgccataatatcttactagactcaatatcttatttgacattcacatctgccatatgaattagatacaattattttcctcatttttcaggtgatgaaaatggggccagaaagcttaaatttcccaaggtcaggcattcaacacgtacttagtgagcacctactatgcgacaggcattgttttcagcattagtgatgaaagcagaaaacttctatcttcagggagtttatattctattagggaagacagactatcaaaaattaaaacaaatatatataaagccagataatactaagtgttgttaagaaaactaaagcagagtaagggactggagagagatggcatctggagagagatggcataagtggcgaggtagcacactccttagataagatggtcagaagaggcctctctggggagatgacacttgagcagagacctgaacgaagtgaggtgacaggctctgtaatcatctgggaaaagggcccaggcagaagaaacggaaactgcaaaggcccagaggccaatacaaacttggcgtgttcaagaacaacaaaaaggccagtgtagtcagtgctgtgaaagaaagggcaacagtagagggtgtagtgagagaagaaactagggagtccagttatgtatggctttgtaaaccattgcatagtttcatttacgtttttccttaaatataatgaaaaggccctgaaaggttttaatcaagaaagtgaaacactgtgccatttgaaaagattacacaagttgggtaggtaaagaaaagactaaaaggggctgggcatggtgctgtaatcccagcactttgggaggccgaggtgggtggatcacttgaggtcaggagttcaagaccagcctggccaacatggtgaaacccccttctctacttaaaatacaaaacttagctgggtatggtggcgggcgcctgtaatcccagctactcaggaggctgaggcaggagaatcgcttgaacccaggaggcagaagttgcagtgagccgagatcgtgctgagatcgtgccactgcactccagcctgggggacagggcaagactctgtctcaatgaaaaataaaaataaaaaaagaatagactgagagaaggcagactacttaggagaatattgcagtagtccaggtgggagatgaagagaagtagtcagatctaggatctactgtgaagatagggccaagaagattatctgatgtgggtcgtgatgcagagtgtaaaaaaaagagaggtgtcaaggaagactctaagactcatatgagtaacagggagaaaagtctaattattcagctgaggaacattgtaggtgatggggtctggggagaagcagtaagtttttggggcaaatcagcagtgccattttgggtaggttaagtttgagagaccttttagatatccaaacgaagagaagtaggacgttggatacctaagtttgaggcttggatacataagtccaagattcagtcctggggtttggatatgtaagtctgagattcaggcctggggtttggatatgtaagtctgagattcaggcctggggtttggatacataagtctgagattaggactggagtttggatacataagtctaacattcaggactggggtttggatatgtaagtctggagattcaggactggaatttgtatacataagtctgagattcaggactgagatttggatacataagtctgagattaggactggagtttggatacataagtctaacattcaggactggggtttgtatacgtaagtctgagattcaggactggggtttggagacgtaagtctgagattcaggactggggttaggatatgtaagtctgagattcaggcctggggttaggatatgtaagtctgagattcaggacgggggtttatatacataagtctgagattcaggactggggtttatatacataagtctgagattcaggactggggtttatatacataagtctgagattcaggaatggggtttggatatgtaagtctgagattcaggactggggtttagatattaatctgaggactggggcttgcatacataagtctgagattcagaactggggtttggatatataagtctgagattcaggaatggggtttggatatgtaagtctgaggactgggatttggatccataagtctaacattcaggactgggatttggatacttaagtctgagattcaggactggggtttggatacataagtctgagattcaggacttggaattcaggtggctttaaacgtggtagttagctttaagcaacatattttcaccacagactgactgagggtgaataaaggagggatgtctgaggactgacactcaggactctccaacatttaaataccaggaagaagagatgggtccagtaaagggggccaaaaaaaaaaatgccagtggggtagtaggaaacccaggagagtgtggtgagaaagacagaagccaggtgaaaagagtgcgtcaatgatagagagatcaattatgtcaaaggagctgagagatgaagaaagaggaagattgagaactgaccactggatacagaaacatggaggtcactgatgtcctaaagagtgggctcaagagaaatttatgcaaaagcctaaaaagtgggctcaaatgagaatgtgactacagggcattgctgagagaaattaaagacctaaataagtggatataccgtgttcacggattaaaagaccaaatattgttaaattttctgttctccacaaactgatctatagatccaacacaataccaattataaactcatcaagcttttttgtacaaattaataatctcattcttaaatgtgtatagaaattcaaaggatttagaatatccagagcaaccataaaaaaaataaaactaaagttggaggacttaacactacctgacttcaagacatcgtagtaagtctatagtaaccaggacagtgtggtactagtacaggatcaacaaatagatcaatacaacaggatagagagctcagaaatagatgcacacttacatggtcactcgattttcatgaaggtaagagaaaaatccaatagagaaaaaaaatgacttattaacaaatgatggtaaaaaaaaaaaactaaatatctatatagcaaaaataaataaatctcaaccatgacctcacaccacactcaaaaattgagatggatcatagacataaatgtaaaaactaaaattataaagcttttagatatggcttagaaagcaatcaacataaaaagaaaaaaaaacagacttagccaaagttcaaaatttctgttcatctaaagtcatcattgaaaaaataaataagaaagccacagcctgggataaaatatgtgcaaatcatatatctgacaaagaactaatattttataatacataatgaatgcctacaattcgataaaagtgagcaaaagatttgactggacatccacaaaggaagacagactcgtgatcactaagcatatgaaaaagtgctccatgttaatattcaccagggaaatttaagaaaaacgcaatgaggtactgctacatccccaccagaacgagtaaacattaaaaagaccgtcaaacccaaatgctggcaaggatacagagacagcacaactctcattcaccatgggtcacagtgtaaaactacaaccagcttagaaaaaagtctagccgttgtttataaaactaaatatgcacctatcctatgacccagttatttcattccaaagtatttatccaagagaaaagaaaacacagccacaaaaaaagactccattcaccatagtcaaaatctggaagcaactcaggcatccacccgtagaaaaatgaataaacaacctgttgtatcatcaaacaatggaatgatactcagcagctcagaaaggaatggattcactcagaaaggaatgaatgactgatacacatgatatgaatacatctcagaaacattacgctgagtgaaagaagccttacataaaagagtacatacattgtatgattcaattttgttaatcttctagaaaggcaaaaataacatattgtgggaaaaaaatcaaaacagtggttgcctctggcagagcataagagggtggtctggggactaactgggaagcaacatgagggaactttctgtggcgatggtcatgttctgtaccttgaaaagggtttggattgcagaggtggtacatgcatttttcagaactctgaatggtacactaaagatttgagcatttcagtgtatataaattttacttcaaaagagaactataaacaaatagggaaggaaattaatcatatgtaccctgaaatgtttaggagtgagtgtactgatgcctgcaacttactttaaaatgtatccaaaacataaattgaattgatgaaaggataaagggatagatgggtgacaagacgtatgttcaagcaataaagcaaactattgattgtagaatctaggtggtggcttatgggtgttcaccttaacattctttcaactttcctgcatgtttgaaatgtttacaagatgttgttagaagagaatgtggggtaaggaattggagacagtgagaactgacaacttatcagagttttgctttaaagaggaacaaagatatgaggcaaatctggagggagatgaagaattaagaggaggtatttgtaaagaaggaagacattatggaatgtttgaataagaatgatcctgtaaaaagaggaactttaatgaagctagtgggcagaaactatggaagcagagttctgaacaggcaagagcaacagatggggtccactggggtgcaatggatgtcaaccaggaggatgcacgtttgtccatggtaaagagcaggggatgggggacagatgatggatggatgcaagagaatatgggagctgggaaactgcttctagtttcccagtgatataagcagtaagatccatggctgaaagagagagtctgggaagggatgttaggggtttgaggaaagaaacaaaggtgtgaaatagtcacctgggagagtgagtttactagggaagtagggttgccagagagggctgagtatcagtggaggcaggggtggagggtggcgtgattaatttaatgtcatcagagtgttgtgtgtgtgttttccaggaatgctccgtggtttggaagaaagtgtagagttatgcctgagtaactgtgattttaaccagggttgtgttttgcaggagactaggatagaaagaggagagaggcaagtagagtaaccacaacagtggaccaagcagataaggtgagtaaagtggaaagttagactacacagggcattaatggaaagtaaaaaggtggcagagtcaaaggagtggacgtaaaagtgttgatctgaggatattacaagacagagcataaaagttggcagatggtagagctgggatttaaatctaaatgtttgactcctgttttttttattttattttattgattgagatagggtttgtttgtttgtttgcctgtttatttgtttgtttattgagacagggtcttgctctgtcaccaaggctggagtacagtagtacaatcacggttcactacaacctctgcctctcaggctctagtgattttcccacctcatcctcccgagtagctgggactacaggcacgcaccatcacactcgactaatttttgtagtgatgtttttgtagagatgcagtctccctatgttgcccaggctggtttcaaattcctggctcaagtgatctgcctgccttaggctaccaaagtgctgggattacaggtgtgagccactgcgcccagcccaccctcttaactgtaacactctccagcattttcaggactcttgtcttatactctctgtgtctggatagtatgtgtacccatttggtcttttcaagacccaggggtattatttgacttcatattcttaaaaataacttctacggaagtgattttctttcatagaatgggaaatataagacacataaagagctggtgtaatttttgaacccttcaacaaattggctatcagagaaaaatgtatcctcctgtctcagctcaactctttgtgtcttatagttctcactcctaaaaagcacatgttgctgcttggaacaaaacaaataccacatttggaggatttgaagaaactagtctcaaagtaattatttcaagagaatttattttaaaaacatgtaagcactaagtcacctcattctcagaaggaaaaaaaaaaaaaagacagtagcacgtgttcaggcattcagaattttagagggaccgctaattgtgtatttaagaaaccatttgaataacatttaagtacccaggaaaaaaagtccagattccctagcctgaccttccactattaaagtccagtctcttatcattcccctgcacacatgccatgtcccaggcaaatgaattagccccattcttcccaaagaatgtctcatctctgagcttttcctcttgctgttccctcccctggatcaccaccactgcaacctgcccaatctttccatagacatcctatttttcttcaagctccagctcaaacacaggctccaagccagacagtgaccacactcctctagaaccaccaaagctttttacctgccacacataaggcatctatcactttgtatctggtatcatagctacctatagatagcaaatatctatagaaactccccccttagagagaatcatctaatatttgaatctggatctccatatttaccattgtagtggacacctcacacagtgcctggcatattatagtcaattaacagctaataacatacaaatacatattttagacggaatcataaggaaaagttaaatacagtgttaggtgcacctattttaagctcggcattctgtctctgaagtacagacagagtactacaggaatactacagtaagtcctgtacagatccagattttattgttgtgggatactgccaaagtatcctttgaaatgtttactccaatttaaatgcttgtcataaggttggaagagagcctagatctcaacaatttatgtttatgtcttacctctattctgttctctattccgaccgaatacggtatgagttacaaaagtgagccacatatataattttaaattttctagtagccacatcaaaagtacaatgaaataggtgaaaataatttaatgagtttatttaacctaatttaccaaaatactgtgtcatgtcaaaatgtgatccacacaaaaattattaatgagatattttacatttcttgtgtactaggaaatccagtgtctatttttttttttttttttagatggagtcttgctccgatgcccaggctggagtgcactggcatgatctcagctcatggcaatctccgactccctggttcaagcgattctcctccctcagcctcccgagtagctcgcattacaggcacgtgccaccacggcaagctaatttttgtatttttagtagagacggggtttcaccatgttgttcaagctggtcttgaactcctgacctcatgatctgcccgccttggcctcccaaagtgctgggattataggcgtgagccaccacgcccagcctccagtgtctattttacacttagagcacatttcaacttggactggccacatttcaattctcaaataaccacgtgtggctaggggacaatatactggacagtacaggtctagaacatccctgtgggcagaggctgcttctttcagccctgtactctctacagtgatttacccattcaatgggattaaatgcaacaagcatgtaaaaaccaaagtgttaaagcactaaacagtgcttaccacacaggaggggttcaataactgccagcttcctttccttcacatgcagtaggccctcaataaatgtttcttgggttgactttccaaactggaaacagtattataggattaaggccatcaggctccctttattctgctcagcagaataaagcaatcttgtcaccttaatgtaggttcgtggcacattttcctggcagaagaataattacccaccaataaacttttccaactatttggaaatagcaatttctcagaataaataaactattatcctgctcttcatcaatcccagtgaatctgattttaagcaaacctgtaggattcatttatccctggctgaactaataaaagtgaatttctgagtccaggaagataaagaaaagatccagtaagattgtctttctaaaccaaggagcagccaccctcaagtccatctggaaatggctggtaagactgattctgcattatagaatcctgtctgcccagagtcagagagaaatgcagcaatcgagctgtctaagcagatacttggatatccaaagtattagaattattctaatctcaaagaattagacagaataaagaattaggagcactagaatatttttatcataattgaatactgtttgaggactcaaacagcatttcagaatttcttttgctcaaagcaacattactgttcgggatggcaccataaaatttgtaatttaaacttccatgtcagttgagcttctgtgtcgtttaattacttactcaaaatacaaatcaacatttaaagaaatatattttatatataataaatatcacaaaatatctcatctgacaaaactgcaactagaataggtaacatgggaatttccttatgaattcttatctcttatgcaaacattctagccaatcaaatagatctttcaatacgtgcagtgcctccgtagtgatgcctcatgctaactaactcccttcatcggtaagttatcactgctttaaaccttcagtctctgtccatccatttcctgttaaattcctcctagattcactcaattcatccagccagccattcattaaacaaatattactgagttcatatctacagtagagtgctaggcacccagcacacaacagagagtcaaccaaacatggtccctgccctggaaagcttacagttgaattctcttcccaatcaatgcccattctgcttgtccacctctgggcccctctgtctctcaggctacatgcctgtgctgaagtaccaactaacaggtagctgaccagggttttaccgagtctgtatggtacattaggtgtctgtagggcatggtcatctctgtacaacacaggcctactttctggatttgttatgttggaatagattatctaccctgagtattttcccttatttttgtgatcaaattactttctcttggcaatgccttctttttttttcattaagtacctgggtgcccccaagtggatgatggttctctcacattgcaagagctggttgtacaaaatgcagcacccaagaacttcatgaccatattatcaacctaggagaaaaatgttatggatttgtgcaccaagaaaggaatctaaaatacatttgcatattttataactcatttgaatgtcatcatacccagaaaataaaattcaggccatttttcccttgttaatattcatggtatggtgtggtatgtgtatgtgtgttgggggcatggtacaaacaaggaaggttgatacaagttaaagaacagccaccttctatggagcagcaagcatattatcactgaattctcatttaggaaaagaaaatattttttccctggtaatttaatgaaatttagatattattagaaccaacttggttttttttaagaaaaaaaaaactagaaaaatattttgtaagaaaaaaaaaattgtatgattgtcagcctcaagaaaaaaattcagccgggtgcagcagtggctcatgcctatactcccagcactttgggaggctgaggctggtggatcacctgggatcaggagtttgagaccagcctggccaacatggtgaaaccccatttctactaaaaatacaaaaattagctgggcatggtggtacacgcctgtaatcccagctgctccagagaatcacttgagcccgggaggttgaggttgctgtgagctgagatcgcgtcattgcactccagccttgtgacaagagcaaaaatccatctcaaaaaaaaaaaaataataataaattaacttttgtgtttgtgagtgcatctgcacttctttttttttttttttttttttgtaaagactgaaaggagtatttctgggctggtaaactgatgagatgaatgacagagtgagaaacaggcttatcagtttaccaactgctgaaaaaaccaagccaggttcacaaggtaacaacaatacagaggtgatagaaataaatttttccttaatgcatgggattcctggattactcgtatacctgcattcattcagttagtgcttcaataaaccaagcagtttgcctctggttttctaatatcccgtctctctattagcttcccaaataaaaactcaagccaagagacaatataacaacaaataaaacaaggtaacaaacttttattacacatttgttgaattgtttaaaaacttttcatgtttcctgaacactcatccaggaaagtactgtcaagatgatgacgaaactcagtttattcctggacaaaagagctttgacacatctgcttgtggttatctacgttcataaaaacacatcactgtcatcaaaggcttaagacaaagaaaagcatttattaagttctgtctatatatagtacttcaactgccaactctggtaatttgtttgagcttagattctctgcgtcatgagaggagttggtttgcatctgttaatgagactgtttttttgaactgtattcctttactccaatatgtattgcataactaccctgtgctatgcactctgctaggcactgagaattcgaggatgaataaaacagacattgtcctcaaaaagctggcaaactcatggaggaggcagtctacatggcccagccaaaagtctactgtgcacaaacaaagctgtgcaaacacagaggggaacagaagtaattcagcatgctaagaaaatggtggtcagggccaactcaccaatgcacaggatttttctatctacaggcagacaagggaggaagggcatcctattcaaagagctccaaaggagaaaagcacatggcacgttctggaaccaaaaagccctgcagagggcgtgggacagagatggatgtatgtacattgcaaggctggaaataaagttgaaaaaaatgcatggcagccacatacagaagggtcttgaatgacactctaaggcgtttcagatccactcttgggtgatgggaagttcatggagggatttaagctgtagaataatgtaatctaatttatgcttcagaaagatggctctgtaaaactaggtacacgaagtcagcagtattcctcagataagagcccctttgggcagtggccagagtgggaatatctgtatacaaaagacaaaaaaaaggtacaaatgagaaaaaaatatttgtgctattgaaaacttggacatctttccattcattttaaaagcaaattttaagtgctactaactttgatgagttcacaatggctgatgaccctcaaattcttcacttactcttcactgtctatgacagaggagaataaagcagaaaacaaaacaaaacaaaatgcattaataccagttcctgattttagccgataatggtagcatcactcacttgctgccagatatcagaatgaagaaatactaactgctgtttttacctatgtctctctcttcatgactactaaataatagtatgtgatgtggctgggctgaaccacattgcccagaattccccttcttgtaggcttccacgtagggtcaaaggatattctctcctaagaggtggggaaaagaaaggagacagcaacattttgcagcatgcatgtacacacatgcctttacctagttattcaatcaagtactaatctactgctgctgtgaagggattttgcagatgtaaggtatgtaatcagttgattttagttagtcaaaagggagattatcctgagtagaactgaggtaatcagctgaaagtcctttaaaagagggcttaggccctccctggattcagagactccaagcttcagctccactcacagggatccagcctgctcatggtctacctgcctgactggttgccctgtggatttcaagcttgtttagccagtcccacaattgaggaagccaattccttgtaataaatcccttaatgcatgtaacctactaagtctgcatctctggtaaaccctgactgattcatgatgttacggttattactgttgtgaggacacagaggaagacctcttggcgtggaatcacccagaaagacactaaagaatctcactcttgtactagctctctcccaatctcttgcaataatggccaggagaagagaagattgtgagttaatttttcaaaaaatgagatttatgataatttagagatgcacagtgaggtgtggctatgttactaagctctggccaatgagatgtaattgggagtactggaattatgagacagggcctgcaaaggaagctggcatgctcctcttcctctattctctgtctgtaatgtaaatatgatgttgagagccccagcagccatctcagacaagggccacatcctggaggtggcagattggagagctctagagactgatgacttctagagccgtcatgccagctcccaacggactacttctggactgtttatacatgagaaataaagccactacctgggggctctgatacttgtagtgaaacacaattcctaactgatataagaattgttttctttagtcttcctattcccttagcagtagacttttacatctaagttgctacgttatcaggaatagctgtatttaatttcactgctatgtacataggacacattaagtgtttaagaggattagaggagacagccacagtaaaagctttttcgtatttctccatgtttctgtgttttggcaaaagaatatgagaacttttcatagtctgcaacaaatgccttcacaaagccacaaactttaattcccatggaatagaatttcatatggcaagcctgtggttacatccaaatccacttattcaacagatttgtgctgtaaaaaaacctcacactagcctatctctttagataggctctgtcttttcatgttggagtcatctaattttccccaaaccaacaacccttgcacatgtctggggtatatttttttgccgaatgcaaaccacatggtcatttcaaagcctataattcagttcaggagcactgggctttctggatgctcgtgaacataaccatcaagagtgacacacatttctggcagtcaccttgccagctccagctctattgtgtctctatatcacggtgaaaaactgcctgacacactaggcagctgacatgtgtagggaaaaaaatatcaggcctgtgaccaaggggaaaatgaagtgattaatatggaaaacacaacaagaaacatcaaacaggaaaaagctgacacttcctattcctttagcttcaagtaaatgtgttttctcctcacactgactgtaaaaggctggatcgaagtattgacatgatataaacgtgtcagatgtcttcctcacctggggccattcataatactgaagagtctttcactcctttttttttgttttgttttagagggagggagggaggtgaggttaacgtaatcataaccctgaaaagataaacttgggaaactataagcataaacacaatgggccgaagtgttcccagtgtgagtcaccactgttgtgccccagctcctttgttcctgccatttccttcctttcagagttccggaacattcctctctggctggcctggctccctttcccaacaccatcccttaaacactggtgttcttcaggcttctgaactcgacctagtctacctgtagactgtgtctcctcattctatgtcctcacagggaggtgagtctcatagatactcattcatacccacagctttactactcccaatgccaccattcctttcttctctttctcctgaaggcccagtgcctagtgaactgtcctaccagtatctatttcatcaagtcccaaactgaacatagtcatgcttttctaccttgcatctcaattccatcctctttccctgtctcacagcccagccacatatgcaccctgtacctccgttattggccccatcatgcacccaggggccagttccatcctcttatctattccaccttatttcatatactaagagtagtgggggctgggtggccccaaatgagattcttatattctgggaatgcagatggatcaggggcccctggccatccatcaggcattcagtaccacaccagctgatctgcaaggtgagaagggggccctcagacacgaaggtctcgctgagcaaaccaggggacaaaccaggagaaggaagagggcctgtttccctgcccagccccagactggctgaggctgatggagcaagtagctgcaggaagaagtggagaggattgtctttccccctgcctctgtgagtcacagagaaacacagtaaatttaggctcctggtgacaaaaggagtcaaggacatttctgcagggcacataccaggttccagcatctttctagagccccaccctccccccagatttgcaaacttgaaaaaaacaagtcctggcatgtgactccttttggcataaatcctcttcaggaggacaccagctatggctgaggtggagcctcacacacaaagccctttggcccacggtcatcaacaaggaagccaaagcggaagactccccaaggaagtggggctctcaaaacacatgtgagacaatgccaagataccaccaggaatacctgaaggagacttgcattgaaggtcctacggatccacgtgggaacacaaaccagtgaaatttgcgtgatctccactgactagacatcatttgaaccctcatgctggcagggtctgaagacatttcgtaatctgtctccacttttgatccctactgtagctcccctacaaaacatttctacagattgctaccaaggtaatcttctaaaattataactccagtggtattctgggctggctcatataggctcctgagagcagactgggaaattttcatcaagattgggaaattttcagcaattttgtgagtcagttgttaaacacataaatcattaaaaattaaaatattaaaaattgaagttactaaaaattaaattatataaacttacaataaattatattaaagcaaaagttctccatttatcacttctttattacttttctatattttaataatgtctattgtcttgaggttacttatgcctattttatgtgtagtgcagtccccccttatctgtggtttcatgtaactaaaatttcagttacctgcagtcaaccatggtccaaaaatattatatcgctacttttgcactttgtagccattattaagtaaaatacagttacttgaacataagccctatgatactgataaaaccactgttaatctgatcacagagatggccaccgagtgactggcaatgctggcaggatggaatggaggagtgcaagatttcatcacactactcagaatggtgcacaatttataacatgaattgtttatttctggcgttttccacttatgtcacactgcctaggttattcgcctcacttcatcttcacacaggcattttatcatctcacatcatcacaagaaggggctgggagtggtggctcacgcctataatcgcagcattttcggaggccgaggcgcatggataacctgagatcatgagtttgagaccagcctggccaacatggcaaaaccccgtctctactaaaaatataaaaattagccgggcgtggtggcacacgcctataatcccagctactcgggaggctgaggaaggagaatcgcttgaacctgggaggtggaggttgcggtgagccgagatcgtgccactgcactccagcctacacgaggggagcaagaatccatctcaaaaaaaaaaaaagaaaagtactgtacaataagatattttgagagagagagaaaaagagagatcacattcacataatttttattatagtataccattataactcttctattttgttattagttattgttaatctcttactgtacctaatttatatattacattttatcataggtatgtatgtatagggaaaaaaatcatagcgtgtatagggttcagtactgtttgagatgtcaggcatccattgggggtcttggggcatatcccccttggatgaggggagactactggatgtgaaaagactacataatgttgtgttgtgcttctaccgtgcatcttttcccaattcaccataacttgatactggccatgatgagggtagtttcatactgaaattgacaaacactataatcacatcgtttctgttttgctaattgtctaggccttaggaggtgatagagaaaatgttaataaaatgcctggtgcttgtagtagttacatcgtgaataaaacaaaaaactgaggaaatattcctctagtattaaaaaaaaaaagtactggacaattcataaagaagatgttccctgaacaagtaaagttttgggatacacctttgctgcttcactttcaaattatacaataatataaaaagaaaatatcaatatgttctttcatcaattgtaaccatgactaggctatggatacaagagttcaaaaaaaaccaacagaaatctgtctaaatcaattagctatatagatttaatgataaagagtattttattactacttgtaattgtgtgcaacacatcttttgtatcagtacaatttataatagacatatgcgcatgcacattttctggagagctggttgttaaacacttacaagcacaccattatatcattctgattaggtgttcctttgtttaaaatctctcaatagctcccttcattggcctccttttacggactacttcaaatcctctcaaacttgcttcttattcctgcattgccatcgcaaccagttccatgaagaatttaaccagcttcacacaagtgcaaactgacaggcccactcacccctagactcctctgttgctgtttcatgtgtcgcccatgggaacctggcagtcatacatgtgcaatccagaagtggggccgcctttattcaatgggagacaagaaacatggataaaagcttctccctttttttctctacataaactgtgctgagtgcatttcataaaacttctcagataatctcttggaataaagcaaccagctgcctatagcaatgatgctccaatattggttccttgtattaccattgcctccttccctagatgactgtctctggtctttcacccctgctccctggatgccattcccaattaaaccacctggcacaaatctctgcacaagacaccacctatcatcatagggtgggtccaggctccttatcttaggagaaatggccctctgaaacaaggcctccacctgccattcctgcttaatttcctagcacatcacacccagtcacaaagaacacacatactcttacccatttcttgtgttttactcatgctattccctctgcttagaattcttcccaaaagggtgttcagagagttctaaaactttgtaatttagtacaacctcaatattacaaaggagaaaattgaggcccagaatggaaaggtctggcccaaggttttcaatagttaatttagatagagctaaacactgtgctactttttatgggcttctgcttctagtccctaaagtgtccatgaatatctctattctagttttgagagtctactgaattaaatgtgtttcctctttctacttcctaggatatatggacttccatttccctttaaactattgctctttattgtctgagacattggtctctcccaaaagaacagatagtaatttactcttacccaatgattcaatccagttccccaaacatttgctgtccactttttgtaagtatttacgatgagtgcagtgaagaagacgaaaatgagtaagatatgtcccttacccaaaaggagtttatgatccagtgggaaagacagagttgtgtataaatatctccatatatggtgtgattattatgatgtaagaaatagccaaagagatgtttaaattacctgctgtacttgtttaaaatatatacatagagcacatatcaaaaaaaggttgatattcatagtttataaaatgggaggaagagtaagtcaacatactaagaaaaccatagcaaaatgaagagctgagaaagaagactatttgcagatgtaactatttcagagctaatgattgtcatggatcaactaatcaacaaatatacgaatgcctgttatacataagccattaactttttgtactactgtgttctatcatatttcagacaaccaaaaaccctcaaacccttaattacaattacaaagaaacctttaagagtatctagtccactcctctcctgaagaaaccaaggcccaggaggttctttttcttatccattatttcttctgagagatccagccattaccaacactcttcaccaacaattcagactttgaatcctcactctcccttgactcttccctctctctcattttcaggaaccaatcaactaccaaatctgtggcttctgctacagatgcatcacatgactgtatccctcccatcttcatgctcttcttcagcctatccttgcttctggatggggctgcctcaataattcctgattctcccaaaatcactctttctcttcctgcaccatccgtcgcaatgccagagctgcccttcttaagcatagctctgatcatgcttttcctttgctgccaaactccaaaaaccaagaacatgttagtttaactttccagctctctcattcttaattccacctgttcatggttgttcctcccctcacatcacccttactctccacctgtgctaggctatactcccactcccatatacattctgcactctccctcccaacagtagagtgtcatctccaaaatgccctacctgccaaggcttcgaaatcctgcttaacctttctgcttccatatggcttctccgatctgtagttgttcactcatctattgccccacctctccacaccctgtttcccattgcatgttacttgtacttatttcacagcatttaatctttgaattgtgtttactgatgtgtcagctaaaccattagatcagtgactctcaaattgtagtccccaaaccagcagcatcagcattatctcggagcttgttagaattgcaaattctctgcccagcccagacctactgaatcagaaactctagggtgaggcccagccctctgtgttctcctgagccctccagggattctggtgcacagtagagtgtgagaaccactgcactagaccatgaatccccagagggcagttgctcccaggataatttcagaggcaaacttagaaggttgtctttaaaaaaaaaatactatagcatattatggacatttttcttctgaatacatatttttaagtaagcagcttttgaccaaaatatatgcaaatatcctaataatatgaaaaaagctggcatgtattaatgtgaatgaagttttcaaatttctcacttgtttattttgggcctcttatttaaaactgactgaagttggctaaattctttgagggttaatttttttttccctcaatctttagaattttttagagacttattactccctaagtgccatttttccttgtaagtttcacgatggctgtcctgtgaggataattttcaaactcattttccatttttctatgactcatctgtgaaacaatagataacagttaagtgtcactgacccttaaaatgtgaaacctaaagaaacattaaagggaaggaaaaaattctcaggccactgaatccaggtaacaccgctacttaagtaagattgtcctattatataaccagcaatggcaggaaagtgagtcggacaggatcaaagtagactgattaaaatgctgtgggatacagaactaaatgataagggagtgctcagtgaattacaatcacttacacattctctactaaaggaattctaaaccatttttgcatcacagagcaaagggtctagagacctttctaggctggggctatgatacctcccttgcttcacatcaactctcctactcatcgaacatatgaccaattttaaattatggtcaaattttacagactccttgagtccttggccctaggaaatcaggcgtaaggaaactgttgctgtacagaagtcatcatattaagtgctatgacttagagaatatcaagtaaattgagaaataaattctaggtgaaatcaggtgacagtgtcaataatggtcactagcatgagaaagagagaaagactgagaattgaatttttgttttgaatttttggatcttgctttggttgtgttaaaataattctaatcaattatgtgaagtgcttattatgtatgcttaacttgtgcttaattacaacaatgtcttctcaacatgttccaaattaatattgttatcctttatttgattgcaacagaaaactcttcaggtctgtctagccaggtcccaaggcccagctctggacatattacctgaccgtcctgagagctaagccacacacaggcccaaaagaacttggccattagagagtcagccatgctgggatgggcctcacactcttttttaggaggactgtgtcctcagtcaggcatcggagcacaaaggtttcatgggtagcctaccgcacactaagccactaaccaacacctgatttgggggcatcattctggtcccttcgaccagattatctggtctctgagcataattgtctgcccacaactttcatttaaaaagagggactcaggccaggcgcggtggctcatgcctgtaatcccagcacttcgggaggccgaggcaggtggatcacaaggtcaggagttcaagaccagcctgaccaacacggtgaaaccctgtctctactaaaaatacaaaaattagccgggggtggtggtgcgagcctgtaatcgcagctactcaggaggctaaggcaggagaattgcttgaacccaggcggtggaggttgcagtgagccaagatcacaccactgcactccagcctgggcaacagaacgagactccgtctaaaaaaaaaaaaaaaaaaaaaaaaagaggaaaaaaaaaaaagaaggacttgcctgcaactaaaactactttctaaagtgtttctgtgtttgtgaactagcacagaagtgaaacaaggccacctaagtgtactacttttctattttagaccaaaattaatgacatacaaaagaaaatctataacattaaaggaagtaaagggaatgaaatccttttaggacatttccccctctctaggaggtacagcataactcccaaaagtatgggttgtgcacagtgacttctttccaaagagtacagtgtggagagggaggaaaaaagtaactttacaatggaaaacattacacacacaacttcagtgaggtgatcaaagtggacatcaccagtgataagtcatgctgatagtatgtacccttgatacgatgtaataaatatggtattttacctctgtcctctccctccccaaacccatcatcccaatctaatcctgagaaaaacatcataaaaatcccaactgagggacattctacagaatacctaaccagtacccctcaaaactatcaaggtcatcaaaaacaaggaaagtctgagcaaccatgataaccaagggagcccaaggagacacaactatgaaatgcagcatggtatcctgggcaagatactggaatagaaaaaggacatgggagaacatctaaataaatacaggttttacttaataatgcatctatatttgttcattaattataacaaatgtatcatatacctatgtgagatgttaataatagaggaaactgtgtactcctttgaaactcgctataatagcatcacaacttttctgcaaatctaaaacaaacataatttttacttctttattttttatttttattttttagatggagtctcgctttgttgcccaggctggagtgaagtggcgtgatctcggctcactgcaacctccgtctccctggttcaagcaattgtcctgcctcagcctcccaagtagctgtgattacaggtgtgcaccaccacacctggctaattgttgtatttttagtagagatgcggtttcaccatgttggccaggctggtctcaaactcctaatctcaagtgatccacccaccttggcctcccaaagtgctgagattacagtcatgaaccaccgtgcctggcccaaacataatttttaaaaggcaaatatacaatagtatgttttctaaatgagatgctctgattaaatgtggtatttagagatgctccagaagtctgctgtctacatccctggacccaatctctactccaatgccagccacctgtcttagtccactcaggctactgtaacaaaataccatagactaggtggcttataaacaacagaaacttacttctcacagttctgggggctaggaagtccaagatcaaggtgcttgcagatttggtgtctggtgaaggcctgcttccccagaggctgccttttcactaacccgtcacttagtgaagagagtcagaggtccctctctggcctcttttataaaggcactaatctcattgataagggcagagccaccatggcctaatcatctcctaaaggcctcacctcctaataccatcaccccttggggtgaggatttcaacatatgaatttgaggaagacaaatattcataccactgtactgccctgaaacaaagcagtttgaaaatcactatcaaggaaaattggaacatacaatcattataaaagccagcccatttcaggaggcctggcaggattctgctgcacaattcagtcctgcctttggatgactgcattagactataagctgtggggctggaaccacattttagactcactagcctaggcctagtactgtgttagcaccaaaaagactctgtgcttgataaattcttcaacaccatcctgaagaggggctattgcaaatacaggatgaaagctttcactgccaactttattggccttccaggcaatggatctgcaaaaattacttcactgtcagtcaaacctaccccgtgtatctggtgagatcagacaggacgaacatatccaacatgcgtttctggcatgcctttctttttgtttcttgtttttgttttgagacggagtctcgctctgtcacccaggctggagtgctatggcacgatctcagctcactgtaacctccacctcctaggttcaagcaattctcctgcctcagcctcccaagtagctaggattacaggcactcaccaccacacgcagctaatttttgtatttttagtagagatgaggtttcaccgtgttggtcaggctggtcttgaactcctgtcctcaagtgatctacctgcctcagccttccaaagtgccgggataacaggcatgagccactgtgcccagcctatggcctgcctttcttacaaagtgatacacatttccctagtccccatgacactaccaaaaaccaccccggtagaactcaaaaaaggtaggaaacaggagtttccccaaatcagtctcatttatgttacgatactttcatgtttaatcgatccattctatcacagattatacacccacatgacagatgcaactgaaacaagtttttgcaagctctctgaaaacgacaggaggcattcacatagaaagctacagattttatttctcatcagttgagagcagcactttgttccaaattgcagtaatatctcagcaatgaatcattgtcataaaaacagcaacatctgtgaggtcagaaaagaacaattaggaaaacaaatgaatcccttgggaaccagggttcacactaacatcatatatttatataacaacttggaaaggtagtcattcaacaagtagttagtgagcacctactacatgtcaggaaagtccctactctcataaagcttaagttcttgtgtagaaaacccagtaagcaagaaaaagagaaaagaaaaagaatttcagatagtggtgaatcctagcatgaaaataaccctaggtgaaaggctggaacaggatcaggtagcaagcaatgcaatgtggactgtgaagtgaggcagctttcaatggtcagggaaaaaacctttccaaggagataacatttgaccattttgtcattgatccaaatgacaaaaaagaaggaagccatgcaaagacttaggagaagtgtgctccaggcagagggaatagcatgattaaaaggccctaagatggaacaaagcttgatgtgttctaaaaacaaccttcctaacaaactctggagataggcaactgtagttcagaaaggtgagaaacaagttgatcaaggttacacagacgctaaagtagaaatgaaacttagcacacctgactcctctgatagtctccctgcaacacgctagctgccttcctagttagaaacccaggctccaatgaatgagcatgagaaatcaggccaatggggcaaagagtggcccctgattaccaagtttcacaggatcagaatttgagttcaaacataaaaatcgaggctaccatacaatgtggccagggtccagcagcccagatgacctgattctaagcaaggtacacaggtgccagggctggagagcaagagcccacaagaggggcccagaaggcacatggggtgatcatcaaactcccaagggaacttacaaaatactattttgagtcccattcctcaagaatctaaatttattacatatgtgatagaacctggaaatttgtattttaagaagttcccaggtgattttgtttagccagactttggaactactgtgatggagaaggagggaaggccagctcttcaggaggttgcagggagaattctatctctacaaaaggaagaatcaagggttaaattgaatgcagttgagacttgtaccagaccagatcataggcacagagagataagaacattgcataactaagcgtattcctttctccccaaccacatccccaaattcagaatcactgtgacggttgacagaaaagtgcaggagaaatctctttggtcataatgagaaagaaagatggggtggagaagctcggatataccccctgggcaaagccagtggtgtgctgagaaatgcttagcaaccaggtccgggtggaggagaaaccctaactgtagtgtttgccaatttcgatggtgtaaatattcctggaaggccaaggcaggaggatcactaggtcaggagttcaagaccagcctgaccaacatggtgaaagcctgtatctactaaaaatacaaaataagcctggcatggtggtatgcacctgtaatcccagctacttgggaggctgaggcaggagaatcgcttggacctgggaggcggaagttgcagttagctgagatagcaccattgcactcctgcctggacaacaagagtgaaattctgtctcaaaaaaagaaattcctatcatggccgcttccaagttaccaacatgatatcactagaacatacagtttggggaagacgtgcaatagttacagtattttcaccatatagaaataataaacataaatagcatagagagcaataaatttagtaaaataattagtaagtcagaggtgtgggtatttattatcttttaaaaatagttttaacatcacagtgatgttagtgccaaaaatatacttcatccccaaattctgtactcctaccttacctcttacctctttttattccaaagcaggaataatggtgacatttaaaaaacaatatctaaaacatcatcttcatttttttttcctattcttagcccctttggttaaatttctcacttttgggtctgtatcttcagaggaccactgccctacacatctggaaatgtttttctgctccaagtcataaatctccaatcccaacccatggctacctactcaaactctttatttcaaaggactccttcatcagaaattgggcagaaaaagatcaatgaagtgagtacagctgtttacccaaaatgccacagactgtccattctacatctacacattttatttttaagaatagttaaatggcaccatagagcaaataaataagtaaaacgttaattataaagacttattttctggaaatacctatgtattttgaataaaatggattacaccttctcccttcatccatgtaccctttcattcagttcacatctattgtacactacaatggacactggagacacaaaaatgacaaaaacacagtctgtgacctcaaggaccttgccctctcacacggaagacagacaatagaaaaaataatggcaaatccagtgattctaatatcacactacatataaaatccacccatggaaagtggcataaaccaaactagactagactgttatgaagatcccaatcaggggctaagagttcccttgtatcttattgtccacatgctttgttgattagcaacagtttaaacattaagatcccatcaagataaaccaaaggaaagatcatctccaactgcttatgagattttgaaggcatcatccagtggtaacacactgagatgcaaggctttttgtaaagaattgacaaaggtattagctccctgcttcctatctgtggccctctgccaatgcctcgtctctgcatttgtttctcccctccctttctacggctttccttttccccatgtttattcctattctccttcatctaaatgtgccatctgtaaaagcctactttgaaaaagatcactgttaaattctgaacccttattttcctgttcttaatataaagttcataagtttatggcctcagaagtctctctctctctttcttaacaaaagaactgactaaactaagttatttttatttccatgttgcttttggctggttttcttttgtgcgtcagaggcttccaaaaggttcccaactctagatccaaaaagttcaaaaaatgattgagtacagaataaaatattgccctcatccagaggggagctgagggtcacgggcattaggagcaacgggggaagcaatccaggattctggagccctaggaagcaagacctgccatgacccagtcggccataatgtgggcccttatttagcagattagctctagtatggtcataacaattattaaaatattgaaatgcttccctctggaaatattgcacataacacccaaccccttccaaatacacctggcctcccagactctcccaggatccctggcccaatctcctcacaatcaggagttaaggcctggcccagcagaggatctccaggaccctgccccagtgcttctaccctttgacatacccatgctccaccttaatttcgttttccgaaaaataaaggacttgaacagattgtctgagttgcactataattgcaattatgtcaaagaacaaggacgaaatggaaataaaaaaacctaaaaaaaagtttgttaagaggatggaatcacaggttatgtttttttctagacagacagcagtgtcaaaactctgggtgcaagctgcctgggatggatccccagctctaccatgtgctagttgtgggatctcactatgcctcaaactgcctcatctataaaatgggcataggccaggctcagtggctcatgcctgtgaatcccagcacgtttggaagccaaggtaggaggaccacttgaacccagaagtctgaaactagcctgggtgacatagcaagacctcatctctacaaaataaaatacagtaaaacaaacataaataaataaattaaacggccataataagattacctactttacagggttgttctgagggttaaatgtattcatgtttgtaaaatgcttagatgagtgcaaggcacaaagtaaacaccacgtaagtgtttattaaataaataattcattttattctgtcgttgtaatgtttgctcaataaatttaaaaattaagaaagtttcacaacagaaaaaaaacactgtgacactatgaaacacttacgtaacatacacttttgcttaataacccagcactaaaacagctggggtccagattttacactgcactgtgaatttagggaaactaacacactggaatgtgttcccactgaagcataagatgcgatttgtatgattctctttgtaatcagaaatgtcacaggcttatgggaaagttaggtttacatgtttctcattttaaccctgcaacaacttttagccacaccctagcaaatacattttattttgtggtgctaagacttaaaggattgtaaacacaaaaccagaccttgcagagctacagcttttcttgtgaacacaatgactcagcctaactacaagtttaaagagacatatcttatgtgttgggtcccctagtatcaatctttagtaaacatctgggatggacaggaaattgctacacactgcttttagttactaaaaaggcaacactacctgagctcaagcatagtttagataggtactatttgcactgctatagaggacaacactgacaattgttatttttctgatagatactcaggagaggaaatgatcaataacaataattcccttacgtgttccttcctcttgacagctaaaccccacaatacccttagacacaagtttaaatacatcacaagcttatcctcaaacagtaatgtattaggtctttcctgctgtagataagatttgttaaacagtctggctatggctttttaccttttctcttttaaaagtgcatttctcagctgggtatggtagctcatgcctgtaatccagcactttgggaagccgaagtaggaggattgcgggagcccagctgttcaagaccagccctagcaacacagtgagacgccatctttataaaaatacaaacaaaactggccaaggatggtgatgcgcacctctagttccagctactcagaaactgagatgggagtatcacttgagcctaggaggtcaaggctgttgtgccactacactccaacctgggcaacagagtgagaccctgtctcaaaaaaaaaagtttaaaaggtgcatttctctaaagctacgagaaggaactcaaaccttgcttagtgataaaactaaagcctgcaacacaaccattatcattaaaatgttattaaaaccctgtaagaaagatgaagagtcttgtggatggatggtggtgacggtagcacaacgatgtgaatgtatttaatgccactacatgtacacttaaaaatggctacaatggtaaattttatgttgtacatattttaccacaacaaaagtgaaattataagagaaaaaaaattttttaaaaaaacatcctgtaagagaacatttatacactgtcggttggaacgtaaattagttcagtcactgtggaaagcagttgcagatttctcaaagaactcaaaacggaactaccattcaacccagcagccccattactgggtatatatccaaaagaaaataagttgttctaccaaaaacacacacaaattcatatgttcaccacagcactagtcacaatagcaaagacatggagtcagcctagatgcccatcaactatggaccggataagagaaaatgtggtccatatgcatcatagaataccatgcagccataaaaagtaacacaatcgtgtcctttgtagaaacatggatgcggatggaggtcattatcctaagcaaattaatgcaggaacagaaaatcaaacattgcatgttttcactaataagtggaaggtaaacattgggtacttatggatatagagacggcaacaatagacactgggaactactagacgtgggagggaggaaggagagcaaaagttaaaaaattatcaggtactatgctcaccacctgggtgacgggaccagttgtacccccaacctcagctgcatgctgtatgtccatgtaacaaacctgcacatgtaccccctgtatctaaaataaaatttcaaattattaaaaaaaaaaaatagggtcgggtgcagtggctcacgcctgtaatcccagcactttgggaggccgaggcgggcggatcacgaggtcaggaaatcgagaccatcctggctaacacggtgaaaccccgtctctactaaaaatacaaaaaatcaaccgggcgtggcagcaggcgcctgttttcccagctactcaggaggctgaggcaggagaatggcgtgaacccgggaggtggagcttgcagtgagccgagatcgcgccactgcactccagcctgggcgacagagcgagactccgtctcaaaaaataataataataataataatgacagtcctacttttcctttgtaacaaaaataaaagttacctataagagttaaaggtaaataaaatttgtaattttaattaagaaacactaagtaaacatacaacttccaagaagccgggttccccactacctggttataagtaagtctacaaacctaaatgagcattgtacagcgcttactatagttcataattattctgtcatcagggacaaacattgtaaagacactttttcctcaaagccttagcattcaatttttttttttttttttttttttttttgagacagattcttgccctgtcgcccaggctggcgtgcaatggctccatctcggctcactgcaacctccgcctcccgggttcaagcgattctcctgcctcagcctcccgagtggctgggattacaggcgtgtgccaccacgcctggctaatttttgtatttttagtagaggcggggtttcaccatgttggccaggctggtctcaaactcctgacctcaggtgatctgcccgcctcagcctcccaaagtgctgggattacaggcgtgagtcaccgcgcccaggcagcactccaactttttatatggattgttaactgtactggttcttgagaagccagactgagcgcttatacaattagtccaaagatccccaaacaacatttaaaggctgtctacaaattcaagctaaaagactgtgtacaaattcatttgtgtgtcacaaaacatttaatactgaaagagattcttattcaaataggcagtgtgtaaatgtggggtctgttaacagttcaaattgcagattcctttccttctttaagttttcattgcaccaccacgaactaaaccatttaacatacctcagaggtctctgggtacctagtctctcagaggcctttggaggcccacgaaggcttatcttaactaaaattggcagggctggctgataaagttaacggaactccccattttggaggcagacttagtaatggtcaaacgaagaaactgttgtggtctgttcttaaaaagctactagtatttagtgcttcacagaggaagtaaagaaagcaataatccgagatgaggaggagcaaatacaggcgtggcggtagttcaggactgagtctacaagggcggttctcaagggcgtcacaaaatcctatggaaggcttggaggacggcactcctggatctgagccctacgtcccaaacaccttcaatcgtattgtgaggaagaagaccttttacacactccctgctgctggcccccggccccctcgccccacctccgagtggtcacatcacacggcgggagccgcggtcagcagctgtgatcacacccccaggaccgtgctctgcgggctgggctcgaagccttgggacgcggcacttcctggttggtacgggatgccggtcccatcgcccccaccagcccagtcatgccaccgcgcacccgaaccaagggcgcccggatgacctggggacaccacacacactgcacccgaagccctgtggcggcgaggcggtgcatcctgcagaggacgcctgggcttcagcctgagcctgcgcggctctgcgctccaggcagccgcccgcgcggcaaaagtgcgtgccagagttgtcagctttcaccctgcaggaattccacccgaaggcgtgcgagggaggcccttggggatcgctagggagtccgccgccgactcactcgctgaaatcccgtccaagttgggcggggagcggccagctgcccaggttgggcggaggagggacggagggcgagggcagtggaaacccggctcccacgggcgcccggtgatccgggtctcggcgcggctcctacctgcagggcgaaggggccgctagcacctgcgcgttggcggcggactctcagggctcgggtgcctctggcacagctggagctcagcgggagggaggg

SEQ ID NO: 2686 - DNA, 210090 bp, Homo sapiens; identical to SEQ ID NO: 2685
  source 1..210090: mol_type = genomic DNA

SEQ ID NO: 2687 - DNA, 54881 bp, Homo sapiens
  source 1..54881: mol_type = genomic DNA
tgatgagaaagatcaggtctttactgcaaaatcattcaaaactcacacggcagcaattccttcaatacattgcaaagactcctcagggccagagccctgctcactaggaacagtgtattgcataaaataacattttaaaaatagtgtgggcactacctttctgagggaggggaggcgggaagagtcaatgcatctgaaagcactggcagcttctggggaacgggccccccagggcctcaaacctgctgcctccgagggcaccttcggggagaatcctcacaggcccaagccctccccaggccaggctcctgcccactcagggatggggcaatgagggctctgactaggctgggcttgtggtggagcgttaatgtgggccatggcggtgcataacccagctcctggcttaggaggcattggcgtctgggcacaggtgtgtgccatgaccgggagaagctgtgcgcagcctccacctgcctgccaccgttgcctctgttctgctgcacaggcatccagctccaaggctgggtgggtgactcagcagctaatcgcccccagggaagggtgggggtgggctcatctctgacagtgacatgcggctctccacctgaggcctgactccaagctgagcgcaggtaagacagctaggactgagggcctgctaggtccaggagaggtgggggaaggcgacagagagaccagcaaacccacatttccccgaagcctggagggtctgaccatcactttgaaaacaattccagactcccaccccagccccaaggccccttcaaaggcagtcctgctccggggaacttcttcagtctccagtgtcccggctgggcaagttcagtgatgctttgggaattcatggctttgtgaggtggtggctgcatccacagggcagttcccccgcacgccctgcacagcttaggaccaggtcacttctccacagtgcagggcgtggctgcctgccctctctggggtcctgcctatctgtgccctggcaggggtcagtcaggcagagagtgtgaccccgggcacccaccaaggtgggcctggagcatctgcagcagcgcccctgtctgtagaggggtgaggagcgcacggggatcgggggtgggcaagacggcgaccctccataaaccgaggagggctcaaagtgctgacagtgctggtttccagtcatttctccttctcctaatggggccaaggccccaggctagagaagagctaggggctctgacgctgagaaagcggtgggctcagcaggcgagacgcactggggtggggagtaaagaggacacagaggaaccggggtcgccaggactggccctgccctgctgaggggcggtttggcactggcagtgagggccaaggaaaggcactgggtgggcccatagaccctgtcccagcagtggcctgcccaccagccacccgctacctctaagccaggcctgagtggctcctgtgcatccgctgggggtgagaatgtctggatttcatgggtgactcacgtagggtcaagaataaaaaaatactttctgttgaaatatgaatgggaaaaacccaccttaaaaaactagaccttttaatcaggaatgtggaattgaaaatgctccccaagtcccctttccacagtgtttgggcagccctaacggaggcgccgggacgctggtgagccagggcctggtgagtaaacggccctgcctgccccagacagggagcatctggtggtggccacgcctcctgcagcagaggggtggggggagggccaggggacaccacggggacttcctgggctttctctgggaggccggtgctctggccacatctgagggtcttcctgacaaggggacacagctgtgacacggtgagtatcctgggctgatggcaaacccagccgggatggctgagccacactcacccccggctttcagagcggggtcagcagatgggcatcaggcgaaaatgttctgttcctggtacttgcgccggcgggcacagcgggggcagcccttcttcaccacagcctggcagctctggtggaagacggtcttgcactcggcacacctggggagagagcagtaggcctgctggtgccggctgggctggaggttgccctgtggccacgctggccagcccttttgaccagaacccacgatacggctgtgatgtactgtgtaacccatgcacgcacaccgtgcctctccgttctggaacaggagagtcttgaaacagtgcttacccatacgtcacacaatgcacactgatattctctgtcctattgcattttttataaatgctgcttgagattcattaaagatctcttgcctatatttaaaaaatatttacggccaggcgcagtggctcacgcctttaatcccagcactttgggaggccgaggtgggcgggtcacaaggtcaggagatcgagaccatcctggctaacacagtgaaaccctgtctctactaaaaatacaaaaattagccgggcgtggcggtgtgtgcctgtagccccagctgctggggaggctgaggcaggagaatggcatgaacccgggaggcagagcttgcagtgagccgagactgcaccattgcactccagcctgggcgacagagcaagactccatctcaaaaagaaaaaaaaaattttttttacttactttatttatttatttttcagagtcttgctctgttgcccaggctggagtgcagtggcacgatctcggctcactgcaacctctgcctcccgaattcaagtgattcccctgcctcagcctcccaagtagctgggattacaggtgcccaccaccacacctggcttacttttgtgtttttagtggagacggggtttcaccatgttggccaggctggtcttgaactcctgacctcaagtgatccacctgccttggcctcccaaagttgtgggattacaggcgtgagccaccacgcccggccaagatggtataattttaaaaactcagccccaggcccattcagggctgcatcccggccagtggacaccgacagaaaaagaactaatgttcccagttcagttttctgctcccacatgggttgcaggaaggtctggacaaatttttccattgagaggttgcggataatgagcaataactgggaacaagagtgatcatttcagcaacagacacagtggcagtggcaggtaccacccaccaggtgccactttgtgcctggtctcatgccaacagtgcagggtggtaactcatacaaccctcctcaacccatgcatacactgaggcgccaggaggctccactcagagagccggcagccacctcttctttaggaagagagatggttccatagaggcagaggagtcctgggaaagcttgtcttgtcccctgagctggactggagctggccatgactgcccagagcatgggctgccccaacaactgcaccaccccttggcacagcacaaagtggatgttcaataagttcctgcccacagagcgaagcctgctgccctgcgtgcttgggccaggctgtgggtgtggggaagggtggggctggaaggcggctggctgggtgtcccgcatacctgactgtggtgtcaaactcaaaggggaagatgatgtcgtggtgctggcagatctggcagatgaagccgcgctgggtgcacaggtcgcagtggtagacatgctgggaggcaaattcaatcagggccttgaggaatccttcatacaccccgtctgcgatctgcggagggcaagtaggaatccttcatacaccccgtctgcgatctgcggagggctggtaaactgaggccccaggcctttcaagcagctgcactgaggtgccatggcaccctgcctggagaacttctaccccccgtttccacacgggcaagaaaagaaaacctccctgaatcaggctgagcaatgccagcgtccagcccgtgggcactgaggtcactgggggctaatgggatttatagctgagacccaaattcactgtaccctccccttggggaaaggagtattccaaactctcttccctgtgatcctggggttgctggagtgcttgtttattccaggggtgctgggggtatccgtccctgcccaggaagctggggcagcagggcaacccaccctgagctgcagaaaagctacagactgctgtcttcttcagtaaactacagacaccccctcttccatcttccttgctgacttctctgggaatgaagtctctctagaggtctgggcgggggaagcatgacactcttacctgttggaggtcagcaacactgaacctatgcggagattccaagagataattcctgtggttgagccttcaaacaaaacacaagcgattctttagaaaggtttccagaacccaggctagcctgtgttgtttgtttacactcccctggcgctgctcaccaggcagacaccccccgcctgggcggggcaggggctaggagtgtaattcggcctgcctgggcttggggcctggtcttcaacgtaactaactagctggtgggaccttgggcacgttacttaacctctctgaaccttgggtttccctctctgggaaatggagttgtctggattaagtaacttatttaaagcatttggcttggtgccaagctcacagtaaacacgtaattaatcatgagaaggaggatgggtgcagacacctgggaccaggaactgggctaagagcttcatacgcattcattcatttgatcctcacaataattctgtgaggctggtactatcacaatcccaactctgagaagaggaaacagagaggttaaatcacttgcctgaggtcacacagctagtaggtgggagagctggagtttgaacacaggggcctggctccagagcctgcacccctgtccacctagcaaatgcctagagatgcaggctgttgtcattattgccaccattacataccagggacagtgctggggacagcaatgcacaggatatggcctctgccctcctgtggcccctggtttggccgagggacagacattcaagtgtctggtttcagtgctacactggtttcagtgctgagacgtgtcctaagcacagcagatcccatttcagaggtggccgggggagcagagaacaagggctcagccgccaacgcagctctagtttctaccacaccaatgggagggatccagggggccccatcctgatggggaggaaacacctgcagaaagtcccttagtgcaaaacctgcctggcctggctgtgtgtgtttacatgggtactgggggtgggaggttactccaagtcagaggatgcttgggaacctgccccaggatgccccagacatctggggacaggatggtgccagccctgggtctgggcctccggggtgcaaactgtggagcatctggaatgggggcttggccttgtcccagctggtggctcagctgtggtccaggggagcccaatccggggtggagagggtgagtctcaccaagcagccacacaggccaagatgccaactggcccctcagtttaccatgctggtgtccccagtaaacttcctgcactctaggaagggaagctgccatttgtcaccaagaaaacatgggacacagcaggctggggggacacaggttggccttcagctggcaggagggtgggcggatctggatggagaattagctttgccatctgtcctctgaccacagtcgtggaagccctgggagcccctgtgccctgggcctgtcaccctctcagcaaggacttggaagtggcttctccgcagtgctcagtcaaggccagaggggagagggcgctgacccaggggtgagaggccacttctcctggcctccaggagagaaactctcatgcactggggcacagtcaggcctacttggggcctcagtttctccacccacacaatgaggagaaccctctttgtcctctggcgtgaggctggctacctgggaaagagaccagaggaatctggacggctctccgggagagaagaagatgaggggaaaggtcgaatcttagttcctggaaccgatgaagtgatggggaaggaaagggccaggcaagggctggaagatccgggggacatgggtggggggcctgggtgccacctgtctcctgagccctggctcctcctctgcccaccccttcccggctgtcgggagggacaatgaggtctggtgggtggacagggtgtggggcatttctgtgatggcttcctcccaagggctggagaggacactgtcaggggcttctctggcccttggagacatgtcccaggtctgccggagagaaccctgccaggcagctgccactagtgcaggacagctcctccctgactccctgacatccaagaccttcccatgtctcagccctctcctctcaaccttccctctggctgactcggtccaggcccagctccctgggctaattactaacaccagctgccacccagggctctccccttcaccaactgcactccactggggccagaatggtctttttgtgtgtttgttttgtgtttttgagacagagtctcactctgtctcccagcctggagtgcagtggcgtgatcttggctcactccaacctctgcctcctgggttcaagtgattctcctgcctcagcctccctagtagctgggattacaggtgcctgccaccacgcccggctaattttgtacttttagtagagacggggtttcactatgttggccaggctggtctcaaaatcctgaccgtaggtgatccaaccaccttggcctcccaaagtgctgggattacaggcatgagccaccgcacctggtcttttcagagtggtcttttctaagccgctgaccggaagtgacagccctatgctcaaaacccttcaatggttccccacaggtggcagatcaaatccaaaggcctcgagggccctttgagttctgggccctgcacctgaagcccagctgcccagagcccctcaagggtgtcagtgagctgtgctcctgccagcctcttgctaccggtctcttagccaggaaagccaggttctcctctgccctttctactcttttctcatttttctaagccccagttcaacagacacacaatgccactggtgtggcaacatgtgtgtgtggatggagtgaggtgcagaaacaggtggtggtgggctctgagaagggctgattgaatggtctgctttattccctttcataaattttcctcgcttggaagattgacctttgtaaagaagaaaaacattttagaaggaaaaaggaaaatatctctgcatgccctcagctcagatgccatctcctctgggagctcctctggcccctgccaaggctggatcaggtgccctcagggcacacacgatgctgacccagggccatctgtggcccagactctgggtccctcatgcagctctcaccactgctcaggaggccacaggaacagaggaatcactggcccattttatagacgggaaagctggacccggagaagtgaagcaactttcctgactcacagtgggtgagggcctcccacactctttcccctgccccatgctgtttccatgggacttccacaggcatgggaagcaggctgagcgcctagcaggagtacagcgctgctgcccagggatggagcaggagggtcagggagagagacagggctgcccctggtgcccacagagacaggtctgtaaagccgatgaacagactctctcagcagggtggggatgggtgaatggggctggggtccacaacccaccccacaggcatctggtctacacaggtctgcatgcctgtgcaggtacctggctccttgaccaaggagggtgataaggccccacctgaccccagagatttcaccacctggttaggtgggcaggaggatagtctctctggagccctgggtcatggactctcagaggtagggagtaagtcagcgcttgccaagaggtggagacccagtcacccacgatgcttgggatgggcagagcctcctggggtgaagtcttctagggtctagggtcccacatggtggtccctggaaggctttctgttcttccaggccctacagaggagaccaaggctcagctggcagctgtggggccaaattctcctctctgcctaggggagagccccctgcagtaccccttgagagcccctggggacctgctcgaggcacaccctggccctgaggaggcccggctctgggagcactgcagccaggatggaggaggcagtcttcagagaggcgctctctgggccagccctgtggggagggaaggccagacgggggaacctggaggggcttgtgaactggtccctgcccccagaaacccagcagaggttgatttgaagcccattctgggcagtaggcaccggcaggcttctccgcctgaggtctgccctcctgagggtgctgggagagtacagccctgggaagactgcagcctgggcgtgacctgaggactaggaagcgtttatgacaggcatggagaggcctaagtccctgttgaagcccagcatcacatcccattcctgagcaccaaaggccccaggccctgggtaagagaagcttcctgaagggcatcctgagggccccgcccggatcacgtcttctttggagaatttcaggagggaggctggcatgggccagacgactggctggtacagggaagagatgggaacatctggccctcacctgcctctcgccacactccccacttccctcctcactgtagccaaagttctccctgggctttccaccaacggtgccttcgttcatggcctgtgcgtgccattccttctgtctagaatgctctttccccctttgcttctcctttctgattcttcctaatttttcaagtctcaccttataagtcacttcctccaggaagtccttcctgctttgtcctcctctgatctgggctggatgtcaagcctctgtggttccaggacgtcctgcctctcaccctcacccccagatggagttgctggctttcccacctgtctccctctcaccctcacccccggatggagttgctggctttcccacctgtctccctctcaccctcacccccggatggagttgctggctttcctacttgtcttccctgccaggccagagacttccggcgggtcggccctggctctgtcctgctcattgttggagcctacatgcctcgccaggtgtgcagtgcttagtatgttctcagtccatgtttttgagtgaacaaatagatacatgaacaaaaccccaaaatcacccccaaaagatgtgatcatttcgcaggcccagtgggaagatctctgcccaggtttcctccaggtggacgccttgccctgggcactgcccctgtgtgtgtgtgcatgtgcacgagtgcctgcatgtgtgtacatttgtgcacatgtgcatgggtgtggatgtctatgcatttgtgtataaatttatgtgtgtgggtatgtgtgcacatgtgtatgtgtgtctgtgtgtacatgtgcatataagtatgtgtttgtgtgcatgcatgtgcgtgtgtacgtgcactcacacgcatacacgtagaggttgctcacctcttgctgagctccttcagggcgccactccggcacaggcccaggtaatcccccaggagcttcagctgctcccgtctcctcccaatgaggtgcatccgctccacatgctcgtacagagacgcgttcaccatctgcaggttgatgaggggctgggcccggatctgtgtcagaaacttcagggcctgcctgcagatctgggggtaccaccaggcattggggatgggaaggaatggctgttcagtgagcactgcctggccaggtgccacatgacctgctcacttacctgaggggctatcttcattttacagatggggaaactgaggctcaaggagatgaagagatttggctagggtcacccagcttgtaaatggtacagtcaagctctgaacccagtttatctgactcccaaacccgctctccctctaatgacaagggtcactgccccctccccaatcatgctgagatgagggagggactgctctgataacgccccctccctctgggcctcacagatccttcccactctttcctgtcctcccagcccctatttccccccactgaaggaaacaggcactcccttctgtgccctgactcaggaaccaggtgacgggctgagtcaggctccagccacaggaagctacagatcagacacagctcaccaacaggcttccctgagctccctcggctcacaccagtagcaacaccgggactccgtgtgcagctgagtgatccatctcagtctctcctggctgacagggtgttgaaggttctacccttggccctgatcctaataccaatgccaataatcgagcgcctactatttgcaaaacactgggtcaggaacttgaccacatcctcccgtcattctcagaacaacacgttagggagggtgtccctgtccccgttttctagataaggaaacggaggcttagaggggctaacgtagcttatacaacctgcctgcagaacctgccaggtttgagctgaggtgtcatctctgaacaccaggctgctgcactaatcagaagccccctcccctgcagtgatctcgctgtatcataaggacggaggagctgttgtctccacagccgacaagtgcacagtgactagaagtctggctttggcctggctcagatctttaacatcttaactagtcctctcgttacatattttatttctggtggctttgtttttgatactattataagtgattatcttttaaaatagtaatttgtttgctgatatatagaaatgaaattgatttatttgactgtcgtatccagcaaccttttcaaattctgataaattgtgtaggggaaaaaaagtctggcttcggagtcagaatggaattgaatcctgcctccaccactttatacctgtatgaattggtgaaacttatccctctctgtgactcagtttcctcatctgtaaaatggggaaaatgagagcaattaaggctcacgggtttggggccttttcgttcgctgctgctgctttagtgctttggcccggcactcggcaggatgtcagcccaggactggagcttctttttcatgggattattttgaattcagattaaaagaggtattccaggagagctcctggcatagggcctggcaggtggcacatccccagtaaatgtgagctgctatcagctgctgtgtgagtgcctggtgtggccctgttgtccccttgagggttgggggactaaactggccctcaggagacctgcccctgtatttgggggctgagggggcctctgacctcttgtctcccagctccaccagcatctctcacctcccccagcaatggacaacctcttcttttcccaaagcctggggccctgaggtaccagccccccagcccagggacagcccaatggcaaactcctggtgacttgggtcaagctgctgttctccagtcctaactcagctcttcccatgacttggccccaggccttgggtgaggctccagtgaaataacacacaggaatgtgcgctgaacactgccaaacactgcagatgggcaggggctttgtgctccccagcgactgttcctatcctgcgggaatggaggagacagaaagaagccccactcctgggctgacatcctgccagtgccagccaggcctcagcaccagtgggtcagccaggcctcagcaccagtgggtcagccagaacagcaacggcgaacaataaggccccaaacccgtgggccccctactttctatcttgagtttccctgtctttcctaggccagcaatctttgagagggagagcgagctgaggatttcctgatctcagatatgcctagaaaacgattgtacttttcttttttttttttttgaggtggggtttcgctcttgttgcccaggctggagtgcaatggcgcaatctcagctcaccacaatatccgcctcccaggttcaagagatcctcctacctcagcctccggattagctggattacaaacatgcgccaccacgcccagctaatttttgtattttttagtagagacagggtttctccacgttggtcaggctggtctcaactcccgacctcaggtgatccgcccacctcagcctcccaaagtgctgggattacaggcatgagccgctgtgcccagctaggattgtacttttctagttagaaaaggaagtggcacaaggatgagggcagtgaataaggagatggctcaacggaagtatcagggtcctgtaaatagttaacgtgttttatgatcaaagggttctttgcatttttggtgattttgaggcttaatttcctctatgtagttagttaaatatttaacactgagagcgagggcggggacaaggcaaacaacaaaaaaatcaaaatgaagccaacttctgcggggtttccccgccccagggaggtggaggttgaggtagaactgactgagagaatcaccctgcactatgatgaagacacatccacacatcaggactacatagctggcaggccctggctctccagaggagcaaacagcttcttccttgtgtttctgtgtctgtcttagtagaaatctgtgcccttggaagaaaaccaaatttgcaccccttgaggcagacactaaccaagtgaattaggtagatgggtggatgggtgggtgaatataggcaggaggtgtgacaggccccagggagagaaaggacactgttcttactgacaggcacacactgccacacctgccctcccaacaaccccgacacagacactgttgttaaccctccttttacagatgaggaaactgaagctaatttgctcatggtaacacaggtaggaaagtggctaagttcagctggagaaaaggaaaattctgaaagactttaagatacatcttattcaaaagcatttggtgaacataaaaaagtacccaaggcataatattaagtgaaccaagcttcttataaagcagtatgagtcctgtgtgatcccaactttataaaaaatagatgcatatgtcaataaatgcacagaaaagggtataccccgaaatgttaataatggtgatctcttggttatgacacagaattttgattggtctttgggtttttctgtaactttaaaatgttaaacaataactgtgtattatcttaataatgggggaagtcacagaaaaagtgcttttcaaaaacatgaaataaataagcccatgtagggcctacaggggagtgcagtcacctgggcctcatagggttggcaaaggcaaggatgactgctccaaggtatagccctggccagcccatctacccatccacctacctattcacccatccacccagccatctacccaccgtccacccatctacccatctacctacccatctacccattcacctaaccatctacccatctagccatctgcccattcacccacccatctacccatctacctacccatctacccattcacctaaccatctacccatctagccatctgcccattcacccacctatctacctatctacctacccatccacctacccaccaagccatccactcatccacctaaccatttacccatctgcctatctaggcacccatctacctacctatccacccattcaccaatctacccaaccacctacccatccatccatccaccaacccatccacctagccacctgctcattcacctacctacctacccatccacctaaccatccacctagccacctgctcatccacctacctacctgcccatccacctagccacctgctcattcacctacttacctacccatccacctacctacctgcccatccacctagccacctgctcattcacctacctacctacccatccacctagccacctgctcagccacctacctacctgcccatccacctagccacctgctcattcacctacctacctatccatccacctaaccatccacctagccacctgttcatccacctaactacctgcccatccacccatccacctacccatccacccacccacctagccaccacctgctcattcacctacctacctacccatccacctaaccatctgctcatccacctacctacctacccatccacctaaccatctgctcatccacctaaccatccacctaaccacctgctcattcacctacctacctacccatccacctagccgcctgctcatccacctagccacctgctcattcacctacctacctatccatccacctaaccatccacctagccacctgctcatccacctacctacctgcccagccccctaaccatccacctagccacctgctcatccacctacctacctgaccatccaccatccatctatctaatctatcaaatctattttatctatctatctatcatttatctgctggtgccttaagcagttatgtttgtagctgcaggaaaccatcctcaaactctttcctcctggggaccaagacagccaccgatagagccctgcccaaggctgtggacaggcaccaagcttttctcttggttagctccccaacatcacagtgcctgaaccagtgaccctggcttcccttgtttagaggagccaaactcctctaaacagatgaacagcagcagcaaagaggagtgaacacccctctgtccctcagcagctgggctgctgggcttgagacttaccgggcgcttggtgaggtcccagttgtggatgatcctggccggaatcactgaggcatcgtcttggtggcagatgtcacagtaatagaggccagagaaggcacagagcttgggtcgtacaaaggagaagccgatctgccgggagcagcctggggagatgggtggagagtgagtggtgtggccagagtcagctcctagtaacttgggagctgctgtggtggaaaggatctgctggttgatttttttttaaggtaggcacaaacacaagaataaccaccactcgtatttccaccactcagaactcccctactaattaatctttacaacaacacactgtaagaactatcattattttacagctgaagaaatggatgctcagagaggttaggaaatctgtctggtcacatagtgatgaagtggcatggctggcattcagatctgggtttggctggttccagagcctgagttctgctccactaccccttgctgcctgtgtccggtgtccccactgctggcttggcaatgccagcctcctctaggtccacccctccactcgggccccagaatggaagcagcagagtaggggctgtggcaagcagcgaagtagctgggggacagggaccagggtcggggctggcaacagggagcggatgggcagccagcagggggcaggggagtgtgcacagtgtctgatgcctcgggactgtggggtagggctggcttcagcccccttggttggaggtgtctccacagccggagccagtgggaatgggagtgggatgtgccctgggcaaaaagcagaggccctgactcaaaccctgaacatgtgccctaactcctccaagggcaggcagaagggtccccgggccttgggaccagagggcgggttctgctcctcaccagctgcctcaccctgaccttcacctgatttcttcaaggttccatttcagtgactgtaaaattcagctactaccagctattttgtggggttattacaaagcttaaatgagacaaggttctgcaagtaccctgcaaattatgaaatacaacccagatgccagtggttggtgtctgccactgagccatgcctgctgggtagaaaggaaacccaaactccccggtggcacagtcccacccgctggtgggtggcagccatggtgagagttgcccccgcagcattcacacccacaggcgaggaaccctttcttgcaagccctggagtcctggccccctcagagcctggccttcacaggctgaagagcaaagtgtgagcgctggggcaggcgggggagaggtcaagcgaggcttgcaggtgttttctgcaggaagctctgttctgcctagcttctcccatcctcgcggggccaaccgcagaccaattcctttcagatgcttgaaacaggcttccctccagtctgtgccaacaggacagctcccaaaccaaggctcagcttcttgctctggccttctgcagcaggacaaccccctcacaggtcacctaagggtcccatggtgatgggatgccatctgcccctggatggtggggggagtgggaggggctaacaatggaacatgggcagggggatgtcactcaaccttgaataagaccctagagggatgccctctagggtcctgcctatgagcaaaggctctggggcctgactgtcagggtcccatttctgcctctggccaggcatggttgctgatatctgtaatcccagcactttgggaggctgaagcaggaggaacacttgagcctaggagttcaagactagcttgagcaacagggggagaccccatctctactaaaacaaacaaacaaacaaacaaaaaaggaaaattctgcctctgccacttactagctgtgtgagctcagtagcagacaccaaccaggtacttaccagctctgtgcttcagtttcctcccctatcaacagagatgataatagtagcgcctatctctacagggttgttatgagacttaaatgagataatccaaataaagcagctggcccagtgcccagcacagaagtattagatttgatgatgaggaagacatagcagatgtactgacttggaataacatccacagtgtaggaaaaaaccaagttgtggaacaatatatccagcattcaacacagcagccaagagccccgtgtgtcccctttaaatgcaaatgaatttaaatagaaaattcagttgcttaaccacactagccacactttaagcacctggtagcactacatggctcgcagctatggcactggacacacagatctaggacattttcatcatcacagaaagttctattggacagcactgaatagcacgagcccatttttataattaaaaaaaagggtgtacacttataaaagcagcagaaatatttggaaggaaaccatgcccctgctctgaaagaacaggacggtagagcaagaagaaaatgaagcaggctgggactccctgagcagcgcagtgagtagccagcctgccgcccatcagtgggaggtggcaggagagggacgggtgagcagggcccactgcctatgagcagggcactggccccagccggggctggggaggagcagaagctgtagggcaagcctgatctgtggcctcatccctaggggaaggatgggggcatttgcggggaggcagaagggtggggagcctaaatcaggaaccagcaggaggtggagtgaggctggcaggctgggggtggcagcagagcaaatcggcacctgcgcagaagcagccttgggagtcaaggcctttctccatggggatagccaccaggtactgcagcaggaagccattctcccgggtggcaaatttcagcacctcctgacagttttcatccaggctcccgcccagggtcaccgcctcctcggctgtctccaagtaggatgccaggactttgcggaccagatccctccacagggcggcttcctcggcgtttccggcctgcagcttcaggacagccttggccgtgatgattttgaagaaggatgggcccccaaggctggtgtctggcaggatgtcccggatggtctccacgccgtggctgtcactcagcatcttctcattgttcctgatgcggaaacatttcagagcctccaaggacagagaaaatatatagggcatccaggtcctgtccatgtacaagtacagcagggactccttgatggcatctggctctggaacctgggcggacgaccagtcaaactgtgtgccctggagggccgcgggctccgagagcaggtctgagggagagaggcagccctggggcgcctcggggggttcctcaggctggtctgggtactgcacgttcacccactcatcctcctgctgaggccggaccttctgcagggcctcccgcacccggtccagccagtcctcagcttcgtcctgggaggaggcgcgcagggccagcttcttgccagagaagaccagctcaaagcgcccatcactatgggctggccccacagactcacagcgaagcagcgagcagttctccacacaggtgtgctcctcgttgctcaggtagaggcggaactccagcggggagagctcgcagaagagctccttccagatgcccattgccccccgccgctccacggtgcccagcttcatgagaccccggaatgggttggacagtcctggaggcagaggcaaaaaggggcacattagttggcgggcctgtctctgtcctgcccaaggcagcctctgctgcctgatgccctgcagtgcatgtggccagtgactgtccccagaacacaggccagccacggggcactatcacatgggaccctgaaagctggatgggaacatccccattctcaccgtccactgctgctcttgcgtcctgtatttcactgagaaaataagagcacccaaaagatcccctccacacgccctgttccctacacccacgccttccctcctgctgccagggatgaaccaagtgtgcttctttctgcgtgaggccaaaccctccatttgtgcaggaggtctctcccttggccaactactcaaggacaaggagcagtcctctcctctgtcactgctttcttccttctctatggggtgactcccatcggcacacatgcacgctgtcatttctcccatctttagaaacacctctcgtctccatgcacttccctaatgaccaccatatttctcaggcccctttacagaaaacctgtttgaagaggcatcaaaactgttcatcttggccggaagcggtggctcatgcctgtaatcccagcacttcgggaggctgaggtgggtggatcacttgaggtcaggagtttgagaccagcttggtgaacacggtgaaaccccgtctctactaaaaatacaaaaattagccaggtgtggtgagcacctgtaatcccagctactagggaggctgaggcaggagaatggcttgaaccgggaaggcaggggattgcagtgagctgaggtcactccactgcacttcagcctgggtgacagaggagtgagactccgtctcaacaaaacaaaaaacctcttggtctctagtttccctgctcccattccttctcgaacctgctccaagtaggcttctctccccccattctactgacactgtttctgagatggtcaatgccctcctcgttgccaaaccccaaggccactcctcagccctcgcccccacccttctatctctctggctcggtcctccctgtggcctctcacgttagagtgcccagatgtcagtcctgggtccttgtctcctctctgtagatgccactttctcaccactctacctgctctcaggctttagctcccaatttttatcgccagcctggaccttgttcttgaaatccacattcatatatccacctgtgccatacatgtccactaggatctcagctgacatgtccaggatgaattcctgctgccagcctgcttcctcctgaatggtcctcatctcaccaaatagcaaaattcatccttccagatgcctgggctaaaaatcttggtgttaccccaggttttctttctttcgcagcctacatcagcaaatcccattggctctgccttccacacatccggaatccccgcctctccccagctgcaccccacccactgtcatctctggcctggcttgtgatgacaacctcctaactggtctttctccccttctcccctgtagtccctcagcgtaggagccatgatgacccatttaaagggaagtcagagcatgtccctctgccccaaaactccacagtggcggccatctcccttagctgaagccaaagtgcttccagtggcccacaggcctcgtcagattgacctcatcgctcactgccacgcccccatctcctctctcctgccactctggtctccactgtccctggatgtgtcaagcgcagccccagcgcagggtctttgcatttgttctccttgcttgaaacacgtacattgcctcatgactccttccctctctccccttgcatctcctcaaacatccccttattggtgagggcttttctggccatcctatatgcagtggtccactctctacctctgtagacaggtagagatttactgtcctccatagcacttatgaccacctgaccacacactatgcttacttgttaattttatttcccgtctcctctactagaatctaaatcccatgaagacagggacactgctttgctgcctgctatgtctccagcacttagaacagtgcctggcacatcacagagcctcaataatatttgctgaatgaatgagcaggtgagtgcctatgtatcacatgttgcccacagctccctgctgcctggggtgtgacaacaaccagggtgtccaaaggacacacaattctctctccgccagcctggaatagccttggagatttcacactattctatgggggttccctgcccctcaagaaacctgatggcctagacctgaagcacagcttcgctggcaggttagagaccacagccatcacacgggccaacagacaaacctaacagaagccagcccggagaccgggctctacccacacaacccatgccagggctacccacagcaaggccccctgagctgggcaggattctctgctgggtcactgcagacagaaaatgaggagagaaagagaccaattctagagcgtactttttttgtttgttttgaagaggaaacccatcatgaaggttactgaaaaatttggttatggttatttaaggctttctggaatttcagtgtgtggagatcaagctgaccttgctgtaaaaagcactggggaggtcgggcatagtggctcacacctgtaatcccagcacttttggaggccaaggtgggtggatcacatgaggccaagagttcagaccagtgtggccaacatggcaaaatcctatgtccactggaaatacaagaatcacctgggtgtggcagtgcatgtctgtaatcccagctcctggagagactgaggcacttgagctgggaggcaaaggctgcagtgagctgagattataccactgtactccagcctgggtgacagagcaagactctgcctcagaaaaaaaaaaaaaaaaaaaaagaagcactggaggacattaaacaaatagcagatcctccagcctggccaacatagcaaaacaccatctttattaaaaatgcaaaaattggccaggcgcagtggctcatgcctgtaatcccagcactttaggaggccgaggcggggtggatcaccggaggtcgggagttggagaccagcctaaccaatttcgagaaaccccgtctctactaatacaaaatgagccaggcatggtggctcatgcctgtaatcccaactactcgggtggctaaagcagaagaattgcttgaacacgggaggcggaggttgtggtgagctgagatcacatgattgcactccagcctgggcaacaaaagggaaactccacctcaaaaaaaaaaaaaaattagccaggtgtggtggcaggtacctgtaatcccagctatttgggaggctgagacaggagaattgcttgaacccaggaggctgaggttgcagtgagcagagatcatgccactgcactccagcctgggcaacaaagggagactccatctcaaaacaaacaaacaaacaaaacaaatagcagatttgatcaagccacccagagctgttacataaaccaactactgagggtaaacacgtttggaaggaccatttaaaacacctggggcttcatggggccggatgtgctctgagctacaggtggaatcaagagttttctataatcataaattgcatagttttcagggaaaatattttcctatttgactggtgaaacagtatttttgtcctctgtaggcagttttgagacaatatactacttttcctgaaatgcttccctgaatgaacatgattatgatggcattctggaatgaggttttataacacttgtgggaacacactacccctttagcaatggaaaacagaacttcacagctgccttctgaaaggcctggtccctgcagatgggacccacccgggaccctcctggtaacctacccatctgtctccggtgtaccacccggaagctcttatgcccctgggatggggctgcctgggcttgccttcttcctggggaaggtacacacgcttggtctaacgcccccagggagcagttttttcttggttcttgagaaaaatgcctgtggagaccaggccttgaccctggagtccccctgtaagaagctattgggtggtctgaagcactctccaggggttgctcccgggaaggccggtagaagtcatcctctgagatccagctcttgtttttctgttgggaaagaagacaacagttgtttgttttaaagtttttttgttttgagacggagtctcgctctgttgcccaggctggagtgcaatcgcgcaacctcggctcactgcaacctctgactcctgggttcaagcgattctcctgccccagtctcctgagtagctgggattacaggcgcccaccaccatgcccagctaatttttgtatttttagtagaggcggggtttcaccatgttggccaggctggtctagaactcctgacttcaggtgagccacccacctcggcctcccaaagtgttgggattacaggtgtgagtcactgtgcccagcctgaagttttttttttttttaagtctttatctagatatggctcttatatcataaaattaacccacttaaagtatgtaattcggccagccatggtggctcacacctgtaatcccagcactttgggaggctgaggtgagaggatcacctgagcccaggagtttgagaccaacctgggcaacacagtgagaacccatctctacaaaaaataactagctgggtgtgatggcacacacctgtagtctcagctactgaggaggctgaagcgggagaatcgcttgagccagggaggtcaaggctgcagtgagccgtgatcacgccactgccctccagcctggttgcagcctaggcaacagaatgagaccccatctctaaaaaaataaataaataaagtgtccaattcaaacattttggcttagtcagagttgggcaatcgtcaccaccatctaagtttagcaaattttcctcacccaaaaaggaaaccccgtacccattagccgtcatccccatttcccctggccactctcagctctaggcacctacttacctactttcagtccctacacacctgcctgttctggacatctcatatagatggaaccatacgacacgtgaccttttgtgcctgcttctttctcttagtgggaggttttccaggtgcatccatgttatataagcatgtttaagtgttcattcctttttattgccaaataatattccattgtctcgatccaccacatttggcttatccactcctcggctgatggacatttgggttgtttctactttttgtcaattatgaatagtgctgctatgatcacttatacacaagtttttgtgtagacatgtttcattgtcttgggtatatacttaggagtagacttgctgggtcatgtgtaactctatgtttcccttcttgaggaactaccaagctgttttccaaagtggccgcaccattttatattcccaccagcaatgtacgagggttccaatttctctccttgggaaatctatccaaatccattggaatctactgaaatccattgtctgtcttaaaatggggctgtctttttgttgctgagttgtgttgtgggttgaattgtgacccccccacaaaaggacatgttgaaaccctaccccccagtacctcagaatgtgaccttttttggaaatagagtctttgcagaagtaattagttaagatgaggtcatgttggagtagaatgggctgttcatccagtatgactgatgtccttataagaggaggagaaaagatacacaaagagaggagaacaccaagtgaagacagagatacagaggaagaacttgtatgacagtagaacatgtgtgacagcagaggggagacaggagtgacatgtctacaagccaaggaatgcaaacgagcacctgcaacgccacccaggagaaaggcgggaacagattcttccttagattctccagaaggagcctccagaacgatcagagaataaataccagttttgttttgtttttgagacagaacctcactctgtcacccaggctggagtgcaatggtgcaatctcagctcactgcaacccccgcctcccaggttcaagcaattctgctgcctcggcctcccgagtagctggggttacagatgcttgccaccatgcccggctaatttttgtatttctagtagagacaaaaccttgtcggccaggctggtcttgaactcctgacctcaggtgacccacttgcctcagccttccaaagtgctgggattacaggcgtgagccactgtgcctggcctattttgttttgttttgttttgaggcagggtctcgctctttgcccagactggagtacagtggcgcaatcagggctcattgcagccttgactgcccaggctcaagcaatcctcctgctttagccccactgaatagctgagactacaggcatgcaccagcatgcccagcaaattttttatatttttagtagagatggggtttcaccatgttggccaggctggtcttgcactcctggactcaagtgatccgcccacccttgcctcccaaagtgctgaggtcacaggcatgagccacctgcccagcaatgtctgtttttgttttttgttttgttgttgttgttattgttgttgagacagagtcttgctctgtcgcccaggctggagtgcagtggcacaatcctggctcactgcaagctccgcttcccgggttcacgccattctcctgcctcagcctcctgagtagctgggactacaggtgcctgccaccacgcctggctaattttgttttgtatttttagtagagacggtgtttcaccatgttagccaggatggtctcgatctcctgacctcatgatccacccgcctcggcctcccaaagtgctgggattgcaggcatgagcgaccgcgcccagccaatgtctgttgttttaaaccaccctgtgtatggtactttgttatggtggccctagggactaattcaagttgtaaggtgctttatatattctgaatacgagacccttatcagatttacgatttgcaaataatttctcccattctgtgaggtgtcttttcattttccggatggtgtgccctctggagcacataagttgttagttttgataaagtctagtttatctatttttgttgttgtttttgtgcttctggtgttgcatcttaaaaaaccattgcctaagtcagtatcacagatttacttctgtgttttctgccaagagctgtatagttttagctcttacatttaggtttctggtccattttgagttagtttttgtgtaaggtgtaaggaaggggtgttattattttgcatgtgggtattcagctgtcccagcatgtagggtttctcagtcctgcttttgggtttgagatgagggagtcctggcgagcaggcctcagggtcctcattggccgcctctgtctctgccgcccacttctgtgcaggcccctgcaaccccaggcagccaggccctgccccttcccttcgttgttctcttttgaatctgaagctgctcactggctggggaagatggggttgcggggagcatctggggtgagtgggcttgtgggagtggattctggttccttttctccagtatttcaagtcctccctggcattctgtgcctcaacatggaagggcagaggcaaggaagctggctgggccactctaagtggctgtgtacacagaggaaatgagtcacacaagcagtgggaccagccccactgttttgttaagtgccactaacctcaccctgacatcgctatttccagtccctgaatcaagactgcactccctgctttgtaaacagggaagggttggtttggacagttggatccattcagatgctacacgactcctcaagccaagggtggcaagttctgactcaggcaacttgaggggtagctcacagaactaggtccccagagactcctccacggggccttcagaattggcaggtgcttcccccctgccagtgacagatgatgtgtcagtcagggcagccactggggaccatccacaacactagattctgagcaaagcctgcctaggtcatcaagaactgggggacccccctgaggaaaatgggtgggagaaacagctccctggcaaccatgtggctgtcctggcagcctcacatatacctgggaagttgtgtgatctccagcgcctggtgggagagggcactgtccctgaagactcagctcaggagacatccatcgcctctgcctggaagcttctctcacccttccccagcctccaccccttcccaccccctagctgggttagggcccctactgggatcccacaatattctgtgcttaccctcattctagcatttataaggctgtttggaatggttttcttgatatctccagcaagtgcctgcccgagtcatacaagatgagggaataaatcatgaccatcacaatgtctttaacataaaataacaaaggtgggtcaagtggactggaaggaaggagacaaatgtaaattttaagattatggacattcagaatgggcatgatggatcatgcctgtaatcccagcactttgggaggccgaggcaggaaaattgcttgaggccagaagtttgagaccagcctggccaacatggagaaaccccatctctactaaaagtacaaaaattagctgggcatggtggtgcatgcctgtaatctcagctactcgggaggctgaggcacaagaattgcttgagccttggaggcagaggttgcagtgagccgagatggatggagctattgcactcccacctgggcaacagcacaagagtctgtgtcaaaaaaaaaaaaaaaaaagtatatggacattcactggggaggacttctctctcctttgaggaaaaagactactaggaaatgttcagacacagtccattgagcacagctgccaggaaatgaaactagggaacatcttttactctcttaagcaacagggaaaaaacagtggaaatgcaggttcctcggagcttctgcacatgggcctggacagagctctgaggctgtgtgcccctggccccaggcaggtggggagcagagagagggtgtgagagagagtgcatgcatgaacaccactgtttctctcttctctcctttttttcttttagagatggagtcttactctgttgcccaggctggatcacagtggtgtgatctcggctcactgcaacatttgcctcccagtttcaagtgattctcctacctcagcctcctgagtagctgggataacaggctcacgccatcatgcccggctaatttttgtatttttagtacagacggggtttcaccatattggtcaggctggtctcaaactcccgacttcaggtgatccacctgcctcagcctcccaaagtgctgggattacaggcgtgagccactgcacccggcccccttctctccttttttcccaccaccttccgacaacctgctcactcagggtccatgtctggccagcaccccgccctttaacagtggagagaaaccatcatcgacgaaggatctataccagagctgcaactgccaccagcgacccaagacagagaaatgccaccttgcgttactaaagggctcatgacaccatatacaacagctgaatccccaagaggagtgtggctgaggagtgagacgaaggtctctgggacactttcagaaggatgagactttgtccagccagtcctcattatgccaggcaaaggaactgcctgtactcataactgtggaaggggaaccacataccatgggcaggtggtccatgggggcagtgattaagagcaagtcctagaactcacactgccttttgggagttaaactgaaacgaactcacaacccccagatcccagacatgcatcacccttgagaggcccctactccctgcacctctccttcccagtgcttagcacaagtgtaattatgatgtggataatcatttgtctaatttaatgtctgtccccaaagggcctttgtctgtcctgttgtatcactctacccctaggacctaacatggtgcttggcttatagtaggtgctttgggttcaatgaattaaaaataaatgtttttaaaagaaagactgaatgggtctctacactataaaacttgacagcgaccccaacatctcccccaaaataacatcaaataaaaagcacgtggctaactgatagaagtacagaaagatgaggaccacaggggcagacatgcagggcacagcctggcactgtccacaggccaggagcccagcaggcccacatgagctggcaggctattcagtggcacctggtgactacctactgaataagcagtgaatgaatccacaacttccctgtgagacagacacaggacgggggcaggatccgagattctcacatcggattcagcaccaagcgcttagatgtcacattccctaagcaaccttccagcaatcagagtcccctgtagctggcacagaggcagagcctgccatgatcacaccaacctgaccaccctgtccactcgatggtacacttcgatgacccactttggcctcccaaattgctaggattagaggcgtgagctatcacgcctcgcctgaacgtccataatcttaagtttcacatttgtctccttccttccagtccccttgacttatctttgttactttatattaaagacattgggatggtcatgatttattcacacatcttgtatgattctgggccaggtacttgctggagataccaagaaaaagaaccattccaaacagccttatagctaggatgggggaacaaaataaacttaggaattggcatctcaagagtctcttgggagttcaagaactattcatccatgcctactttctcccaggtacagtgcttggtgctgacaatacagaagtgaacaggcctggtgctctgtatcatagagctaatattctagtaaggaagacagaaaataaacaaggagacaaagagataatatactgtaattgcacatagtgatgagtgttataagcaaagtcaagcagatgaatgggacagagagtcactggggatggtgcttttgagctacgggggtccggtcagggaaggctgagacaacaatgaagtgagtcgggaaagaaggaacagcaaatgtaaaaccctgaggctgggccgggcacggtggctcatgcctgtaatcccagcactttgggaggccaaagtgggcagatcacttgaggccaggagtttgagaccagcctggtcaacatggtgaaaccccataattttgtaaaaatacaaaaattagctgggcatggtggtaggcatctgtaatcccagctacttgggaggctgaggcatgagaatcagttgaacttaggaggcggaggtttcagtgagctgagattgcaccactgtacttcagcctgggtgacagagtgagactctgcctcaaaaaaatttttttttttaaaagaagcctgatgttggaaggagttcgcttggactatagagctgcaaggaggccggtgggtcagagcttagtgagcaaagatgctattctgtcccaccagctttgaggccctggcaagataagatgcctgagcctgcaaagcagaagctagaccatgggcaggagtgaactcaacatgcttagtgccactctggagtcctgtggggcgcacagcctgcatccccagcagacgtcactctgcctccagcttgaggaaggggctgcagagctttcctcttcagccttcagcttgagttggcaggtgcacagtcacaaccttcagggtcctagagcattcattttcaggaagcaaatcttcaggatgtactgaagcatcttcaggatagcaaattcgaagactctgacccacactgacagttttgtgatttacatggtcatattcaagaaacagtgaggccaatcagatatccatatggaaaaatatgaggtttgacttctaacaccacacacaaaaattaatcccagaaagatcataaacctaattttgaaagataaatcactaaagcttctagaagataatataggcaaataccttcagatccttgggggagatgaatatctcttaaatgggacaaaaaccaagcaaaccataaacaaaaagactgataaactgcacatcattaaaagaacctctgttcaataaaaatactattaggaggtttaaaagtcaagccttatagactagaaaaagatacttgataaatatactatttttgtccaataaaagacttatatctgtaatatataaagagttcctacaaatcaacacatacacatacaactcaatttaagaccggaatgacaacttggacagacattctataaaagaggattgactggccaataagcaaatgaaaaggtatcatcatttagtcatcaaggatatgaaaattaaaaccactacacatctaccagagtggctaaaattaaaaagattggtaacaccattggccaggataaagagcaactagaatgctcatttgttgccaatatgagtataaattagcacaaacactttagaaaactgtttggtggtggtatctattaaaggtaaacataagccacccaaggacctagcaattccattcccaggtatatatacccacagaaataagcaccgaggttctccaaaagcatgtatgagaatgttcactacagctttcttcataatagtcaaaacctggaaacaacccaaatgtccattaacaggagaatgggtaataggttgcaatatatttttacaatggaatactgcagaacaatggaaaagaattaactacagcctcatgctatatgtacagccacacaccaccatgcccagctaatttttgtattttttgtacagatggggtctcactttgttacccaggttggtctccaactcctgggctcaagcagtcctccctcttggtctcccaaagcgctggggttacaggtgtgagccaccacacccagcccccaaatattttcattttaacttgtaatccataaaaatgagattttctattcttttatcatactaagttattgaaatccagcgcttatttcacatggcacatctccatttggacttgccacattttaagtgttcaacagccacacgtggcttgtagctgccatattggacagcacggctctaaaacctgggtcatgttgcaaagtgagtatgctcaaggcctagtattttctaaaaacattaatttaataggctgagtgcaccagctcatgcctgtaatcccagcacttcaggaggcccaggcaagaagatcgagaccagcctggccaacatgatgaaaccccatctctactaaaaacacaaaacttagccagacatggaggtgggcacctgtaatcccagctactcaggaggctgaggcaggagaattgcttgaacccaggaggcgaaggtggcagtgagcagagattgtgccactgcactccagcctgggcaacagagcaagactccatctgaaaaaaataccaaaaaccaaaaatcaaaaaatattaatttaataataacaagtactaaggaggaaatgaaggttcagagagctgaagtgacttgcccaaggccttatgctggtgagtggtagtggttaaagagctgagactgcggtcagacaagaacaaccttcacaaagtgacgtgaaaatgacaggagatacacacgggaagtgatcagcacagtgccgggcttatatctacagctcacatgccaagaaacagccgggcttatatctacagctcacatgccaagaaacatgagccccatcatcatgatgctattaacactatcactatgcagggagaggaaggctaacagggaaaaggcagagaccactcagggtcactagctggggaaaccctgtgtcagctgacatttcccaagactgccccctgaacggcttgcaccactcaccggactggtgggtgaggaaactaccagcttcagaccagctccgtcatgagcctgggccttctgcaggccattcccttggcccacttctctggctgtctcgctgacagtactagaaggctgctggcctgaggtgctctctacaggctgctgtaagtccagggggctgggcgcctggggacgcggctcctgcacgtggacaccatcttgagttccagaggctgcctgggcaggaaggggctctgcaggtgcctcacagtgcaggtatgtgctggtgttgaggccatggagggagagcgaggcctgtggtgtggggatctctgtttcttggctcagtccgttggttggcacagagtttacctgggctttgctgaattccaacaataccctagaagttttaaacaaagaaacctgtgtgacaggttgtctgcgataatgcccaaggcaactggggcagagggaagaatgcaaaactgctgttttatgatttaaaacaacccacaccctctaaatgatccactgcactccccctcacgcagtcctcctctgacactcccaccacgtttttcctggccaggatttaggcagactgcgtggacaggtgatttgtggagcctgggatctcaggcgaaaaagctccccagcagaggaagaggacttggtatgaatgaggacttactggcattctgagcaggctagctgtgggcctggagagcttgctcagccaaacacatggttgtgtgggcaatcgtttccccaaacatggtatgcagcagagcctcctcctccacagcacagggagtagagatgccaggactctgccctggggcagggactaggagaagcgagggctaggcaggtttcctaagcaaggtcatactttgttcctgtgcaggcactgggacagcaaggggaggtgcaagggctggtcccctcagagctggactggatgtggagacagagaagcttcacatccccagaaactgctgctggagctcaatgtataccaggtgtgtgagggtggatatgagtacacacgagatgtgcccctgctcactctctatggtgggactgccactccctgtctcctccgtgctgcttcctggggccacagggagcaaatgttactgccttggtacacgtgcatgcacaccacactcacacatacacactgcacagaaacatgccctgggccctctggaatgtgcactgactagcaactgctcctccctctcctgaggcttcttctgaggatccaagctccattttgaaaataaacccgtttgctatctcttctgcttataaaaccagtggagcatgtcatgggcaaagcctggttcaggtggccacaggctgtctaaggccccaaagcctccctgcatctgccctgatggcttggactgggtccagaagatacatgaagctctgcttaatttgggcttagggaaatgaggattttagaattcaagttgcttacctgattgtctttccagtgagctctgcaccatcttaaccccaaacaacatttcaagacattatggtcaagaataggtggccaatccatacatgtataagtaactgattttggccgggtgtggtggctcacatctgcaatcccagcactttgggaggctgaggtgggtagaaccacaagatcaggagttcaagactagcatggccaagatggtaaaaccccgtctctactaaaaatacaaaaattagccaggcttggtggcaggcgcctgtaatcccagctactcaggaggctgaggcagagaattgcttgaacccggaaggtggaggttgcagtgagccgagattgtgccactgcaatccagcctgggtgaaagagcgagactccatctcaaaaaaaaaaagagtaactgattttcaacatagacaccaacacattttaatggggagggaatagtcttttcaacaattgtgctgagataagtggataatcacatgcaaaagaaaaaagctggactgctatctcacattgtatacaaaaattaactcaaagtggattaaagacctaaaggtaagagctaaaactgtaaaactcttagaaggaaagagaggtataaacttcatgtctttggattaggcaatggtttcttagatgtgagatctacagcataagaaagcaataaaaaataaattgtaatcccagcactttggaggccaaggcgggtggatcacctgaggccaggagttcgagatcagcctggccaacatagtgaaaccctgtttctaataaaaatacaaaaattagttgggcgtggtggtgcgcacctgtaatcccagctacttggggggctaaggcaggagaatcacttgaacccgggacggggaggctgcagtgagccgagatcacaccactgcactccagcctgggcaacaaagtgaaactctgtttcaaaaaacaaaaataaaaaacgtttgtgtggttttttttttttttatttgagactgagtctcactctgtcgcccaggctggagtgcagtggcgccatctcggctcactgcaagctccgcctcccgggttcatgccattctcctgcctcagactcccgattagctaggactacagacgcccgccacaacgcccagctaattttttgtattgttttttttttagtagagatggagtttcaccgttttaaccaggatggtctcgatctcctgacctcgtgatccgcctgctttggcctcacaaagtgatgggattacaggagtgagccactgtgcctggccaaaacgtttgtgttttaaaggatactatcaagacagtaaaaagacaattcaaagaatggggggaaatatttttaaattatacagaagggcctattatccagaatatatacagaacacttacaaatcaacaataaaaagacaaataactaaatgtttaaatgggcaaacgatctgaacagacatttctccaaagaagatatccaaatgtttgataagcacatgaaaagacactcaacagcatcagtcatcagagaaatgcaaatcaaaactacaatgaaataccactttatacccactgggttgattgtaataaaaaagacagaaaataataagggtgggaaaagatgtagagaaattaaagcttgtatatattagtgggtgggggatgtaaaatgatgcaactactgcagaaaacaatttggtagttcctcaagaagttaaacatagagttacatatgacccagcaattccacccctaggtatgtaactaagagaattaaaaacatgtctacccaggctgggcatggtggctcatgcctgtaatcccagcactttgagaggctgagccaggcggatcacctgaggtcaggagttcacctggccaacatagtgaaaccctttctctacaacaagtacaaaaattagctgggtgtggtggcaggcccctataatcccagctactcgggaggctgaggcaggagaatcgcatgaacccaggaggcggaggttgcagtgagccgagatcatgccactgcactccagcctgggggacagagcgagactccgtttcaaaaaataaataaaatattgaataaaataaaatacaacaataccatcaattgagcactattgatgcctctgtgccagggaccattctaagtacttaaatctaagtacttaaaccctccagactatacctatgccactcagtgatgattataatacagatccaatctacacggaagaagctatttaggacagtcaattcactaggccaactgcaatttggtttctgccaaacagaaccgctttatattaataaatttcattttgaatgttgtgtcttttatgcttttctttatgtttgatttgtggatgttttgattttatatgtgtaatgataagcacaaggaatttatgtctaatttaaagttacaaatatttaaataatgtaacaactttgatgaactctaaatgtcggtgagaacattttacccttgaaatatacacttcaagaaatgctggtctctgtggatgctcaaggactaacttcaaggcccagctctatgaatgctggtgctggctgtgtgtttgtgcatctgtatgtcttacatttgccagttactcacaccactgtccggcatttgtctatacatcctgacccttgaccctccagtttccccataatagccgggacaacacttcctgcacagagaggatggtcactgattcagtgaccttaagctggaattttccatcacaagacacatgagataaaggcgagacatatgacaagggatggctggctggtctgcagaggaggcagacacacaggaagggctaagacaggtgagtgaacctaggtcatgccctgtgcctgggtcacactgcaggcctgtcatgccatggtcccagtggtcacaggaggcagacactgttcctccccaatgtattctatctaaattcctccatttaacatttgaaaactccacctaatatgctcagaagccatttctgggactacgagacaatctcctatattgtttgactaacaaacaatgtgcctgaccttcctgggcttgtaagtggtggaacaggactcgaaactaggtcggctccaagcccagtccgtaacaccacccaacgctggtgctctttccatggtgggtgagaaccctggagggacctgaaccaaggcgagggcacagggcgagtggaaagaaggtcccaaacacgtgggaccttcttttccgctgatgcagcatggatccagctgaaggaggcttttaataagaagttcccattttccacctatcagatgagcaaatatccaaaagttcactaataccatcagttggcaaggctaagaaacaaggacattcctggtggagtgtaaatgggcaataatctgtgaacattccatattagtctatccttttgctcggcaattttgcttctgggagtttatggaacagagatagctacgcagaactaaaagaccacatacacaaggttatttatgaaaacacaggccccagcacccattaaatactgggctgattaagtaaactaaggtacattcatacactagaacaatatgcaatagaaaaaaaaagaatgaggctgggcgcagtggctcacgcctgtaatccccagcaatttgggagcctgaggcaggaagatctcttgagcccaggagttcaagaccagcctgggcaacacagtgagacccccgtctctataaaaaataaaaataaaagaatgaagaagctctgaaatgaaaagatcttctccaaaacaagatatagaacagtgtgtatatactgcctttgtaggagagaaagtaataaataaggaagaaattttaaaaatcttttatttttttttttttgggacagagtctcactctgtcacccaggctggagtgcagtggcacgatctcggctcactgcaagctccgcctcctgggtccacaccattctcctgcctcagcctcctgagtagctgggacttcaggcgcccgccaccacgcccggctaattttttgtatttttagtagagatggggtttcaccgtgttagccagaaaggtctcgatctcttgcctttgtgatccgcccgcctcggcctcccaaagtgctgggattacaggcgtgagccactgcgcccagctgaaaatctttatactggtatttgttgtagatgcatttagaaatttggaagaatatacaggaaattattatggttttaggggtgggaggaaagaacagggtagagggagaacaggaatgggaaaggctttcactgtatatgttttagattttttttaaccataaaaagattatctatgcaaattttttattttatttatttatttattttttttttttgagacagagtcttactctgtcacccaggctggagtgcagtggtgcggtctcagctcactgcaagctccacctcccgggttcatgccattctcctgcctcagccgcccatgtagctgggactacaaggcgcccgccaccatgcccagctaattttttgtatttttagtagagacggggtttcaccatgttagtcaggatggtctcaatctcctgaccttgtgatccacctgccttggcctcccaaggtgctgggattacaggcgtgagccaccgtgcccagctgcaaaaaaatgtttaaaaggctgtgtgaagaaggctctgcccagttctctcttcagcctagttcatctgccccacatactcttccacacatctgtctgtccccacctgtccaccacctcctgcatgcagcactcaggtcctgtgtcccccaggaggtattctgtgaagtcacactcttatgcgttatgtttcatctatttgttggacgttttaaatgtactctgacctattagtttccttccttctagatgaagacaacaatattttacactgtgccttgtagagactaagtatcttgtttttttgttgttattgtttgttttcagtttttgttttatttatttatttatttttaatttagaggcaggatcttgctacattgcccaggctggcctcgaactgctgggctcaagcaatcctcctgtatcagcctcccaagtgctgggatttcaggcatgagccaccgcacccggccaagtaacttgctaaaagtcaccggggcagagctggagcccaaaccagctctaagctgttctaagtccactttctccactatgcctgtattgcctgctacagttcccagctactccagtccctggagaagtcgatgactcccttggctttctttaattactaatagagttcagtaacagacaatcacatgctatgggaagaaagggaggaggagaggaaagaaaggagggaagagagaagatgggaaggagtgggggcagcgtactcactcttgcagagaccggtctgagtcctcagcatttgctgtgcccaggtctgagtcacaggacatgggctcctcgcaatggtctggactcttggagccattctcttggagtaagcagctatcagagtttaggctgcaggacagctgggatgaactggccgtgtccaggctgagggaggaggcagtcagcttctggttcctccgtatcttatggcccgagtgatggacttcgatgtcttcagagcctgaagaatgggaaatggaatccagagattccttccgctgtagttctgcaccagaggtagagagagggtccagctcagaaagcgggcaaagcccagacagggccaatggggtgagcgtccactcatttaagatggcagacttgtaggagagttcgaaggacaaggacgtgaggccctgcaggaagctaaggaggaactcgccctcctcagcatcccggagcagggcggtgggctggtagtactcatgcaagcgggcctgctcctgcagcagcagcttcaggtagcactccatcaggccatcgttcagggccagccgcagccatgcccggcagcggcccacatccgtgttgacaaacgtcaggtgctccaactctgagatgatgtgtctgggaagggagaacagacgtgtttcaagaaactaccccaaatcacagagatgtgcttttatccactggttagcaggaaccaggaataactactgcaaatagatacaggcatgaaaaaatattgggtaatagtgttttaggccagatgtggtggctcacacctgtaatcccagcactttgggaggccaaggcaggtggatcacttgagctcaggaattcgtgaccagcctgggcaacaggacgaaactctgtctctacaacaacaacatagccagatgtggtggcttgcacgtgtagtcccagctacccagctactcgggaggttgaggtggaaggatagcttgagcctgggaagcaaaggtcacagtgagcggagattggaccactgcactccagcctaggcaatatatatatatatatttatatttatatataataaatatataaatataaattatatatatttatacattatatatatatatatattttgagattggaattgtgaaagataatttccatgttcattccaactaccacggggcccctgacacatctgctcatctaaggcatgctgtcagagctccttaagtgcaaagtccttggagcaatgaagatgcagggtaaagacatggtccctgccctcaggcacaagggactgatggaaaaaggcataaagtgtaggaaatcaacaaccctgtaagaggattggggagcgctccaattacagcatgtggcggaaaagtgggtggtttggttgcaaggccaggaaagagagggtcttaaatatcaaatcaataaggcaacacggggtaatggccccacacccagctgtgcaccagaaccccctggggaacttgagcaggatacaagttctgggaccccaacctagtgaatcagtctccaggctagcatctgggagcctgtaggctacagatttttgtttagaaaagtgacttgaccacagtcatgcagactgcagggtagatgttctgcataaggagatcagaccccaggtgtaccaaactcagtcccagaatgcctccgtctgatgtacatgcccctctgagctaccacagtccctagcgcaggtttatctcctccatgggaatgtagaccgcactctactaggctcagtgagtaagctccagggagcttcagctcagtaaatgttgaccagatgatggactcaaggaaagacagagtgagataagggggacaaatagaaagccagtgtcacccaggaaagaagaacgtgagacaaggcagtggcaatctgcatggaaaggaagattagagactgacaaggcttcttttgggctgaaggtggcatttagtagtcctcagaggcacagtgccagctacttgctcaaaagcccagacagttaggggccaaagagataagtgtctcagggtgaatattcatatgcttttcctgattccactctttatataatcccagcactttgggaggcggaggtaggcagatcacaaggtcaggagtttgagagcagcctgaccaacatagcaaaacccctctctactaaaaatacaaaaattagctgggcgtgatggtgcgcgcctgttgtcccagttactcaggaggctgaggcaggagaattgcttgaacctgggaagcagaggtgccagtgaaccgagatcgcgccattgcactccagcctgagtgacagagcgaaactccatcccaaaaaaaaaaaaaaagatttacaattcggatgtttgaataatctaaggcagggtcagcaaatccaaggcagggtcagcccttctgtaaagggccagatagtatattcttcaggctttgcaggccacacaacctctgttgtaactatgtaactctgccccagtgtggcaaaaaaggctgttcctgctaaaggtggccagtctcacctgctttttgtgaccagtctcaaagcagccacaggctcttgcctgagtgctgagggtctcaagatctgctggcacactggctgggaagcttggtctagagataagcctttctagaagacactttcaacccctacctcaccctctctctatgctagaacacagggcacctctgttggcttcctgaacagctggggaggaaaagccaagtgtcccatagtctgctgctcctccgcaaagcaaaacctctccagctaaatctcacttgtgggtgacagctttcaggaggggccagaagacaggctggggcagaggcttctggtgggcacttttcttcctttttcctccggcctcagctcggatgtgcttggcgtgcaggccatggataaatacggcctccagggcgctgcacatggtgttggcatctccgtcttcactagtgaccaccgtgtccagggacacgtactgcttctgcaaggccttcacggatcccaccagcttcttcttgatgacctaggcagcaccacacagaacacaggcctttagcggaaaatcctatggagagtccctagagtgtaatcctttagctggtgccaaatacgtgtgcaaccacatgcacacacatctatgtgtgtgtctgtagattccttctgcaaaattagcacattgttaactacagcaaagaaagataaagcatagagaagaaaaggaaaatcacacacactacccagagataattactgttattgtttgtttcatatgtcctttagtatagatactttttgttttttagaccaaacttaagtgaacttagagccatataatcttgtgtttaaatattggccccatcatagctgcagtgatgggagcttgggtaaatccatctaggacaagggtggggcttcccaccttttttacatggacaagcttctgtagagaatcaataagccaagaggcaaaaacaaacaaacaataaacacccacactgctttagaacaataaaaacatgaggagaacaggagcatggtttactttaagaaagatcctaggctgggcgtggtggctcaaacctgtaatcccagaactttgggaggtcagaggcaggaggactgcttgagtccaggagttcaaggctgcagtgagctgtgatcacaccactgtactccagcctgggcaacatagcaagaccttgtctcaaaaaaagaaagatcctaggcctggaagccagaggactaggctcagtcctagctgccagtaaccagatgggcctcctcagacattccacttaaccgctttgagcctcaatttccttatctgttaaagtggaaataatactttctgatttatagtactatgaggattctcctgaggacaggactacctttttttttctttttttttttgggaagtggtttctggtgaaaaccagaaaacctactagataaattctaaaaagaggctgggtgtggtggctcacacctgtaatcccaacactttgggaggccaaggcaggcggatcacttgaggttaggagtttgagatcagcctggcaaacatgatgaaaccctgtctctactaaaaatgcaaaaattagccaggtgtgggccgggcacggtggctcacgcctgtaaccccagcactttgggaggccgaggtgggcggatcacgaggtcagaagatcgagaccatcctggataacaggctgaaaccccatctctactaaaaatgcaaaaaaatagctgggcgtggtggcagcgcctgtagtcccagctacgcgggaggctgaggcaggagaatggcgtgaactcaggaggcggagtttccagtgagccaagatcgcaccactgcactccagcctgggcgacagagcgagactccgcctcaaaaaaaaaaaaaaaaaaaatagccaggtgtggtggtgagtgcctgtaatcccagctacttaggaggctgaggcaggagaatcacttaaacccaggaggcagaggttgtactgagccaaaatcgtgccactgcattccagcctgggtggcagagtgagactccatctcagaaaaacaaaacaaaacaaaacaaaacaaaacaaaaaacatatatataaaagagctgagtgtggcactaagactagtgttttattcatccttgtgtcaacacttggcactgtgcctggcacatagaaatactcaataaatgtttgttaaatgatacaccacaaaatgtacatagagtcttttggaaatatagagtaaaaattgagcataattataagcatgtgaaaatcacataagtgattggaaaaggactggaagggattacagaaaaactggtttgaattgttgggtgataggattatggctacatattttaatcttttattttgatttcagccaaaacactaaatgttaacattctttgaaaagttaaatttgaaaaaatataacggttttaatgagatataattcatataccataaaatacacccatttaaagtatacagttcaattgtttctagtatattcacacaattgtgcaaccatcaccactacctaattttagaagattttctggccgggcacagtggctcacgcctataatcccagcacttcgggaggccaagacgagtggatcacctgaggtcaggagttcgagaccagcctggccaacatggtgaaacccccatctctaccaaaaatacaaaaattagccgggcatggtggtgcacacccataatcccagctacttgggaggcagaggcatgagaatcacttgaacctgggaggtggagtttgtagtgagtcaagattgtgccactgcactccagcctgggcagcagagggagactccgtctcaaaaaaacaaaaaaacaaaaaaacaaaaaaacaaacaaaaaaaacgattttcatcaccccaaaaagaaatactgtatattagtgattgccaggggctgggagaaaggggaatacgaagtgaatgcagtcactaatctattttctgtttctgtggctttgcatattttgtacatctcacatgaatagatatcaatacagcatatgaccctttgaatctgacttatttcacttagcatattttccatcatgttgtagcatgtatcaggacttcatccctttttattgccagaaaatattccgctgcctagatataccacattttattcatccattcatcagttaatagacatttgggttgtttctactcttttgctattatcaataatgctgctatgaacatccatgtacaagtttttgagtggacttatatttctagttctcttgggtatatatctaggagtggaactgtacacataaccctatgtttaacttatcaaggaactgccaaactgtgtgccaaagtggctgcactattttacattcccaccagcaatatatgagttccaatctctccacatttttgccagcactagttattgccttttttattacagccatcctagggggtgtgaagtagtatctcactgtggtttcgatgtgcattttcctgatgtctaatgataatgagcatctttattggccatgtgtgtatcttctttggagaagggtctatttaaatcctttacccattttataactggattatttgtctttttattgttgagttataagtgttctttatacattctggatactagacccttatcagatatttgatttgcaaatattttctcccattctgtgggttgtcttttcattttcttggtagtatcctttgaagctcaaaagtttttaatcttgaaatagtctaattttaaatgttcttttaaaagcaagatgttatttgtatattatatttaaaaagtacatacatacttcgttcaattgagcacctactaggtgttgggttagggtatacagggagaaataaggcataccctcaagaaaggcataccctcatggagtcagtttgtgcagctgttgttagaaggctgggttggccaggcttctgccctagctctggagggtcctggggtgggattcggcaggcactgggggtgggagagtgggggtgcagaggggagggaagagcctctgcatgaaagccagctgggaaacaggtggagctggactctcctgtggccaggacggggaaaggcacgtctctgagagctacagtttctttcaagcagagttctctgagctgggaagcagcagtggggaggaaaggaaatcctggcttctccccgaaagccatctcaggatgctgctaagggaccagccccaaagctacctgacttcctgcctctccaagagaacagagagctctatctggagtacccaagatagcccaggagggtgcaaagggctgtccaagaaaaggtcctagggggctccagtgaactgctcacaaataattacatttagaatatcctagaaaatggtaagtgttcagatacatgtaagttaccaatttacccccattactgaaacaacaaaccagtgcctgggaatatctgtttcccacccattcagtgctttggccagactgtgaccaaatcatggcctaagggcagagggctgaagggctgaatggaaatccttggtcttcaggttactgatcttaaattcccactgcttttcataaatctccatcttatcaccaataaggtgatctagaaaagacagggtctcctcagagcctgcttgtgctgtaactttttctcaacctggtctctcttgcaggacagtgcccaaggaagtgagccaagccgatgatacaactgtcccctgcagcccttccccgcccttgatcctccctcacccacctaccgggatggcagcctgggggtccagtccattctccaccactgaaagcatctccactcacgcagctgctccctcagagaatcacatgacacctgaagagacagatggcagccagatgaatgggcagggaactttcccccagccagagtccattcccagcaagcagcaggaggtcagcctctcttactcaaactgcaaccaaaaaggcctttgcagaacacaaaagtaaaaactgataatagatttgaaggaaagaaacaaggaaggaaagcccagggggcttagtcgttgggaggcaaggagtcctgggtgccaggggtgggtccaccccaaggagtaggtggtaagggcgcttcacatcaaatgctgcccagaaagccaaggccctgtaggattgaaacctgtaggcagggaacgacaggctgattcagatacggagctgcaggttcgagggggaggctgcagctgaaggtggcaggaacccaatgggaccaggaagcaggggctcacaggctcacacatcacattcaggggctgggtcctgcaacaccctgcccccacccctcactcctgtcccagtccaacatctgccagctcagcagtaaaaagtaccactggaacggcttcaaaaggggagggctcccttgctacacttctgctcctcatttgggcttcgagggtctggcttgagcagcacagacagggacgtgtctaaccgggatgaccatgaggtctcatcgcagtttgccactaaccaggtaggcatgctcagacctctcagatggagaatgtgtaaaatgcctgtcacggggcctgatatgtacctgtacctgatatgttgtacctggcatctgtcatcccagtggatgtggccacctaaacctacagaccaagaatgtcatcacctaaatgagtatgcaggaagagctgaagtcagtgagtggttaaatccctcagggctgccagcttcctcctggaagtgggtggggtggggtggggtggggtggggtggggcgggtggggtggggactttagcctgagcctgagggggctgctgactggcttggccccaccacagcaacttggacagacctgggccaggcaggcacattcacacgtaaacaaatctctagccaactcctggctgagcatcaggggaaagggaaaggtgatgtctgtctcagctctcaatcaccgcacaaagaagttaacaaaaccaagaaaagttaaatgggctcagttctctttacatatattgcctaatttatgttcctcctaaggaccctaggagtgctgttttattgtctccacctgacagataaggaaatggcagctgacccaggtcaaggaagttcctgaggtcccagggctgataagcggcctgactccaccaccagcccccaggaggaagccaaccccagccctaggaaaacccgattcctgagtgagtgctgtaaaccaaaaataaaattctaagctccccaactgcctgaatgggccccccttggccaaagggatttcaaaaaaactgaaaactgagttcaggccatgacacgaagtggggcgtgggccatgcctcatcctagcctctcccttttggagcttagacacaactgaccagcattaacattaaaacagactcctaagactgacagaacagactctcagcaattaagataccaactccaacctgactggtctaacatcacatgggagataacaggccctaaggaaatcaaagtatcttacccccaagtatatttttgacatagtttggaatggccctgcaaagccatctcttgttgggaaaatttatgtcctgcagagattcccttccctttctaggccttttcctgatttagaggagatttaactaagagtctgacaccttagagacatttaccatctattctcttgaaggcttcatctacgttacatgaaccttggctttcacaacccaccttatcttaaccccaagcttttcttctgctgacttttaactctttaggcaaagtttaactttttcagccaattgccaatcaggaaaatcttttaatccaccttaccctgtccccaccaatgtataccttacatatatcaatttatgtctttgcctgtaacttctgcctgtaacttggataaaaatcaagctgtaccccaatcaccttgggcacatgttctcaggacctcccaggactatgtcacaggtcatggccctcacatttggctcagaataaacctcttcgaatatttaacagagtttggctttttcatcaacagtgccatcacctcagagctaggattccaggggtggtctgggaagaccctttcgctgggggccgggaacagggggtgcaggggaacattaaggccagtgtggcaggaaaggtttcctggacagccctggagcagcatgaggtttggaaagcagacaggcaggctggccctaaatggtggaaggtgctctgattggatctctggcttctggggatagcagagggcaaacaggacacagggagtcaggacccagagccaacctccctaagtcaggtccctcaggaggaagcaggcatgtatggaggatggttcctgcagacccagtaacaggccgggtgctgcagatggccagaagagccctcagtcctgactacagccccatctgactgcctcacccttcaccatagtctgctcccagctacccagggattctcagagccctcctctggagaccagttccacattctggccacggggtgacaggaaaagggggttgtatgctgcagtgactctgcatctagggtcacttccagaaacaggcctggtcttgaggtcaggctccatcaaggctacccttttgcagctcagcaggccacgtccagcttctctggctccgaaaccctgggctccaatcccagtccacaatttccagtggcctgaggccctcaggcccacccttctagagagagcccgaagccccaaagttgcccttcccttaaccagctacagggccgggaccctaaggacttagacccaataatttgaattatagcccaggcccattaagacctcattaactaattagctgagagtgatagagtattcacagagtattcactgggaggagcaggccattggtaagtgagtgctctggccaagtaacagtatgctaagaagacaaaataggccaggtgccgtggcccacacctgtaatcccagcactttgggaggccgaggcaggaggatcacttgaggtcaggagtttgagaccagcctggccaacatggtgaaaccctatctctaattaaaaaaaaaaacaaaaattagccaggcatggtggcccatgcctgtaataccagctactggtattaccagctaccataccggctgaggcaggagaaccacttgaacccaggaggcggaggttgcagtgagtcgagatcatgccactgcactccagccggggcagcaaagcaagaataaataaataaataaataatttatggcatggcgccgtggctcacgcctgtaatcccagcactttgggaggccgaggccggcggatcacgaggtcaggagatcgagaccatcctggctaacacggtgaaaccccgtctctactaaaaatacaaaaaaattagccgggtgcagtggtgagcgcctgtagtcccagctactcgggaggctgaggcaggagaatggcgtgaacctgggaggcggagcttgcagtgagccgagatcccgccactgcactccagcctaggcgacagagagagactccgtctcaaaaaaaaaaagataaaataaaaaaataataataataataataatttatgtctcaaataaataaataaataataaactgaagctggctgggcgcggtggctcacgcctgtaatcccagcactttgggaggccgaggcgggtggatcacgaggtcaggagatcgagaccatcctggctaacacggtgaaaccccatctctactaaaaatacaaaaaattagccgggcgggcacctgtagtcccagctacttgggaggctgaggcaggagaatggcgtggacccaggaggtggagcttgcagtgagccaagattgtgccactgcaccccagcttgggcaacagagcgagactccatctcaaaaaaaaaaattaataataataaactgaagctaagagagacagggccagacaagagaagggtcacttggcctaaaacagagtcagaaatgccacaaaatgactgacaagagctcagagaaatccagcagaagagccacttgaaaattcacaagacaggactgagcctctggggttccagccacaatgcaggacacctctgtttgtaggcagccatagcaccccacctatctgtatctgttccatcatgctcagggaggcagggctcagatggtcagtgacataagaactcacggcgggaatcagaaggaggctttgtgtctcttgactgtggggacagtactgcgtcacccaccctggtggcccagattctgaatctaccatcctatggaactggttccactttctgtcctcaaaacgctcttcattgacacaaagaaccaaagtgaagagaggtgtggcttcaaggagacctacctgaagggagtgaggcaaagctgggcaacagtaccaaagggctcttgaacatgacgggtgaaatcttagcaggggaaaggtgactggtgccatttaggaagccccaaaccacaccaagtctactgccaccctgtgtattcattcgccttcacatagctctccagagtgcagaaagcaagcttctctgatgtccctctctaacctcatttaattctcacagcaatcccgtgagagagtgattatccctgttttacagaggacaaaactgaggctcagtagcaatgggtctcgggtaagggacagaactctctggtttcttcatcccaactcctgcatctttccctggaccaaaaggcctcaggtctttggctcaaattcagacaaactattacttcttctttagaggtactcggaagctccatttcatcacagaaggtctgaaaccaacaagaaacagttctgccaatcaggtttatagccccaaccagctgagaccaggtcctaccaatgctcctaaagtctcagagctatactttcttaaatgttccaacatagttaggaaggaacagttccggttggtttcctgcattatactgcctggccttctctatatgtccaatttcacttcctccagagatcaaggaagcaaaaaaagagaatgacttggatgagacttacgttaaaagaagaaagggataacctggttccaccactctcaaaacactccaccatcagtgaacagcaacctcttctcttgagggactcctcagccactccccacggccttctctccactgcctgaattgtgtaactggctgttcagagccacagcctggctttaagccatccaactgctgtaccaattgatgagtcatgttttttcaattggaaaagaatgacaaagttatcctctgattcagaaaggcagctgatctttcaggcatgtgagtgctgactgaggaaactgcacctctgtccacctgaggaaagctggatttctgtgatgggtggagtggtgggggttggagctttgaagcaattaaataccagatgaagggtgagaaacttttagcttgtgattcccagactcagggctagtggatgagggcagaattgtggagtcagtgaacactagctatctttctttcctccctccttccttccatccagtatcacccagctttcctgtattcttgtcccatatcccagaggattctaacaaggaccaaactctgaatgaatgaaaacaggaccgttgcctgacccattcaccattgtatttctagtacctggaacagtgtttgtcacacactggtgctcaaaaaataagctgttgaatgaattgattaataaaataaaaacaaggcacggggtaagtacctccacttcacacactgtgggaagttggggtatacaactcttaagtgctggggcaactgtggagctcctgtcattaagccaagctgccaataaggctgaaaacaacttaaatatactgcatattaatgggaggacattgaaggtaaacagcattcacttttcaaaggaatacgactataagtggcaagcagagacagtgttctttggggctctttaaaactgcaatcagccaggtgcggcggctcacgcccgtaatcccagcactttgggaggccgaggtgggtggatcacctgaggtcgggagttggagaccagcctgatcaacacagagaaacccccatctctactaaaaatacaaaactagccgggcatggtggtgtatgcctgtaatcccagctactcgggaggctgaggcaggagaatcgcttgaacctgggaggcagaggttgcggtgagccgagatcatgccactgcactccaggctggggaacaagagtaaactccgtcgaaaaaaagaaagaaagaaagaaaaaagctgcaatcaaatggcccacccatctgatgccgggtcctcaggattcagagaaaatgtgtaccaaaaagcccccaggaaactataaatgctgagcatgggacttgggtgcctctggaatgtccttctgcctcagctactctgagataacatggttccctgtgttcatggaacccagatggccaaaagtcaatgatccagcacttaaaagaaaagaaagcgattcaagagcctctgtacccacctaggcctcagcctccccaggacctactcacctatactcttcacaacaggtaacgttgcctctggcacccatcatatcccctgaattcagcatcaggactgatctgccatcagctctggcagggagaggcccttacaagtgccaagaaaaggaacacgaacaatattctgtgaccacagccaacaccacacagaacttcccagaagctctccagggcgagaacaccaaccagaaggaagtgacagcttccatcattctgtgctaagtgagctgagtgagtggccgtctctcaccttccagatatttgaatgatacctaccattccagcagccagcacaagtcatttaatatgaatgccaaaaacacaatccctgaggacaggtgcaggagaccagatgccaggaaaaaccccggccccacccaagagttggggagagcccactgctcctccacccttatttaccacctgagcccctgcacccgccaatcatgctgctcagtctgtaactgcgggtctgagtgagcacctacatttggctgttgaggggcagctggtggagttggcaggcgactctgcactaagttctcaggttgaatgggagttgggtcgagggaagcaatggacgcagagttggggtgaagagttgcggtgggtcagcgggggtgaaaggacatggagatgtcatttttaacaagattgggtgagggtggtaggaaaggaggcagcaagagttcgggacagtttggcaaagacttagggatgggctgtcctcagtacggcaggagacgcaaaggaaggtatacagtggctaggagactaaggacgagaagacacagttaagacttggaataaggctgagatcggagttatccagaagaaagcggtgagctcaacagggcacctactttgggggtgggtcttagatgagagggcggaggtagaatgtttgggatgagcagatcttggggagctagacgggggatgggggtgactgggataagaaagctgagccagaaaaggggaaacctgaatggtgggtctcggggaggtaagcgcggagcatcgggattaccagaggggtggggagagaggatgaggtgtgtcagggcggggcgaagggacgtggccgagatcggtgttggaactggggtaaagtggggtcacgagtgaagctgcatttaagcaagaccgctggtgaggggatgcgggcgcgggctgggggctggacagacggaggggacggggccacagcggcggtgcagggggaaggctgggtcggagaggagcgggcgcgggctggacagggctgagggccctgaagccgggcagtctcagggtaaccaggggctgggaatcgcggagggagcgggaggcccaccgcccgttcgcgcctcggccctcccaccactccgccgccctcctcgcatcttgaccccctaactcaccaagcggagcgaggagcgaggcgaggggcgctcccggccgcggcagcccctcagcctccgagccgacgatgcggtctctcggccactgacaacaggaagcggcgccccggcccctgacgccatcacgtt

SEQ ID NO: 2688 - DNA, 54881 bp, Homo sapiens; identical to SEQ ID NO: 2687
  source 1..54881: mol_type = genomic DNA

SEQ ID NO: 2689 - DNA, 54881 bp, Homo sapiens; identical to SEQ ID NO: 2687
  source 1..54881: mol_type = genomic DNA

SEQ ID NO: 2690 - DNA, 11488 bp, Homo sapiens
  source 1..11488: mol_type = genomic DNA
gagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgcttcgagatctcggacgcggacaccaaggaggtgttcgcgggcaagattgtgcctaagtctctgctgctcaagccgcaccagagggagaagatgtccatggaaatatccattcaccgcagcctcgcccaccagcacgtcgtaggattccacggctttttcgaggacaacgacttcgtgttcgtggtgttggagctctgccgccggagggtgagtgtcgctgctggggaactggaactgcctgcggggcagttggagcgcccagacctggagctgctggaaagagtacccagcaagggagagcctgggacttggagctgctagagaagggtgctgggagcctcccgcttacgtatggaaagtgtctttggtaagggcttcttggctctgggagctgctagaggagggggttccagtgaagtggagtctgagtcatgttgctgatagggaagtcagcttctggacgcgaggtgctggggggaggggtgctggtaatggacgctagggccctggagtacccagggaggagtcccaggttagtgatgccgcgccctgggagcttctggggtggagctgggtcagtgggggggtagttggagccagacttcgggccttccgggggagatacgagtcaggaaagggatctggtgctggggactcggagcttccggagtggggctgagagaggacccccaggtaaggggggaagctagtaggagaaggggtgctgcgaatggttgtggacagtgttaaggcagggtccagatgccgctgtgctggagaaggaatggggtgggggcatagggaaggagagaaacccaccaagacccctctttcatcccttgggagtccagagtccagtcctgtgcttcctttgcctggtaaccctctcccttccccaccggcctcaatccacctccccatccctcctgccctctccttcccacccacagtctctcctggagctgcacaagaggaggaaagccctgactgagcctgaggcccgatactacctacggcaaattgtgcttggctgccagtacctgcaccgaaaccgagttattcatcgagacctcaagctgggcaaccttttcctgaatgaagatctggaggtgaaaataggtgagttgctgagcctgcaggggtgcttgacatcactacaagaggctggaatttggaggaggctgggagaaaggaaggagacaacccacaagtcagtatcttgcctacagatgcattatttttttgtgccccaatgcaatattttttttttacaaagaatttgaatttgtttttattttttaaattggaaggtttgattgaacaaaaagtttgattcagaactccttttaaacaggtgaaagcttcagtaatacgaggacagcattttcttagggcagccctttgctgggctggaaaacagctgtccccttcagacttctttgccacagtctctactcctccctattcttcacagacttgccaagtcttggaggttaacttgcttgatccttgaaggcattggagttttactatccctgtcagttcctgtttcaaagcatagcccctttctaaaaggaggggtgagaagtgtcactggaggcacctccctggtgtcagcatgggaggaagattcctgggcaagccttgctacatacaaggagcagaggcttgtgggatcagatggccctggttctggatggtcaaaccttaactagccttctgcattgacagatgtcagaggctggcatctaagtaccaactcttcctccctctgtcccaggggattttggactggcaaccaaagtcgaatatgacggggagaggaagaagaccctgtgtgggactcctaattacatagctcccgaggtgctgagcaagaaagggcacagtttcgaggtggatgtgtggtccattgggtgtatcatgtaagttgggagttgtctctggaccaacctggtctcagcaggggcaactttgggacatcctacctggctgaccttttctgtggacctttcggcctgctttacagaaagcctactccaagggacaagtcatccccaaacaaagcctaattgtcatatctttccctgtcactggtgtatcctgtcggatttctgcagcctaggtcatgggtacagcggaggaggaggagggagagtctccacaaccttactgtagtcctttgctagagttgtccacagggcagcatcaccatcatctgggaacttgtatacacaatctcaggacccagactacttactggatcagaatctggatttttaacaaggtcccttggtgattcccttgcacaataaggtcttaaacaccgatgagcattagcatggtgggggaaattaggccaggagttacagatggaaagatgatgtgccagtggtctgtctggattaagaccatcagcagcggttggtggcaggcagaggcttgggccttttcaggtgttatctttcttgttttgggcctaggtactggagagttagaaatgagttgtagcaatggctttcatacgtctttgcagtggggttttttcaaatgaaaacttgaagacttaagtacagaactgctaaaggtggagctgcttctgtaagcgcaggtagccctttgacctgttttgcatgacaggcagcatctgaggcccttgcacagagtcctagatgaccacaggctatagctaaaaaatcactggcccttaagaatcctggtctcaccatgtgtattctgctgagggcttattctagccaatgtcatggcttctggggctgctcagtggacttagggattgtcttcaggggccccagagttagagtgagtgtccagaggatgcctgacctttgttctgaccctgagatgatttctctcatgtctgggttgtggctgggagactggtgccaaatcctaccttgtgcttacaggtataccttgttagtgggcaaaccaccttttgagacttcttgcctaaaagagacctacctccggatcaagaagaatgaatacagtattcccaaggtgactaatgatgctttaagtttacatttattttgttttccccagaagctgtttatggagcccagcaatatcctaggaccagaaataggtctatcccacctctaaggtagccacagagcttgagagggcctgtgtctgaaattgcatacagaacttgacatgtatgtgcacataagcattttttctagggggagagagttggcagattctcaagagattgggtaacccaaaagttgtgtaaaaagcaaaaaacaaaggaggtaggaaggagtaggaggcaaaagtgcttaatctttagaaatggtttatcttaattcaaatggattctgccacttagcgagatcacattgggcaaatggcctgcatcttttttttttttttttttatttgaggtggagttttgctcttgttgcccagtgcagtggcatgatcttgactcactgcaacctccacctcccaggttcaagcgattctcctgcctcagcctcccaagtagctgggattacaggcacccaccacctcgcctggctttttttttttttttttgtatttttagtagagacggggtttcaccatgttggccaggctggtctcgaactcctgacctcaggtgatccacccgccttggcctcccaaagtgctgggattacaggcgtgagccaccatacccagcctggcctgcatcttctgaaccatagtttccatatataaagtggagttcctgccttggagcacctcacagagtgccttgcatgtggtgagtgctctcagaattatgaatcactgtgaatcccagggcttcctaatggcatagttgtgtgcattttctttttttttttttttttttttttgagatggagtctcgctctgtcgcccaggctggaatgcagtggtacaatctcggctcactgcaagctctgcctcccaggttcatggcattctcccgcctcagcctcctgagtagctggaactacaggcaccagccaccatgcccggcttcttttttctgtatttgtggtagagacagggtttgaccgtgttagccaggatggtctcgatctcctgaccttgtgatccacctgcttcggactccctaagtgctgagattacaggcgtgagccaccgcgcccggccatggtgtgcattttcacaaccaccaacagaaatacatttaaaggaatagctggttcctgcagaagcctagcacacagccagtttgaagtgtagtgtccttgtgtgaagccaggaggcctgtcaccataaggacagacatagtaaatccatcacaaagtgtcagttcactgtcagagacagcatggaatcaagccagctagacaaggccttcaccctctctgtgcctcactttcctcctctgtgaaaaagggatgataatagatccccaccccttagatgagttggtgagggctaagtgagctaaacacaggagtgcttagaatgctttcctggcacatagtgagtgctaggaaagtgagttggtgttcggccacagtccattgacccttctgtcaatggtgctcagtaaagctgacagtggagaacttggcattgaaccaagttgtgaaccactgacctgtggtgtatttgagactgggggctgcatgtgggctggggacctgcagctcctttgaggccgtactgtactccaggtccccttcacattctgcttatggctgtccctctctctgccccagcacatcaaccccgtggccgcctccctcatccagaagatgcttcagacagatcccactgcccgcccaaccattaacgagctgcttaatgacgagttctttacttctggctatatccctgcccgtctccccatcacctgcctgaccattccaccaaggttttcgattgctcccagcagcctggaccccagcaaccggaagcccctcacagtcctcaataaaggtacaacaagggtctgggtaagagagcagaccccccagagaaagcccaggttgtaggggtgtgtgcagcttagtccctggccctgagagctcaggtgtggagtaggacaggcctctgtccttcaatccgtggttccaatgcccatctgcttctcggccctgccaggaaagactgaccttaccatggctggataaacgtaccatgcccaagaagaagaaaatggattgaatgccaagcctgaaaaattctttcaaatcactttaattaatttaattttttggagacagggtctctcctctattttccaggttggagtgcagaggcacaatcacagctcactgcagctttcaactctagggctcaattgatcctcccatctcagcctcccaagtagctgggactgtcaggcatgcaccaccatgcctggctgacttttctaatttttgtagagacagtgttttgccatgttgcccaggctggtcttggaactcctgggctcaagcgatcctttcacctccaccaaagtgttgggatgacaggcatgagctgctacatctggcctttaaaaaaatttctaacactttttcatgattcattgaaaaacataaaaatttccttttttttgtggcgtgatcccggctcactgcaagctctgcctcccgggttcacgccgttctcctgcctcagcctcctgagtagctgggactacaggcgcccaccaccatgcccggctgtttttttgtatcttttagtagagacggggtttcactgtgttagccaggatggtctcaatctcctgacctcgtgatccgcctgcctcggcctcccaaagggctgagattacaggcgtgaaccaccaggcccggccttttttttttttttttttttttttttttttttttttttttttgagacagggtctggctctgtctcctaggctggaggggagtggtatgatctcgatttcactaaggatacatagttttaaaaagtcacttgaaatactttttttctctgtggatatatcaccaatttgatgtacaacttcagttcatttttcagttttcaatttttaggtattggtttttcttaaacttcattttggaataattttaggcttatacagaaaagttgcaacaacaacaaaaaactccccagagttcctacataccttgcagcaattattacagtggaattttttttgagacaggtctcaggacttgctgtcacccaggctggaatgcagtggctcactcatagcttactgcagccccaacatcctgggctcaaacagtccccctgccttaccctccagagtagctaggactacaggcatgtgccaccatacccagctaattaaaaaatttttttctttgggaggccgaggtgggtggattgcccgagctcaggagttcgagatcagcctgggcaacatggcgaaacgctgtctctactaaaaatacaaaagactagccgggcgtggtggtgtgcacctgtaatctcagctactcgggacactgaggcacaagaatcacttgaacctggaaggcggaggttgcagtgagccgaggtctcaccactgcactccagcctgggcaacagagcgagactctgtctcaaaaaaaaaaaaaaattttttttttgtaaagacaagatctcactatgtcgaccaggcttatctcaaactcctgccctcaagtgatcctcctcggcctcccaaagtgttaggatttacaggtgtgagccactgtgccctgcctagaatgatgttctaatggtaatttttcttttcctcactttttttgcatttaataattggaattcttctgtaaggaagagctgttccttctctccgattgatttatttatttggttatgtctgaaatagactcatggatatttttattctttgggctatattttaaaggattacttatttctctgcttttatttatttttttaaatttgagacagggtcttgctctgtctcccgggctggagtgcagtggcacagtcgtacctcacagtagctttgatctcctgggctcaagtgatcctccagcctcagcctcccaagtagttgagactttaggcatgtgccaccgcgtctgaccaatttttaaatttttggtagagatgaggtcttgcccacactggtctcaaactcctgagctcaagtgatcctcctgcctcagactcctactttttttctttcagttttaattttttatatagcattttaaaaacttaaggaaattttcagttacccgaaggtggagagaactgtatgatgagtcccatgtttcatctatttttactagttatcaacatttggacagactgttttatttattccagcctcctgccttttttgttaccggtgttttaaaaaattattatttactatttattattatttatttgagacattcttgctttgttgcccaggctggagtgctgtggcaagatcatggctcactgcagcctccacctcctgcgttcaagtgactctcccacctcagcctcccaagtagctaggactacaggtgtgccaccatgtccagctagtttctgtatttttagtaaagacagggttttgccatgttgctcaggctggtctcaaactcctgagctcaaacaatctacctgcctcggtctctcatagtgttgggattacaagtgtgagccactgggcctggccttgctggagtgtttaaagcaaatccctaatatcttattatttcatacccaagtccctatcatgacatcgttttttaattgaaaacttaaacattttatattatacaaggagaattagcacatggtggtgggggaataaataaataaggaaaaagacaataagaataatctgtgtttctactgcccagatataatcagcgttaaaatttcatgttatcttttcaagcttttttggttataaataagcatataaagcaaattttggggtggaaaaaaatttcttgtgtttttatttaaatgcctactgaatccattctgtggatgaactgaactactcagcccttccatctgcctggatgctgaagatgctttccattctttgctcaaagctgggcagctctgagctgctggtgccttcaagctgtttgcctgagtggcaggtcatcctgcagggccacaccgttgggtcagaggccacggcttctgaagatctgttgcctcacagtgagcactatgtgcctgtcacctgagcatggcagctgctgctctagtaaccaggcactgattcagtttccccaaagcagtggtagctaagagaatttttctttcggaagagtttcagctgtggcaggggagtcccgtgcccttcccaacgcccctgtttttgtcaccttcctaggcttggagaaccccctgcctgagcgtccccgggaaaaagaagaaccagtggttcgagagacaggtgaggtggtcgactgccacctcagtgacatgctgcagcagctgcacagtgtcaatgcctccaagccctcggagcgtgggctggtcaggcaaggtgggtactgcggggccctgggcggggcaggattgcttggggcatctggaaaaggcaggaggaggcttggccaacaaagcactggtgacttgttcaggccctgtctgcataggaccattggtttccccatttcctgatatccaaggccctgcttccgtggctcctgccgccttttctgatccgtcttttttactctagcacctcgatgtgccaccttcatacgctgtttcttttgctcagtaagttcctattgtatcttcaagacccttgaaataacagacccagatgtactgcagcctcagggctttctccctggtcctggcacgaaagcacttcttccagacaccacatggctcacactgtggcctccttcaagtgtctgctccagtgtcagctctgtgagcatctccctggcccctctgctggtgcttctcatcctcttgcccactgcatagttctccataacacttctcacccaacatagtccaacatgtccttctttgtttattggatttaaattaaggggtttgttgcatgcactgaacgtaacattttgatgtgtttgcaactggcttctgtcttcacagtttcttaattactccaaactggaaaactagatgcctctgactcttaccatgatagaagtcactgatattttgcccatacttaaattgattagtctttgcccctacaaccacagtgtaagctccgtggaggctggggttttgtctgttgctcactgaacctgcaacagtgcctggcacggtaggccttcagtaaatgggtcagtggaatgaaggagtgagtggaacttggtgcgctgtgctgagactttctctgcagagatatctgtgctgctgcttgtctgagcctgctggcagcagaggccctgctttgctcttctctggggccctaggcctctcaactgagcccaggtggggtgcccagcaggcttccctgttccctggtgtgggccacatgtgtggagcagaggggaagaggctggtcctgaccaactaactgtctgtctgtttctgtctcagaggaggctgaggatcctgcctgcatccccatcttctgggtcagcaagtgggtggactattcggacaagtacggccttggtaggtttcttccagaacaggtgggtgactcaggcacagccaggtgaccttttcagttgttacagactctggcctttttgagctcccaggtactgttctcagtgccctcctctctccatcccaggcctcccagttccagctcccagtgctccctgactccccagctttttttttttccagagacagggtcctgctctgtagcccaggctggagtgcagtggcacaatcatggctcactgcagcctcaaactcccaggcccctaagtagctgtgactacaggcgtgcaccattatgctcagctaatttttaaaatattttgtagagatggggtctcattacgttgcccaggctggtctcaaactcctgggctcaaacaatcctcctccctcagcctcccaaagtgctggaatcacaggcatgtgccaccacgcccggtcccactccccactttctattccccctttctgagacctctctccaccgatccctagggtatcagctctgtgataacagcgtgggggtgctcttcaatgactcaacacgcctcatcctctacaatgatggtgacagcctgcagtacatagagcgtgacggcactgagtcctacctcaccgtgagttcccatcccaactccttgatgaagaaggtgagtgccgtccggcccatggggggtggtgttgcagaagtgggacctgtgctggaggatcagactctaattctggaaccccttacctacttttcatccagatcaccctccttaaatatttccgcaattacatgagcgagcacttgctgaaggcaggtgccaacatcacgccgcgcgaaggtgatgagctcgcccggctgccctacctacggacctggttccgcacccgcagcgccatcatcctgcacctcagcaacggcagcgtgcagatcaacttcttccaggtgagctggaggtcaccaggcgcaggagagagctggggtaggctccgcatgcctggcagtggcccatgtgggttgaatgtggagtgagcggctcaggtacctataacctgttgtgtcttccctctactccctaacatacactggcctctgggatcgccaacccctgctgctcttctcttgcaggatcacaccaagctcatcttgtgcccactgatggcagccgtgacctacatcgacgagaagcgggacttccgcacataccgcctgagtctcctggaggagtacggctgctgcaaggagctggccagccggctccgctacgcccgcactatggtggacaagctgctgagctcacgctcggccagcaaccgtctcaaggcctcctaatagctgccctcccctccggactggtgccctcctcactcccacctgcatctggggcccatactggttggctcccgcggtgccatgtctgcagtgtgccccccagccccggtggctgggcagagctgcatcatccttgcaggtgggggttgctgtataagttatttttgtacatgttcgggtgtgggttctacagccttgtccccctccccctcaaccccaccatatgaattgtacagaatatttctattgaattcggaactgtcctttccttggctttatgcacattaaacagatgtgaatattc

SEQ ID NO: 2691 - DNA, 26200 bp, Homo sapiens
  source 1..26200: mol_type = genomic DNA
tgcagtgtgttatcctttaatgaaaagctgggtcaatggagtcaccactctccccaagacccccctgcagcagatagccctcaccatggctacctatgaggcagggcagccctgtggcagccagccctgctgaggggtcagtttgtagtggcctaggagaggcgttcaactcttagacctaggatgtggcagcagcaacaaggccagaggcagctcaactgaggtcagggatggtggaggaggcagacaggaagcatggggctctcctccttcctctccgaatcccagtgtggccaaggccagtgttcaggaacagtacagtctccccaggggcctggagtctcttccagccactctctggaagcccttagtccccaactccctgcagaccggtgtcacagggtcgctggactcggggagcaggctgggtactaccccatgagccttgaggccccgggtctaggaggtggatccagcagggccgaggccagagccaccaggagactgggagtcaccttccactaactctgcttgtcagtcactacaggcacctaagaaggtggcctctcctccgagcttccagggctgcccaggccaggctgaagcaacagcaggccgtggctcctgggttcctatagatctgtgaccttgttttccacagcagctgcaatctgctggagccgatagcccagctgcatcttctgggccgtgccatcctcctccagggcagtgatgatctgaaacagagaccaatgccatcaggggagacttctttggccaacgtgtttgctgcaaaattcaacagccctcctaagacgctgtggcatgagtggggtaggaggccaagaaacccagccggtcacttcacgtactttctgggacctcagggcctcgctggcgggaggggtaataacatcaaagtcaccgcggggttccaggatgaataaggtaggaaatgaaggacctgactcagtagcgagctcctcagaagccctgctgcagccatcctggctaacccacccgccagccaacagtatttcccaagttcctgtctgcccggtgccagacaaggggcagagacccaagaatgaccagacacgtggtgggaaaacagacactgatcaaacacgaaccacgaatttggggctgccaccaagggaaccggtaggaaccggagggcagcagcacttgggaaaacagctactgcccactatgtctccacaaggggacatgcctgcatcacaccctgcctcccccaagccccgtgccatggcccacaccatgccgaggaaggctgtgggccatgagacaggttcctcatctctgagcagcaatagccatgtcactggtgccacacaaacatctaagtggactattccaccaggcatccagcaggttgactggcaggtgctcagctcttcaggcacagcccagggatcctccaaaaagcttcaccagctccagtgtaccctcacacccctggccctgtgcctggactctcctcttcgcagctcatgcagccaagccaggcctgcacttgcatgttggccgtgcccaacatgctgccaactcagcaaatgcacaccatctccaggccctggtagaccccttggcccccacaaccaccagcactgtgcctcgccgtcctgctggggagctggaatggggagcagtgggacaggtgagagcacagccaatgccaggaagcccgcctggaaaacacttctcaagccaccaaggggcccggccccccactactctgtccctggggaagaccaaagcccccaacgtgagtcacagggtcagagccccttaagtctcctgggaggccttgggtcagcctcccagtcggggtccagggcctgcccacctggtcatagtacttgttgatgtacttgtagagttcatgcagggccactcgcgccccgaggtctccggagtagttctagggaagaggccaaatgaaaggtgagagagacgaggggtgcagagagccacaggaggcagcccaggaccccagggaagggctgggggagaaggggacctgagaggtagagaatgggatgggcactacagtgggaagcagagtcccctccatggcccagggaccccaggccaggtgtgccagatggggacagaacagggtagagcaagggggcctccttggtaggaagacagcccaggtctacctgcttcagcaaggtctggggtttccactgaagccctgcctctctcacccccttgaggttctagcccagaccctctgccacccagatgactccagagccaagtggcacagatgccacttgcaggctgacagcccagcatgattctgctctggcctaactcaagtatttcctgaggtcactctcaggcccctccatggggacatctctgagcctcaacttcctcacctggacgatggaattggtgtcacctagcttgtggagttcttgtgaggatcaaataagacaatcaaagcaccccatgaagggcttcacacacaacaccccaaaattatatctgctattagtgttgtggttgtcatcatcaacatttcagaaacattgttcataaactccctggagttacattttagggcggtttcaggaatgggagaggtgaaggggacacctgtgccaccaagggaagcacagcagtgggaagacgcatgcaggcagacccaggcaggcctggggctgaatcccagctaccttgcaagagcctggctgaatcagggtacatggcagctgccaggacaagacccctgcttgctctgtgatgagatggtgggagccctggtctttcagtggcagttggaacattctgcatttatgtttcctgccccaaccagctcacagggctgctgaggttcccaagggcttccctgcaaaggggcagtgtgaagggggaaggaccgttgtggcaggaggcctatgcccaacccaagaagcagagggaggccttacccaggacagttcagccaggacagagttcatctcttggtcgctggctgggacagtctgtctgatgtctgcatagtacctgccagagagccagggcacagcagctgctgggtaaacaagcccactcccctgctcccaaccagagcccaccccccaagcctcagctgcacacgccctccaacctctacccaccgtgccctccagtacctttccaccatccgcttgtaccggggaatgtcccgtgcatacagaagtttgttgatcggggagtcctggacatagcaggaggacagcaaaagaggaaggaaggaaggatgagggtccctgttcgagtgatcaagtgtcctgggtttcccagtactgcttcagttttgaaaaggaaaagtctcacatcccaggaagcccctgagtcccggaaaaccaggacaggtggtcaccctcgcctacttccttccgcaggagcctctgctgctccctcccttccaccaatgtccagtctctgatgtcatcggaaatcatttctcagctccacatgccaccatctagatccagcaagagcccggtacgtagggcaggacgcatgctgttcactcccagggtcatcattttaaaaatgagcaaacagacccagaacattacctaagcggccacagaccacctctctccccagtggctgagctaggatttcaagcaggtctgtccagtttccaccactttaacacacctagacacagcgtctacaactgaactgggttcaagtcccagcagccatgggctctgggcagcatacttctattctcaggacctctcctcatcctagagctgctgggaaggtgagaatatctcgaggtggcactgtcccccatgagcagggatccaaggccagctcctctgtcaacctgagtcaggattcgcgccttctcgacaactccccatgggggaacccttggcattctttgttcggactactcctgagctacccaggaaccatttgctgttctgctgggaaggggaggtactggaaggatctggcaaaaatcccagccaccacatagggtctaccctggaggtggccctgcgggtcctggtgtggccctttgattcttagctcattataggcatgatgacagcatgtggaacaaaaatggctcccaaaagacagtgctacaattttggacagaactttccgtttttgtttttgttttcagacagggtctcgctctgttacccaggctgaagtgcagtgaacagagtagtcatggctcactgcagcttcaacctcccaggctcaagccatcctcccacctcagcctccctagtagctgggaccacaggcacacaccaccactcctggctaatttttgtattttttgtagagacagggttttgccatgttgcccaggctggtctcaaactcctgagctcctcaggcgatctgcccacctcagcctcccaaagtgctgggattctaggtgtgagccaccgtgccaagctaattttgatttttcccagaggtgtagggatgtatctctcaagaagtcccaagccaactgagacctgggggtctaggctaagcagagccccactcatggacctgcagagtcacacgagggccctgcccactgggtgcttgagcagacaccttggggacctcatatgtcaggggactcccggctttgactgctatgacaatagactcccaacctctgtgctcccggacggctccaaccactcagtctcctgtgcttcccagctcccctcctcacacatccctcaaactgtgacactccatgaactctcttccctacttccctactggcaggcagacacctccaccaccctaaggaattaaacctaatcagcagcccagagctgctctgggattgaacaatccatgtctctatctggaaaccccacaaacaccagactcaccttctccaagtctaagcttaccacagccagaggcccagggatcatgtgtgactcccctccttcttcctcatcccccacatccaaccttcagcttttgcctgccctgcaccctcccacccggcttgaacccagccactgcttgtcaggacagcacagcgccctcttgggactccctcactcagctcatccatgcacagcagccacaatgttccaccaaactctcaggtctggtcacataacttccctgttcccagaccttctgtggctcccactgccccaggagtgagtcctgaccaactggccctggcctactgccacgcctggccagcattctatgccccagccacaccaggctgtacttgctgcacacaacttcacctgtgaattggcacacagtgtcccctcctcttgctcatcccttaaaactgaggtggccccgggatgaagccttggcttgggaggtcagaggtctcccctaagccctccttgaagttctcagaaaagcctggaatctgagtgcacacacagcactgtccaccctcacccatcccccccgtgtccatcccagactcgctcacccggcccagcttgtggtcggccagggtgcaggcgtccatgaaggtctgtgcaatgacaaggagcaccgcatccatgttatcagatgtttgcacgtcgaacacaaactgcgggttttttattatattgatccagaacctcagaggcaagctgcgggtggggcaggcatggccgatgaatgtgctggggaggcagaagagaagaccccccacacacacctagagcccacccagctccaccccacctgttggtcttccagatgtggatggtgtcctggtcggagatgccatgctgctgggcctgctcatccagcaggtcaaagaagtacttcacagcgagcggcacggggcggctggtgctgagaatcacctggaacaggtcatccacgaacttctgcagggtgccctgtgggaaggaagaagcagagaggtgtggtcagcaaagggccctcagcagcagcccagcctcagacaccccccggcactgtgcctgcacgagccccacaccacccccaaatcccacgagtggccatgctccctctcagcccaggccccactaccttggcaggccccaccccaccttcatggacagcaggcgggtcaggtagatctcagggatggccttggcgcgctcacgctccccgccccgaaggctgcccctccgaggcctgggcggctccggctcatcacttggcttcaccaggtgccagggccggatgcccccctcatctacatcctccagcattggggtccctgtgccaagagcccacagctgtcacccctccccaggtgccacctccccaggccccctgtttcttgccagctctcccaggggtgggggcacctggttgagggatttcctgggccgaatggaaataggcacaagcctgccctgaggcccagaggaccttccccatgactccgggctgggcacagcaggggcagaggaccgtgatgggagcggtactcacgctctccagggacataatcctggttttcccggagcacatgcttggtgaggcaggggacgagggccacagttgctccatctgggacctgctgagcacagctggtgatccctccaccagtcccaccccaccatgccctcctccagctcccactcctcctaccttgtaatgctgcagtgtgttcaggcgcctccacagaccctggacctcagaagtgacatcctcgtcagaaagaatgaggtgcccggccaccccagaccgccactctgcaagggcaaggcagaactgggtgcagggctggaagatacccttcccatagtggagcccatctcctcctccacagggacaccagcccctccatcatggggcagccttactcaacctctccaaagaccaagagcagggaccccctccccagatgagaggctgtccaagaaagatgttccaaagccagcttctgcctgcctcccagcatcctccccaccctgagtgatgagttgtccctgcagagttggtccggggccagcccaggcccaacagtggctcaggtccccaggggctctccacgccctcaccaacatcaagggtgcgagggtctggccgctgggtgagaggcactcctttataaagctggtccagcatcttctcctttgcctgggagatggtgtcacagtctaggaccttcacgggcacgccctgggcctctcctgccccaggccccacagccaatagtgcattcaaggtctgtgcaggacacacaggagccatcagggttcatgtgcactcaggatgaccaagacacaggccaagggcagagacaactcatgagaaactgctgcctccaatccccacgcaccacacaatccctaattctcgtctcttcacctgcctgccttccccagggacagcagcttcctccccattgtgaccccagcacctagcgcagtgcacttgtaaaccactatggggtaaatggcagaaaaaaatgagtgagcacaagtccctcatcactcagatccccaggttcctggctgaatgggtcaggctgacggagtttcgggaagcctgcattcccaccatcgggagcaaatattcccacctatccgacaggggaggggttcagcaggcctgaatgggggtttcccacaggaacccttgtgcgtaactaaggggaaagcaaacccagagagaagtgcctgccagagtgaggctggcttggtgggcaaggccgcattcctggtaggagggccaggcagacagggtcaggccctgacacagctcaagcccatggtctaaggtagggctggcttctcccaaaccctggttgtggctaccctagttccatccctagcctggggcacatagaggccttatcatcaaagtctgccctaaactgctatcctgctaagctagtctgatgggctctctccaggagccagccagaggtcaacccagctctacatccaggtaccacatcagaagctggtgtccagaccccacacacccacacactctccaccctcgccctcaccgcactcagactgcaggccacacacttgcacaccctcaccaggggacggtactccacatcctctctgagcaggcggttgtcgttcaaggtgtatttggccttgcctgtcacactgtccactggccccttatccacttggtgcttaatccctcgaaagagcatgtacagaggctcccctacggagtcctaggagagcacaggcagttagggccccccagcaggtggcagaggtgtatgggacatgacgcacactggggaaggggacaggacatgggcttaaggggactgaggacaggctgagcaggagtctctgctctggcacaagtgtccgagctgcatggtggctgagggcttagaagtttggagggcctgaccctccctggacaggagccctgtccacctctgccccctcaccctcacgaaggtatacagacagatggacatccagttggtgagcagcttctccaccacagtctctgtcctgagatgatgggaaaggggagtgccagggtcagcaggtggggctgcgggcctctctatcctgcagaccccccagcccgaggccccaccccagctccagctgtccagggcccacccagccccaacagccacacagacctgcgcagcatcagcttggggttcttggccacatactgggcaaccaggtcactgagcagagtgcggaggatgtcagtgaaatactcaagcttcccatgcagtgccacggtgagcagagatgccacgtaggcacggtcccgagctgaaaaggtgcgctggctctccagcgtgtggatgaactgcagccaaagagaagggatgggaaaaggggtttagggggacagaggggcgggctcagaaaccatgccctggagaaggggcagggccaggggcaggccaggaagatgcagctgggggtaccttggtgaggaagagcttgctgttgagcaggttagagagctgccccagcccttgctccacagtgggccgtctgctctcaggcacacccaggtcccggtgcaagggcgactcgcggtgcccagggaagaagatcctctccgcatacaccttgtagtcgaggaaggggatgccgctgcccaggaggtcactggtgagatcggtcatctcagtcatgaggtctgttaagcagaagaggccaggttaagcacctgttaagcaccaatcccgtgtgatgggagtgggtttgggcagagttctggagggcggggcccattctcccagccacacctgtgaattccttcttgcagcggtcccgcacactgctctccagattctccagctggatctgaaccttcttatagtccctcagggcctgcttgctcttcctcctgctcagccccagggtcaggagaggatggccagatgagtcctactcgcccaggcctgcctgacaatccccaggcacaccccggcctcatccagcacagtccaatgcagccatgccagccaagctcaagcctagcccagtacgattcagcctgtcccgtcccaagcaagtcacacacacccatgccccgtctagcccagcacagtttagcctagagatcagccaaccacaaccaggccaaatccatcccacaacctatttttataaagatttgttagaacacagccactttcatgtgtttccatgtcgtccctggctgcctttgtgccacagtggcaaagctgagttgttgaacagagaccacttggcctgcaaagcgaaaatatttactctctggccatttacagagaatgtttcctgactcctggcccggtctgtcccttcccagtccagccagatcccacgacctgccccagcccagccacatctggctgcacccacctgtacatgaggacaatgatgatgacacccagagccagaagagaggtgcccacccccaagcccacctgggctgccacaggaaaagccccagggctctcgccgtcatactgcacgtgacccagggagaagcgcaagttccccatctgcacctgtgtcaggagccacctgtgagcaagggtttggcccaggtcaatgcccagcccggccagggacctgcccactgaccgtgaactcaggcaaagagtcaggtgcctctcggagggcatggtgccgtggcaggggctgctccacggggggctcgcagtacaggtggtgccgcgtcagcgtcttcaccacacaggggccatcccctatcatagccaccacctcctccttggacattgcaaggtccaggttctccccctggaacagagggtcaccgatcagtcactcaggacccttccctcagatcctgtcctccccaaatgtgggaaggaccctgagacccagccgcagcagcaaagctgacagcctctcagcacccttcccgagtgcaggccagtcacacagtgtcctccaagctgctcctcatcaccctttgttgccctttcctatctttcttctccagaacgaaaaatctggagaacataaagctgcctcccaaatcctgcccagctacctaacaaagctggagcccccaatctgtgtctgatgactcaccaggggggtgatgatgctgtatcaacctgtggtctgcccgcatgcccatctgctgcccactgtgtatgtccaagacacatgcctagcgcatgtccatgtgagccaggctgccaacgggggtcagcccgatggcctatgtggaccacaccacccagctactgcacaggccgaacatacaaatgcagtcattccagagcctgccatggagtgcatcaggacccgggccaccagccaagcagtccagctcgtgccagatgctaggctaggcaccccccaccagccccctctgcccccaccacagcaaggatgaggagccatgtccatccaccggcccttgctctactgtctcggcctctccgccacacacagcagtgctgtccagccaagggaagggtctcggggccctgccaggtccaagtaggagctgtacctccacggagaacacactcccaggcttgtgccggaatggcatggtggggtcctcagggttgagtggctgcagggtggggtcggcctcataggagaaaggtgtggggttcagtgttgcaaagtcaaagaccaggttgtcaaggataaattccacccggacccaggggtcctcaggcaggcctgggagggcaggtgtgcggcacgtgatgagctgggaggagttgacatggcacggctcctcaaactggaaggaagacaggcaggttgacgaggggccaagcaaagatgggaagagcctcctctggcacctgctctggctgtccccagggtgtggtatggggcaaggggagagtgtgggggtacccaagggtgtcctacttgctggctactgcaggagggtccaagggaacatgccgtctccgggaccacgcgacgcctccgtccaagcccctggctgggctgcagcattctcgagaccacggtcacccggattcttggcgtctgtaccacgtccagattctggccacggacgcatatctcacgtcctccactgaaacagaccgtgagcttacgtaacgtaagatggcttatgttacctggacctaaagcacagcccagtcccggctaggtcagctcagccccagccccaaaccacacgaccccttgcccctactagcagcatgggattctcagtgcctcaacataaagccctacaaacccccacatagtggagctgcaaagacctccctgccacctgccatgcagccacacccctggcccaacacctgaggaagctcttggtggggccagcagaggtgatgttggggtccaaggtatacttgaactgtccgcgttgaagcctccgctccgtggccccaaaccacacagccacagggagcgtggcaggcgtggggcgtgggctggtctcacaccgcagttgttctgactgctgctccggcagcctgggaggggaggtgggaatgaatgcaggggcgcaggcagggaaaacttggaccactcaggccccaactggcttccctcaagcgctgactgcagtctccaccaggtgtccctggaggtgcactcccaccacagctggctagggagggtctggccactctctgaaggagcagactggccctcttcccctttctgctctccccaggatctcagacccctccatctttcccctggagcagatggatttttgcaggatgaggaagtggccctcacaagtgacaaggctggtctccaaccaccactcggatgtcctccagccgcccagtcaggagcttggagccattcagggtgagacgggtgcccccagctctggggccgcgggccgggaagatggaatggaccttcggatcctgtgggacagacagggagagagatgagcatcagaccagacacatggaggcagggacagcctgagagacaggctggcccaggactgggagccccaccaaggaataaccagatgggttgagaggagccaccagagaggttggcccgctggcagctgggggtggctcagcagtcaggtacctggtaggcaaagtcgtgttctgagacaccacgtcctcttcccggcacctccaccgctgtggcgccggccacctcctccccactggccccggtgatgcacacgaggctgtaggcacagggcaggctagggggtgccaggctgcatcaagggcccctcaagcttacctggcagcccctctccctgccctactgtcaggtggtcttccccttcccatgctccataagattgacagagaccctctctcactttggagggaattctttatgacacatcagaaggccttggtatctgagaattaatatttgtggcttcaatcatttaagttcaaccccaggggcccccaataaggaagaatttatctgtggcataaatttacaaaggggccctgtcagcctggttgtggggcgagctgctgagcaagtgagtgggcacagctagccgcccatgtcctccgccacgtcacatgcacagtacccactcaaagcatggtagaaacttgatttattcaggaaaaagagtccctgaaagcctctagtcagacagggaaatacaggtgaagggaaagtgaaccatctaagaaaatgctggttcttagccagaaaatagaagcttgggcaaattaaacttccagagtgttaagcctgcagtggctcaactcagtgacattgtcacagttgttgcaaacactaggaagacacaagtgacgtgtgagccacccaggggaggctccagacagaatatatgctaattgcttcataaatcacagcagtcttatggtctggaacactaacagtctagatagtcaccgtaagttctcggtcataacacattcaggggacactccgtgctccaggagagtggttccttgtttcaaatacagatttgggggccccaccgtgggcctcctgaatccagatgtttgtgttggtttgggacaggatctgcaggttaccctgatattcagccacgtttgggccctgctgcttatggacatctccttaggaatgtcctgcgtgtgtacctttggggcctgcaaccgctggccaggttaccataacccaggagccccaggaaggcagcaggggtccctagagacgacagtggagcctggccctcggccagtgtgcctttctgaggtgtgccttccaagtctaccttcctgaagagcctggcagcccaggacaatgcctggggaagagtgagctggtgagaaggccagcccctgagcttatctgtctgatctgagggtcctgctgccacagctattaatatatccacagtccctcagaagaccaggtgagcagagcaggaagcagagccacgagtcagttctgggcagtgacgggcccaggaaggattccccagcagcccaggccaggaacctacaggtgtggtgggtgctcagggtcttcagtggcaacgctggcactcgggcattgtggccaggatcaaggaacagggagagaggggggcagatgagcggtgggtgggaggccccaagcagcaacgccaaccgcggaggccccaggctgcgccgtgctcctgctgggtgcagccagcttacctgctggagacctcgtactcctgggcatccacagcacagggcactccagccaccgtgaccatgcccagcacatcctgcacatgctggcccaggttggagcccctgatggtgacacgggtgcctccgtctacaggcccagtcagtggctccacctgttccaggacaaggactgctcacctctactcaactggaaaggcagccccaacctcccacctttgggcccccacaccctccctctaagggcagcactgaggaagggatggccagcctttcaacaaaccgagtggatgaggggcgctgggcactgggtggccacagcctcagcctcaccacaggcctcccgggtcacacaacgtggacgctccccctcacaccacacacagccatactggggcatggcagtttggcagcggctgcagtctccatgtcccacggaacagtcatacagtaccactgggggtggcagagacacacgtgagaggcaggcctgggagagccctgctaccaccgccagcccagcagcccgcaggtggctcaccatgcagcccctcagcactgtccacacgcagacggccggcccgacgcagaaacagccccacacggagctccggctgcagagcctcatagctgagctggagaaatgggagtgggttcagagtcaagcactgggggaagtgtcaggcctggggaggggttagtcagagaaaggactaaaacgaccagttaggagcatagggtcagagggaccccatggggccacaagttggagggcagagccagaaatggagtatggggaccccatggggtctcaagttagagttcagagctgggatgcaaggactccacggggcacatggtcagaggtcagaaatgggtgtggagactccctcagggcgacacggtcagagcgtggctctggaaagtgtggtgcagccagctacagttggcagccagcctgtggccagtgcagtgcacccgtgcccacccaggcgctcatggtgtgcacctggtgctgctggcaggtgacatggcactgggtatctggaggtggctcacactcgacccgggcctcaaccaccacctcgaggccctccagctccatcacacactcattgtctcctgggccatcctgagggcagagaacacagctgttgggcagcttcaggagctgggcccagggagtcctgcaggtcacccaacagatcccccagcacagcttctgggttggagttgagccctcggactctgccctcctcctgctccccagggcttgtgcagagtttctcaacagctaaggaggctgcaaggacagcggcaggcaggacacactgacctggaaaaggtgcaggttcctgcctagcagccggatttcccgctccacatggaccggcatcaacgtggagccctgaacgctctccacacaggggcaggagcttgcccccaaggtcgcctcttcctgcaggcaccaagggcaaggcagtctatggagcccaccctgcccagctcagccctctgccttgccagattccagaggcaaggccggtgtggggctgcagactccaccctgcccctcacctcctcccagtgcagaatcacaaggcaagctaggggtagcatcttccccacatcccctcccctgaggcctccttcctgggctgggcctcaccagctcccagagcccgggggtgtcatactggtagtcgaggctggacgggaggatgaggggggcgggagggccctcaagctctgctgagtctccatcacctgagaggagggtggaagtggagaaggcgggtgcgtcaccccccgtccactcgtccgcctcgggcagctcgccgccttctctcgtgagccagtccagggcgggcttcacggagcccatggcccctgggaaagtggtggcaggaacagtggcagggggcaggtccaggggcactgtgggatgaagagcctcggggccagggtctgcagggggcactgctgctacctctgacggtgacagcggggaggccaagaggtcctcaggtgtggctgagggtctgaagtcagtgggggcagggacagcggttccaggtccattttgggggctgggaggggagggctcctcatggagaggcgaccctgtggagccaggggaagatatggagccagaacctgcccatggcccccaggggctgagcagggaaggactagccccaggtgagatgtccgaagctgtggctgtggagggagccccaggctccacgggaagggtgtcaggagcaggggtggccagggctttgggggctgtgggtggggaggggctgggtccacctcttgcaggagggtctggggagacaagcgggctctgaagggggaggcagaggaagacaggaagggccactcagcaggcaggcgcgggacaggaggcaggcaggcacagtgtatgttaagaggaaaggagaccaaggaaaagagaaataaaaacagcccattaattctccactggagaaaactgcgggggaaggctccaggggtgtctgtgccgaggtggggcatgaaggccagacatcccctgcctctcagctacaaatgccctctcccaaaacaggcgggatgtatcggcggctgttctccagggagtccgtcacatacagcggctctggtgctcaggacagagcctcacataggcagacagaccccgggccatgagaaaaactctcacactgggacccccaacccccccggtatggcccagcccaaagtcacactcacctgatggcttgcaaccatgggcccagcatcacacgaggccttgtgggtgcacaggtgctgccagacacaccagttacacccccagcggctgctcacacaggcctggcacctgcacagagcacagccatggggcaagggtcgccacagggaagcccaggcctggggacagggcgaggaactcactgcgcagatgggcggagttcagtgaccgccacacagtcatagaaagagagggaagttttggcgatcacaacagcgccaaatctgagctccacgctcacggatacgtagtctgcagagggggagagagggccagggttaagcagcaaggaggtgcactcagacccagagccgatatcctgagcccttgaatggggaagaggacccaggatgagggaatacagtccaagggcacagaatggaggcttcaggtggttggggagtgggaggacccagagaaaggcatccattcatggctctttgcctggattcacactttaaccccaccgcatcccctgaagcaggggctggcccccaccaggctggcccattctctcacccaccggctcctctcggcagcactggggcctcactagggtctggggaggggcacatcacaccagaaccagtcagcagggcaggactctgatgttccccaaagtggcaggaatatgactcccctggccacaggggtggcaggtctggcactgataggaaaacctgccaagagagccagggacacactgttggggctagtgggcagcagaccagggctcacatttatgggacacccaatgtgggcaggcaccagcaatcaacagccctcaggcctccccaaacaccctctggcctgagttagaaatagatggggaaactgagctcctaaaagaagtgacttgtgtgaggccatgtggtatctggcatgtccgacatcaggatccaagatctctacccagaccttgatgcccagagccctccccaccagggccctgcctatctgatcattcacctccctcgtctcctctcggctgatgttggcaggactcatggctgccacttgcagacagcccagctcaggctggaagctccatagccactgctctgggccctggcccctcgagcactcagaacggcgactgcacctgggcgagatgaccagtgtctatctgtgaccctcatgggccactgggagttcatagggtagggactcctacaatctggaggacctgggcagggccctagagtgggcatgatagaggctcctgtgtctgccctggcagggcactgatgcccagtgcagaggatgggggtgaggaattggggtgtctggggatcaggggttgagagtcatggtctaagggtcaggaattctggacaggacaattatgcaggagcattgtgggcttgaggctggggctgggatggggtcagaaatctgacctgccaaggagcacgcaccacccacagtatgggtccctgtgagcaaggcaagatgcacagtccaggtgctgagcacaggaagccacaggaaccttcagaagctgtgacagcaaagaggacctgaggccagcaatccaaacaccagtggctcacccacaagtgggtccctggccccacccagaggcccctcccagcagtcatgccctggcttgtgcctggcactcactgtgctctgggtcatgacatacaggtgctcaaaggtcccatcaaaggtgaggtctctgctcactgcagacccctgctggatgctctgtgtggagtatgggtggccatcgctccctgggcccaagtagacctgggatcagagaccacagggtctgggacccaagtccatggccagaggcccaaagccctcccctcctccacccaatcgaagtaatttacaaatagaatttcctcctaggcagtcacaggtcataccaactggcctagcggggatggaggaaagtcacaggtaaacaccacccagtcctggggagaggagctcaggtcatctctcctggcccaggggtcacagggatagcttaaaccaggctgggtccctagcaatctgttccctccagactctggggcaggggccagtacttcctgtgggctcaccctgtgcagctgcccttgactatcacccaggaaagcgatggtgtgtccatcttccatggtgactgccacagctgttagctgaatccctggccactccagaattggtgtggcttccagcgggacccggctggccatggggctgggcgtgtggtctgagccacagggataagcatccagggtgtcctataggcagcaagaagcatcaggaaggccctccctggataacctcctcggccgcatcgtccctggacaacctcattccctcccccagccgctctggtagctctccctgtacaactgtgttttctctgctggccctcctgggacaacctcatccccgcccccagtctctcttcccttttttatccatcctgaggctacagctcatcaatcccgacctcaccttcctctcctgctcaagaaccaaaggtctcattccattctaggtccctgtccctacccaagaacccccaaacaccctcccaatccaccgacacaagtgccacccctccagcatcctggtccaagcccatccagacactgctgccacccgcatgccagatttgtggtaaggtacccttccactgcccaggcaacataggaagcacttaatatttgctgatctgatcatcctcgtgctaccaccagctgccctcggactctctgggcagctccttggctgcaaatgcttggccagtggcctcagagaggcggaaaagtggggcaatactggaactcaccactggcagctgtgcacagtcagaattgacatcatactcgatgtaggccacctcggtcccatcctcagcacgaccctcccgggtgtagcaggcatctcgcgtgcgattagcaagccggtccacctcatccagggggaaggcacagagggcagaggctccagatgccccagcagccgccgatgggggccggcccacagtggggggtgcagccgaggagaaagctgcaaagagcacctccccatgcgccacctccctggacgtggccacagctgcagcctggatcagcccgtagcggccaccttcgcaggccagaggcaactccacataggagtagtagtgctggtcccggagacacactcgagatacataggcacgaaaagctctagactgagcctgcaggtcccgccgcaggaacaggaagtaggcgctggccccacgtgcaaaggcactcacgaagtggtggctgtactcggagaggcggcccactgccagcttggctgtctcctcataggagaaggcagcttgggggtcgggcggccacagggcccgggttgtgatgggtggaatgccaccccccacacccctgctggtgtatcctcgccccacaaacaggaggggctcccctgccaagccctgggctaccagccccaccgtgctgaccgcaggatcattggcagccacatattgtgtgtccccaggccgctctggccgcagcagcagctgctcgagctgccccaggcgccgctgttcacagaccccctggtgcacgctcccgcataccaccagggcccctgggctcaccaggagcagctgattcgggttgttggtaggctgggcctgggggcactcatcaggcatcacaggtggcaggcagtccctgctgtctagcacagggccggtggacactgtggcctccagctgcagcccagggctcagctggaacaggaagttggtagcccccaggtagagggtgcctgaggtggggtcccttgccaggtgctgcagatacgtgccattgggagtgaatgcagttggtggaaggggctggagggtgaggacccacccggcccagagagcctggagaagagctgggcccagagcaggcatggtcacctggcaggaagagaggtcgagagagtggggctcacgtggccgccagagcaccctggggccactggtaagggataggactgtggcattgccaagatgctcctcctaacctagggggtgagcagaggaggaccaggcttcttagataggcactatgtccaggatgaccccaggaccacacactagaacaaggtcagaaataggagacacttcctagacaacactgcccattctctgcaggcacgattctctcaggagacctgcaccccactcaccatccccccagatcagagggtgaggggctgagaggccatgcccaggaagcagggtctggatggggcagaagagcaggtgatgggaaggaggggcccagaccccaagaaaggagaggctctacatggatgagggtttcccgggcagaagaaggaaggagagggaggtctcctgaaccagcagaatgttagaatcaagacaagagttgggtgcagggcctttcaggccaggaatccagaagggtaataaccacagaaccaacaggcctgagagatgggaagaggttccagctcggaggggtggggcctgaagggctgccccccacctccgagagccctcagaataggtaggagtcatgctgctcctagatatctagtgtgaggtcaggctcacctggcagggccggctggatcaggagacaacagcatgacccgtgtgggagtcacctagcaggcgggaaagccgagtgtgaagccggggcctgggctgcaggcacgtggaagccctgggctccccaccggggaggcagcacagaagcaccccctccccaccgcccagcctgctggtggagctgggcccagcctggcccctggccaccaaacacattccacagaggacgcctcctcagagcccacatgaggagggggagggcagcagagccaggcacccgaggggcctgggaaaggtcagctaggaaggagccccgtggctggcagggcccagccaggcccccagcatggccttctccctgtgaggtccctctctctgctcaaactccaccctgtaaaggcacccaggtacacaccctctacacagccaggggctgtcccagcccaaagggccaccagcgcttcagcagacaggcagtcgcacagcaagatacatacacaccacccaccctgtatgtatatgcctacaacacacacacacacacacacacacacacacacagagagagagatgcagatgccatctatacacacagcacagtgacacacacagacacagccacccatgttcaaacaccacatgaagacacatccatatagagacaactcccccacacagaaacacactgcaggcacatatgtcacactcacccgagacattcagaccaccactcacatttagacatacacacgcacactcaggcacactcccctcgtttgagagtacttagttggagccctacgtactagagagctgtagaagctaggccatctcttgctatttcctctcctgcagttcagaatagtgccagggcccaagatgtggggtaagtggagtgtgtcctggaggaaggtgccatgcctggctgttcccaggcccatccccaggacctccccagactttgggtgcctgctttccacacagaccccttcttgggccccagctgaggctcctgagtccctgaaccaagaaactatggcaataccaccttccccagtggtctctagccaggagcaccaaggttggtgaagtgctgggacagacaatgcatctcagactgggagacacttcccctacttgcctgtgcccaggccacgttgcccagcccctcccatcacccagctgccaagctgtctgtgcaaaatatcccaagcgcttgcttctcccaggtcggctcatcctagcagatgaggcctgagcagggtactcctgaggctgccctgaagtgaacagggccgggcacaaggctcaggggagggtccagcagcctggtggaagccgggacactgtggccacagcccggtgggagcaggggggccgtggtcacagcctggctgggcactgctcccgaaatagcttgggggtttccatttttagtgtgcagaaaacagggcagctctatgggagcaggaacaaggctgcctctgttagccacccaagggggcggggggaagggggcagcagggaaagtctcgaacccggccaggatcccaggactgtggcaagaccaggctgcccaagagccccccacctagtttccaagggatgaggaaagaaagtttcttcccatgggaagacagagtccacctgaggatgggcagaggccacctcttgcaaggggctactgttcaattctcctgccaccgcatgccagggatgggccttgggcacagggtcccatagttagaccaatactcactcctacatgcttacaaatatttgctcagagcctactgcgtgccaaagttctccagccctcaaggggcagtaacaaaaccactccccatatgtgaaatcaaaactgcattgatgcatgacagagccttgggagatgaaaaaatggttaaaaacaaaaacaaaaaaaaaacactggatgaggagacaacaggaagaaatgggcgggatcagaacagctcctggccaggccactgaggaggtcggccgctgacccactccagggaaagtggtcaggcttctgccagcagtctccctgtgaatcaggacctagcaccccttgcccctccacacataccatgggtgtcggaaggaggacagaaagaagagcagtgactttttctcctccatttcaggcacatggatttcacttaatctctgccacaggccactgagcagctcccagcccctccaatctagcctcccaactcccaacttctcaggactttccttgagcagaattgagtacacccctcccccaagagcctctggggcaccccagagcgggagggataaaggcctacccctccagtccacacctctcccacccgatccatgccagtgctcccccacacatgcccttcgttcctgccagcctgaactgcaggctgcttggctcctccaaccgctgcacaggctcttgccgctgcctggaatgcccactccctcgctatcccattaactcctacaccaaccatcctctccctggggagcctcccctgtcctcccaggctcctgaggaggccgctgcatgcggtggacagaatggacacacctagccaccaccctgacaggcacggccgctctgcctcaggctttccgagcctcagatttcctagttgtacaatgggaggcaggattgctctgaccagtaaacatgaaacagtgtgtgcctggcattagtgatgccaaccagggtcacctttctccctgttccaccctcctactctggacttgaagctccttgaaggcagggagtatggcttctgattcagaggccccagcaacttacacagacttcagcacagaccagatgctccctgtatggtgaacgaacccccatttcacacccaagaaaacccaacaagtaggggagatagggggcccacaatccctccaagccacttggtctctcaaagggaacacattggccccacttttattaatgaccaggccagggcagactgaaaaggctgatctagaaccagacctcacatccccaacttacacagccaggatctcctgcccattcccaatatctgaggccctgctcagactcacagccaaagcctaactctgcctgtgcccagtgctcccccacacatgccctggagtctcttctggggccaccctactctgaaccttttcagggggcgcaagactgcccaacttctgtctgtagagcaagcacctcccggacccccgtggagctgtcctcgacaacaaaaggggctcacaaaccccgccattccgcacctgcagaggggccataggacagcccacatttgccttgcctgccagttagtgggaaaccggccttcccgtttcaccctcctgctcagctcccagggttcactacagaggtgagttattcattgacagtgcagtggtgcccgctgcccgccctgttttctgtgtgttgaggaggggtggggagatccaccatttaccaggcacctgcgatgacccaaggcgctcatcgatcacccacttaatatgtctgtgtgtggagaggagggtcccccccacccgcccgggggtcaggaggctcgaggtccgcctttgtcagtcccaccgggagcagccagaaagggctgttactactgaggggaagccccgacctccccactcggctcgtccttgaccctccccaacccccagaccccgaggcgaggaccccatcactggccctgggagggcggggaaggggccggccggtcccccgcggcgacggcgaggagggggcgcggaggagcagctccacctcctcagtctcccaatcgcgttccaggcggagtcgccagagtttcccttcgcgcggagaagtgtggtcccaactctcaaaaccaaagccgcccaccactcacccaggccgcccctgcccggcgggatcggggccccggcccgttccacctcgggagccccgttcctcgccgccctggccccgagccccgcactcaccacccggccgggccccgcgggatgtgcgcgccgaggcgggcgtcggccgctccgggctcgggctccgcgcgcagcggcctctccccgggtctggtggagccgcagctgttacccggagaccgaggggcggaaaactgcgcccgctgcccgcccctcccgcgcggcgctgccaccgccgggaacaaaggagacaaagccgcgtcggccgggctcgtctccgctccttccccctcgcctgccgggctgccctccccccgcccgccgcccgggccaggccggaagcagcccggagagccgggcgcgcggccccgaaccgcccgggaccccgcattccagccccgcgggctccgcatcggccgagggctggggacccgacccctcccgcacgggggagggcgggggcgggctgcaccgcggcggtcgccatggcaacgcgggtcgcccggaggggtgaggagtgaaccccgggagccagagccgccccgccccgtcggcctcacctgctcgcctccttggaaccggaactgggaactttcctggttgccaggagccgaggcggggggtcgcgctccgcacccgcaggtgctggtggaacagcgtcccggcctcttcccgcccgtccagagccgggtagcacccgagtccctcaccagcccgacccgttcttctgccagcgcccggcctcgccccgcgcccggagctccctttcccttccttacccggctccggtggtcatcctccccaactttctttacctgaactccaaggcgccttgtttctcccctgcgcacctggccct

SEQ ID NO: 2692 - DNA, 25612 bp, Homo sapiens
  source 1..25612: mol_type = genomic DNA
tgcagtgtgttatcctttaatgaaaagctgggtcaatggagtcaccactctccccaagacccccctgcagcagatagccctcaccatggctacctatgaggcagggcagccctgtggcagccagccctgctgaggggtcagtttgtagtggcctaggagaggcgttcaactcttagacctaggatgtggcagcagcaacaaggccagaggcagctcaactgaggtcagggatggtggaggaggcagacaggaagcatggggctctcctccttcctctccgaatcccagtgtggccaaggccagtgttcaggaacagtacagtctccccaggggcctggagtctcttccagccactctctggaagcccttagtccccaactccctgcagaccggtgtcacagggtcgctggactcggggagcaggctgggtactaccccatgagccttgaggccccgggtctaggaggtggatccagcagggccgaggccagagccaccaggagactgggagtcaccttccactaactctgcttgtcagtcactacaggcacctaagaaggtggcctctcctccgagcttccagggctgcccaggccaggctgaagcaacagcaggccgtggctcctgggttcctatagatctgtgaccttgttttccacagcagctgcaatctgctggagccgatagcccagctgcatcttctgggccgtgccatcctcctccagggcagtgatgatctgaaacagagaccaatgccatcaggggagacttctttggccaacgtgtttgctgcaaaattcaacagccctcctaagacgctgtggcatgagtggggtaggaggccaagaaacccagccggtcacttcacgtactttctgggacctcagggcctcgctggcgggaggggtaataacatcaaagtcaccgcggggttccaggatgaataaggtaggaaatgaaggacctgactcagtagcgagctcctcagaagccctgctgcagccatcctggctaacccacccgccagccaacagtatttcccaagttcctgtctgcccggtgccagacaaggggcagagacccaagaatgaccagacacgtggtgggaaaacagacactgatcaaacacgaaccacgaatttggggctgccaccaagggaaccggtaggaaccggagggcagcagcacttgggaaaacagctactgcccactatgtctccacaaggggacatgcctgcatcacaccctgcctcccccaagccccgtgccatggcccacaccatgccgaggaaggctgtgggccatgagacaggttcctcatctctgagcagcaatagccatgtcactggtgccacacaaacatctaagtggactattccaccaggcatccagcaggttgactggcaggtgctcagctcttcaggcacagcccagggatcctccaaaaagcttcaccagctccagtgtaccctcacacccctggccctgtgcctggactctcctcttcgcagctcatgcagccaagccaggcctgcacttgcatgttggccgtgcccaacatgctgccaactcagcaaatgcacaccatctccaggccctggtagaccccttggcccccacaaccaccagcactgtgcctcgccgtcctgctggggagctggaatggggagcagtgggacaggtgagagcacagccaatgccaggaagcccgcctggaaaacacttctcaagccaccaaggggcccggccccccactactctgtccctggggaagaccaaagcccccaacgtgagtcacagggtcagagccccttaagtctcctgggaggccttgggtcagcctcccagtcggggtccagggcctgcccacctggtcatagtacttgttgatgtacttgtagagttcatgcagggccactcgcgccccgaggtctccggagtagttctagggaagaggccaaatgaaaggtgagagagacgaggggtgcagagagccacaggaggcagcccaggaccccagggaagggctgggggagaaggggacctgagaggtagagaatgggatgggcactacagtgggaagcagagtcccctccatggcccagggaccccaggccaggtgtgccagatggggacagaacagggtagagcaagggggcctccttggtaggaagacagcccaggtctacctgcttcagcaaggtctggggtttccactgaagccctgcctctctcacccccttgaggttctagcccagaccctctgccacccagatgactccagagccaagtggcacagatgccacttgcaggctgacagcccagcatgattctgctctggcctaactcaagtatttcctgaggtcactctcaggcccctccatggggacatctctgagcctcaacttcctcacctggacgatggaattggtgtcacctagcttgtggagttcttgtgaggatcaaataagacaatcaaagcaccccatgaagggcttcacacacaacaccccaaaattatatctgctattagtgttgtggttgtcatcatcaacatttcagaaacattgttcataaactccctggagttacattttagggcggtttcaggaatgggagaggtgaaggggacacctgtgccaccaagggaagcacagcagtgggaagacgcatgcaggcagacccaggcaggcctggggctgaatcccagctaccttgcaagagcctggctgaatcagggtacatggcagctgccaggacaagacccctgcttgctctgtgatgagatggtgggagccctggtctttcagtggcagttggaacattctgcatttatgtttcctgccccaaccagctcacagggctgctgaggttcccaagggcttccctgcaaaggggcagtgtgaagggggaaggaccgttgtggcaggaggcctatgcccaacccaagaagcagagggaggccttacccaggacagttcagccaggacagagttcatctcttggtcgctggctgggacagtctgtctgatgtctgcatagtacctgccagagagccagggcacagcagctgctgggtaaacaagcccactcccctgctcccaaccagagcccaccccccaagcctcagctgcacacgccctccaacctctacccaccgtgccctccagtacctttccaccatccgcttgtaccggggaatgtcccgtgcatacagaagtttgttgatcggggagtcctggacatagcaggaggacagcaaaagaggaaggaaggaaggatgagggtccctgttcgagtgatcaagtgtcctgggtttcccagtactgcttcagttttgaaaaggaaaagtctcacatcccaggaagcccctgagtcccggaaaaccaggacaggtggtcaccctcgcctacttccttccgcaggagcctctgctgctccctcccttccaccaatgtccagtctctgatgtcatcggaaatcatttctcagctccacatgccaccatctagatccagcaagagcccggtacgtagggcaggacgcatgctgttcactcccagggtcatcattttaaaaatgagcaaacagacccagaacattacctaagcggccacagaccacctctctccccagtggctgagctaggatttcaagcaggtctgtccagtttccaccactttaacacacctagacacagcgtctacaactgaactgggttcaagtcccagcagccatgggctctgggcagcatacttctattctcaggacctctcctcatcctagagctgctgggaaggtgagaatatctcgaggtggcactgtcccccatgagcagggatccaaggccagctcctctgtcaacctgagtcaggattcgcgccttctcgacaactccccatgggggaacccttggcattctttgttcggactactcctgagctacccaggaaccatttgctgttctgctgggaaggggaggtactggaaggatctggcaaaaatcccagccaccacatagggtctaccctggaggtggccctgcgggtcctggtgtggccctttgattcttagctcattataggcatgatgacagcatgtggaacaaaaatggctcccaaaagacagtgctacaattttggacagaactttccgtttttgtttttgttttcagacagggtctcgctctgttacccaggctgaagtgcagtgaacagagtagtcatggctcactgcagcttcaacctcccaggctcaagccatcctcccacctcagcctccctagtagctgggaccacaggcacacaccaccactcctggctaatttttgtattttttgtagagacagggttttgccatgttgcccaggctggtctcaaactcctgagctcctcaggcgatctgcccacctcagcctcccaaagtgctgggattctaggtgtgagccaccgtgccaagctaattttgatttttcccagaggtgtagggatgtatctctcaagaagtcccaagccaactgagacctgggggtctaggctaagcagagccccactcatggacctgcagagtcacacgagggccctgcccactgggtgcttgagcagacaccttggggacctcatatgtcaggggactcccggctttgactgctatgacaatagactcccaacctctgtgctcccggacggctccaaccactcagtctcctgtgcttcccagctcccctcctcacacatccctcaaactgtgacactccatgaactctcttccctacttccctactggcaggcagacacctccaccaccctaaggaattaaacctaatcagcagcccagagctgctctgggattgaacaatccatgtctctatctggaaaccccacaaacaccagactcaccttctccaagtctaagcttaccacagccagaggcccagggatcatgtgtgactcccctccttcttcctcatcccccacatccaaccttcagcttttgcctgccctgcaccctcccacccggcttgaacccagccactgcttgtcaggacagcacagcgccctcttgggactccctcactcagctcatccatgcacagcagccacaatgttccaccaaactctcaggtctggtcacataacttccctgttcccagaccttctgtggctcccactgccccaggagtgagtcctgaccaactggccctggcctactgccacgcctggccagcattctatgccccagccacaccaggctgtacttgctgcacacaacttcacctgtgaattggcacacagtgtcccctcctcttgctcatcccttaaaactgaggtggccccgggatgaagccttggcttgggaggtcagaggtctcccctaagccctccttgaagttctcagaaaagcctggaatctgagtgcacacacagcactgtccaccctcacccatcccccccgtgtccatcccagactcgctcacccggcccagcttgtggtcggccagggtgcaggcgtccatgaaggtctgtgcaatgacaaggagcaccgcatccatgttatcagatgtttgcacgtcgaacacaaactgcgggttttttattatattgatccagaacctcagaggcaagctgcgggtggggcaggcatggccgatgaatgtgctggggaggcagaagagaagaccccccacacacacctagagcccacccagctccaccccacctgttggtcttccagatgtggatggtgtcctggtcggagatgccatgctgctgggcctgctcatccagcaggtcaaagaagtacttcacagcgagcggcacggggcggctggtgctgagaatcacctggaacaggtcatccacgaacttctgcagggtgccctgtgggaaggaagaagcagagaggtgtggtcagcaaagggccctcagcagcagcccagcctcagacaccccccggcactgtgcctgcacgagccccacaccacccccaaatcccacgagtggccatgctccctctcagcccaggccccactaccttggcaggccccaccccaccttcatggacagcaggcgggtcaggtagatctcagggatggccttggcgcgctcacgctccccgccccgaaggctgcccctccgaggcctgggcggctccggctcatcacttggcttcaccaggtgccagggccggatgcccccctcatctacatcctccagcattggggtccctgtgccaagagcccacagctgtcacccctccccaggtgccacctccccaggccccctgtttcttgccagctctcccaggggtgggggcacctggttgagggatttcctgggccgaatggaaataggcacaagcctgccctgaggcccagaggaccttccccatgactccgggctgggcacagcaggggcagaggaccgtgatgggagcggtactcacgctctccagggacataatcctggttttcccggagcacatgcttggtgaggcaggggacgagggccacagttgctccatctgggacctgctgagcacagctggtgatccctccaccagtcccaccccaccatgccctcctccagctcccactcctcctaccttgtaatgctgcagtgtgttcaggcgcctccacagaccctggacctcagaagtgacatcctcgtcagaaagaatgaggtgcccggccaccccagaccgccactctgcaagggcaaggcagaactgggtgcagggctggaagatacccttcccatagtggagcccatctcctcctccacagggacaccagcccctccatcatggggcagccttactcaacctctccaaagaccaagagcagggaccccctccccagatgagaggctgtccaagaaagatgttccaaagccagcttctgcctgcctcccagcatcctccccaccctgagtgatgagttgtccctgcagagttggtccggggccagcccaggcccaacagtggctcaggtccccaggggctctccacgccctcaccaacatcaagggtgcgagggtctggccgctgggtgagaggcactcctttataaagctggtccagcatcttctcctttgcctgggagatggtgtcacagtctaggaccttcacgggcacgccctgggcctctcctgccccaggccccacagccaatagtgcattcaaggtctgtgcaggacacacaggagccatcagggttcatgtgcactcaggatgaccaagacacaggccaagggcagagacaactcatgagaaactgctgcctccaatccccacgcaccacacaatccctaattctcgtctcttcacctgcctgccttccccagggacagcagcttcctccccattgtgaccccagcacctagcgcagtgcacttgtaaaccactatggggtaaatggcagaaaaaaatgagtgagcacaagtccctcatcactcagatccccaggttcctggctgaatgggtcaggctgacggagtttcgggaagcctgcattcccaccatcgggagcaaatattcccacctatccgacaggggaggggttcagcaggcctgaatgggggtttcccacaggaacccttgtgcgtaactaaggggaaagcaaacccagagagaagtgcctgccagagtgaggctggcttggtgggcaaggccgcattcctggtaggagggccaggcagacagggtcaggccctgacacagctcaagcccatggtctaaggtagggctggcttctcccaaaccctggttgtggctaccctagttccatccctagcctggggcacatagaggccttatcatcaaagtctgccctaaactgctatcctgctaagctagtctgatgggctctctccaggagccagccagaggtcaacccagctctacatccaggtaccacatcagaagctggtgtccagaccccacacacccacacactctccaccctcgccctcaccgcactcagactgcaggccacacacttgcacaccctcaccaggggacggtactccacatcctctctgagcaggcggttgtcgttcaaggtgtatttggccttgcctgtcacactgtccactggccccttatccacttggtgcttaatccctcgaaagagcatgtacagaggctcccctacggagtcctaggagagcacaggcagttagggccccccagcaggtggcagaggtgtatgggacatgacgcacactggggaaggggacaggacatgggcttaaggggactgaggacaggctgagcaggagtctctgctctggcacaagtgtccgagctgcatggtggctgagggcttagaagtttggagggcctgaccctccctggacaggagccctgtccacctctgccccctcaccctcacgaaggtatacagacagatggacatccagttggtgagcagcttctccaccacagtctctgtcctgagatgatgggaaaggggagtgccagggtcagcaggtggggctgcgggcctctctatcctgcagaccccccagcccgaggccccaccccagctccagctgtccagggcccacccagccccaacagccacacagacctgcgcagcatcagcttggggttcttggccacatactgggcaaccaggtcactgagcagagtgcggaggatgtcagtgaaatactcaagcttcccatgcagtgccacggtgagcagagatgccacgtaggcacggtcccgagctgaaaaggtgcgctggctctccagcgtgtggatgaactgcagccaaagagaagggatgggaaaaggggtttagggggacagaggggcgggctcagaaaccatgccctggagaaggggcagggccaggggcaggccaggaagatgcagctgggggtaccttggtgaggaagagcttgctgttgagcaggttagagagctgccccagcccttgctccacagtgggccgtctgctctcaggcacacccaggtcccggtgcaagggcgactcgcggtgcccagggaagaagatcctctccgcatacaccttgtagtcgaggaaggggatgccgctgcccaggaggtcactggtgagatcggtcatctcagtcatgaggtctgttaagcagaagaggccaggttaagcacctgttaagcaccaatcccgtgtgatgggagtgggtttgggcagagttctggagggcggggcccattctcccagccacacctgtgaattccttcttgcagcggtcccgcacactgctctccagattctccagctggatctgaaccttcttatagtccctcagggcctgcttgctcttcctcctgctcagccccagggtcaggagaggatggccagatgagtcctactcgcccaggcctgcctgacaatccccaggcacaccccggcctcatccagcacagtccaatgcagccatgccagccaagctcaagcctagcccagtacgattcagcctgtcccgtcccaagcaagtcacacacacccatgccccgtctagcccagcacagtttagcctagagatcagccaaccacaaccaggccaaatccatcccacaacctatttttataaagatttgttagaacacagccactttcatgtgtttccatgtcgtccctggctgcctttgtgccacagtggcaaagctgagttgttgaacagagaccacttggcctgcaaagcgaaaatatttactctctggccatttacagagaatgtttcctgactcctggcccggtctgtcccttcccagtccagccagatcccacgacctgccccagcccagccacatctggctgcacccacctgtacatgaggacaatgatgatgacacccagagccagaagagaggtgcccacccccaagcccacctgggctgccacaggaaaagccccagggctctcgccgtcatactgcacgtgacccagggagaagcgcaagttccccatctgcacctgtgtcaggagccacctgtgagcaagggtttggcccaggtcaatgcccagcccggccagggacctgcccactgaccgtgaactcaggcaaagagtcaggtgcctctcggagggcatggtgccgtggcaggggctgctccacggggggctcgcagtacaggtggtgccgcgtcagcgtcttcaccacacaggggccatcccctatcatagccaccacctcctccttggacattgcaaggtccaggttctccccctggaacagagggtcaccgatcagtcactcaggacccttccctcagatcctgtcctccccaaatgtgggaaggaccctgagacccagccgcagcagcaaagctgacagcctctcagcacccttcccgagtgcaggccagtcacacagtgtcctccaagctgctcctcatcaccctttgttgccctttcctatctttcttctccagaacgaaaaatctggagaacataaagctgcctcccaaatcctgcccagctacctaacaaagctggagcccccaatctgtgtctgatgactcaccaggggggtgatgatgctgtatcaacctgtggtctgcccgcatgcccatctgctgcccactgtgtatgtccaagacacatgcctagcgcatgtccatgtgagccaggctgccaacgggggtcagcccgatggcctatgtggaccacaccacccagctactgcacaggccgaacatacaaatgcagtcattccagagcctgccatggagtgcatcaggacccgggccaccagccaagcagtccagctcgtgccagatgctaggctaggcaccccccaccagccccctctgcccccaccacagcaaggatgaggagccatgtccatccaccggcccttgctctactgtctcggcctctccgccacacacagcagtgctgtccagccaagggaagggtctcggggccctgccaggtccaagtaggagctgtacctccacggagaacacactcccaggcttgtgccggaatggcatggtggggtcctcagggttgagtggctgcagggtggggtcggcctcataggagaaaggtgtggggttcagtgttgcaaagtcaaagaccaggttgtcaaggataaattccacccggacccaggggtcctcaggcaggcctgggagggcaggtgtgcggcacgtgatgagctgggaggagttgacatggcacggctcctcaaactggaaggaagacaggcaggttgacgaggggccaagcaaagatgggaagagcctcctctggcacctgctctggctgtccccagggtgtggtatggggcaaggggagagtgtgggggtacccaagggtgtcctacttgctggctactgcaggagggtccaagggaacatgccgtctccgggaccacgcgacgcctccgtccaagcccctggctgggctgcagcattctcgagaccacggtcacccggattcttggcgtctgtaccacgtccagattctggccacggacgcatatctcacgtcctccactgaaacagaccgtgagcttacgtaacgtaagatggcttatgttacctggacctaaagcacagcccagtcccggctaggtcagctcagccccagccccaaaccacacgaccccttgcccctactagcagcatgggattctcagtgcctcaacataaagccctacaaacccccacatagtggagctgcaaagacctccctgccacctgccatgcagccacacccctggcccaacacctgaggaagctcttggtggggccagcagaggtgatgttggggtccaaggtatacttgaactgtccgcgttgaagcctccgctccgtggccccaaaccacacagccacagggagcgtggcaggcgtggggcgtgggctggtctcacaccgcagttgttctgactgctgctccggcagcctgggaggggaggtgggaatgaatgcaggggcgcaggcagggaaaacttggaccactcaggccccaactggcttccctcaagcgctgactgcagtctccaccaggtgtccctggaggtgcactcccaccacagctggctagggagggtctggccactctctgaaggagcagactggccctcttcccctttctgctctccccaggatctcagacccctccatctttcccctggagcagatggatttttgcaggatgaggaagtggccctcacaagtgacaaggctggtctccaaccaccactcggatgtcctccagccgcccagtcaggagcttggagccattcagggtgagacgggtgcccccagctctggggccgcgggccgggaagatggaatggaccttcggatcctgtgggacagacagggagagagatgagcatcagaccagacacatggaggcagggacagcctgagagacaggctggcccaggactgggagccccaccaaggaataaccagatgggttgagaggagccaccagagaggttggcccgctggcagctgggggtggctcagcagtcaggtacctggtaggcaaagtcgtgttctgagacaccacgtcctcttcccggcacctccaccgctgtggcgccggccacctcctccccactggccccggtgatgcacacgaggctgtaggcacagggcaggctagggggtgccaggctgcatcaagggcccctcaagcttacctggcagcccctctccctgccctactgtcaggtggtcttccccttcccatgctccataagattgacagagaccctctctcactttggagggaattctttatgacacatcagaaggccttggtatctgagaattaatatttgtggcttcaatcatttaagttcaaccccaggggcccccaataaggaagaatttatctgtggcataaatttacaaaggggccctgtcagcctggttgtggggcgagctgctgagcaagtgagtgggcacagctagccgcccatgtcctccgccacgtcacatgcacagtacccactcaaagcatggtagaaacttgatttattcaggaaaaagagtccctgaaagcctctagtcagacagggaaatacaggtgaagggaaagtgaaccatctaagaaaatgctggttcttagccagaaaatagaagcttgggcaaattaaacttccagagtgttaagcctgcagtggctcaactcagtgacattgtcacagttgttgcaaacactaggaagacacaagtgacgtgtgagccacccaggggaggctccagacagaatatatgctaattgcttcataaatcacagcagtcttatggtctggaacactaacagtctagatagtcaccgtaagttctcggtcataacacattcaggggacactccgtgctccaggagagtggttccttgtttcaaatacagatttgggggccccaccgtgggcctcctgaatccagatgtttgtgttggtttgggacaggatctgcaggttaccctgatattcagccacgtttgggccctgctgcttatggacatctccttaggaatgtcctgcgtgtgtacctttggggcctgcaaccgctggccaggttaccataacccaggagccccaggaaggcagcaggggtccctagagacgacagtggagcctggccctcggccagtgtgcctttctgaggtgtgccttccaagtctaccttcctgaagagcctggcagcccaggacaatgcctggggaagagtgagctggtgagaaggccagcccctgagcttatctgtctgatctgagggtcctgctgccacagctattaatatatccacagtccctcagaagaccaggtgagcagagcaggaagcagagccacgagtcagttctgggcagtgacgggcccaggaaggattccccagcagcccaggccaggaacctacaggtgtggtgggtgctcagggtcttcagtggcaacgctggcactcgggcattgtggccaggatcaaggaacagggagagaggggggcagatgagcggtgggtgggaggccccaagcagcaacgccaaccgcggaggccccaggctgcgccgtgctcctgctgggtgcagccagcttacctgctggagacctcgtactcctgggcatccacagcacagggcactccagccaccgtgaccatgcccagcacatcctgcacatgctggcccaggttggagcccctgatggtgacacgggtgcctccgtctacaggcccagtcagtggctccacctgttccaggacaaggactgctcacctctactcaactggaaaggcagccccaacctcccacctttgggcccccacaccctccctctaagggcagcactgaggaagggatggccagcctttcaacaaaccgagtggatgaggggcgctgggcactgggtggccacagcctcagcctcaccacaggcctcccgggtcacacaacgtggacgctccccctcacaccacacacagccatactggggcatggcagtttggcagcggctgcagtctccatgtcccacggaacagtcatacagtaccactgggggtggcagagacacacgtgagaggcaggcctgggagagccctgctaccaccgccagcccagcagcccgcaggtggctcaccatgcagcccctcagcactgtccacacgcagacggccggcccgacgcagaaacagccccacacggagctccggctgcagagcctcatagctgagctggagaaatgggagtgggttcagagtcaagcactgggggaagtgtcaggcctggggaggggttagtcagagaaaggactaaaacgaccagttaggagcatagggtcagagggaccccatggggccacaagttggagggcagagccagaaatggagtatggggaccccatggggtctcaagttagagttcagagctgggatgcaaggactccacggggcacatggtcagaggtcagaaatgggtgtggagactccctcagggcgacacggtcagagcgtggctctggaaagtgtggtgcagccagctacagttggcagccagcctgtggccagtgcagtgcacccgtgcccacccaggcgctcatggtgtgcacctggtgctgctggcaggtgacatggcactgggtatctggaggtggctcacactcgacccgggcctcaaccaccacctcgaggccctccagctccatcacacactcattgtctcctgggccatcctgagggcagagaacacagctgttgggcagcttcaggagctgggcccagggagtcctgcaggtcacccaacagatcccccagcacagcttctgggttggagttgagccctcggactctgccctcctcctgctccccagggcttgtgcagagtttctcaacagctaaggaggctgcaaggacagcggcaggcaggacacactgacctggaaaaggtgcaggttcctgcctagcagccggatttcccgctccacatggaccggcatcaacgtggagccctgaacgctctccacacaggggcaggagcttgcccccaaggtcgcctcttcctgcaggcaccaagggcaaggcagtctatggagcccaccctgcccagctcagccctctgccttgccagattccagaggcaaggccggtgtggggctgcagactccaccctgcccctcacctcctcccagtgcagaatcacaaggcaagctaggggtagcatcttccccacatcccctcccctgaggcctccttcctgggctgggcctcaccagctcccagagcccgggggtgtcatactggtagtcgaggctggacgggaggatgaggggggcgggagggccctcaagctctgctgagtctccatcacctgagaggagggtggaagtggagaaggcgggtgcgtcaccccccgtccactcgtccgcctcgggcagctcgccgccttctctcgtgagccagtccagggcgggcttcacggagcccatggcccctgggaaagtggtggcaggaacagtggcagggggcaggtccaggggcactgtgggatgaagagcctcggggccagggtctgcagggggcactgctgctacctctgacggtgacagcggggaggccaagaggtcctcaggtgtggctgagggtctgaagtcagtgggggcagggacagcggttccaggtccattttgggggctgggaggggagggctcctcatggagaggcgaccctgtggagccaggggaagatatggagccagaacctgcccatggcccccaggggctgagcagggaaggactagccccaggtgagatgtccgaagctgtggctgtggagggagccccaggctccacgggaagggtgtcaggagcaggggtggccagggctttgggggctgtgggtggggaggggctgggtccacctcttgcaggagggtctggggagacaagcgggctctgaagggggaggcagaggaagacaggaagggccactcagcaggcaggcgcgggacaggaggcaggcaggcacagtgtatgttaagaggaaaggagaccaaggaaaagagaaataaaaacagcccattaattctccactggagaaaactgcgggggaaggctccaggggtgtctgtgccgaggtggggcatgaaggccagacatcccctgcctctcagctacaaatgccctctcccaaaacaggcgggatgtatcggcggctgttctccagggagtccgtcacatacagcggctctggtgctcaggacagagcctcacataggcagacagaccccgggccatgagaaaaactctcacactgggacccccaacccccccggtatggcccagcccaaagtcacactcacctgatggcttgcaaccatgggcccagcatcacacgaggccttgtgggtgcacaggtgctgccagacacaccagttacacccccagcggctgctcacacaggcctggcacctgcacagagcacagccatggggcaagggtcgccacagggaagcccaggcctggggacagggcgaggaactcactgcgcagatgggcggagttcagtgaccgccacacagtcatagaaagagagggaagttttggcgatcacaacagcgccaaatctgagctccacgctcacggatacgtagtctgcagagggggagagagggccagggttaagcagcaaggaggtgcactcagacccagagccgatatcctgagcccttgaatggggaagaggacccaggatgagggaatacagtccaagggcacagaatggaggcttcaggtggttggggagtgggaggacccagagaaaggcatccattcatggctctttgcctggattcacactttaaccccaccgcatcccctgaagcaggggctggcccccaccaggctggcccattctctcacccaccggctcctctcggcagcactggggcctcactagggtctggggaggggcacatcacaccagaaccagtcagcagggcaggactctgatgttccccaaagtggcaggaatatgactcccctggccacaggggtggcaggtctggcactgataggaaaacctgccaagagagccagggacacactgttggggctagtgggcagcagaccagggctcacatttatgggacacccaatgtgggcaggcaccagcaatcaacagccctcaggcctccccaaacaccctctggcctgagttagaaatagatggggaaactgagctcctaaaagaagtgacttgtgtgaggccatgtggtatctggcatgtccgacatcaggatccaagatctctacccagaccttgatgcccagagccctccccaccagggccctgcctatctgatcattcacctccctcgtctcctctcggctgatgttggcaggactcatggctgccacttgcagacagcccagctcaggctggaagctccatagccactgctctgggccctggcccctcgagcactcagaacggcgactgcacctgggcgagatgaccagtgtctatctgtgaccctcatgggccactgggagttcatagggtagggactcctacaatctggaggacctgggcagggccctagagtgggcatgatagaggctcctgtgtctgccctggcagggcactgatgcccagtgcagaggatgggggtgaggaattggggtgtctggggatcaggggttgagagtcatggtctaagggtcaggaattctggacaggacaattatgcaggagcattgtgggcttgaggctggggctgggatggggtcagaaatctgacctgccaaggagcacgcaccacccacagtatgggtccctgtgagcaaggcaagatgcacagtccaggtgctgagcacaggaagccacaggaaccttcagaagctgtgacagcaaagaggacctgaggccagcaatccaaacaccagtggctcacccacaagtgggtccctggccccacccagaggcccctcccagcagtcatgccctggcttgtgcctggcactcactgtgctctgggtcatgacatacaggtgctcaaaggtcccatcaaaggtgaggtctctgctcactgcagacccctgctggatgctctgtgtggagtatgggtggccatcgctccctgggcccaagtagacctgggatcagagaccacagggtctgggacccaagtccatggccagaggcccaaagccctcccctcctccacccaatcgaagtaatttacaaatagaatttcctcctaggcagtcacaggtcataccaactggcctagcggggatggaggaaagtcacaggtaaacaccacccagtcctggggagaggagctcaggtcatctctcctggcccaggggtcacagggatagcttaaaccaggctgggtccctagcaatctgttccctccagactctggggcaggggccagtacttcctgtgggctcaccctgtgcagctgcccttgactatcacccaggaaagcgatggtgtgtccatcttccatggtgactgccacagctgttagctgaatccctggccactccagaattggtgtggcttccagcgggacccggctggccatggggctgggcgtgtggtctgagccacagggataagcatccagggtgtcctataggcagcaagaagcatcaggaaggccctccctggataacctcctcggccgcatcgtccctggacaacctcattccctcccccagccgctctggtagctctccctgtacaactgtgttttctctgctggccctcctgggacaacctcatccccgcccccagtctctcttcccttttttatccatcctgaggctacagctcatcaatcccgacctcaccttcctctcctgctcaagaaccaaaggtctcattccattctaggtccctgtccctacccaagaacccccaaacaccctcccaatccaccgacacaagtgccacccctccagcatcctggtccaagcccatccagacactgctgccacccgcatgccagatttgtggtaaggtacccttccactgcccaggcaacataggaagcacttaatatttgctgatctgatcatcctcgtgctaccaccagctgccctcggactctctgggcagctccttggctgcaaatgcttggccagtggcctcagagaggcggaaaagtggggcaatactggaactcaccactggcagctgtgcacagtcagaattgacatcatactcgatgtaggccacctcggtcccatcctcagcacgaccctcccgggtgtagcaggcatctcgcgtgcgattagcaagccggtccacctcatccagggggaaggcacagagggcagaggctccagatgccccagcagccgccgatgggggccggcccacagtggggggtgcagccgaggagaaagctgcaaagagcacctccccatgcgccacctccctggacgtggccacagctgcagcctggatcagcccgtagcggccaccttcgcaggccagaggcaactccacataggagtagtagtgctggtcccggagacacactcgagatacataggcacgaaaagctctagactgagcctgcaggtcccgccgcaggaacaggaagtaggcgctggccccacgtgcaaaggcactcacgaagtggtggctgtactcggagaggcggcccactgccagcttggctgtctcctcataggagaaggcagcttgggggtcgggcggccacagggcccgggttgtgatgggtggaatgccaccccccacacccctgctggtgtatcctcgccccacaaacaggaggggctcccctgccaagccctgggctaccagccccaccgtgctgaccgcaggatcattggcagccacatattgtgtgtccccaggccgctctggccgcagcagcagctgctcgagctgccccaggcgccgctgttcacagaccccctggtgcacgctcccgcataccaccagggcccctgggctcaccaggagcagctgattcgggttgttggtaggctgggcctgggggcactcatcaggcatcacaggtggcaggcagtccctgctgtctagcacagggccggtggacactgtggcctccagctgcagcccagggctcagctggaacaggaagttggtagcccccaggtagagggtgcctgaggtggggtcccttgccaggtgctgcagatacgtgccattgggagtgaatgcagttggtggaaggggctggagggtgaggacccacccggcccagagagcctggagaagagctgggcccagagcaggcatggtcacctggcaggaagagaggtcgagagagtggggctcacgtggccgccagagcaccctggggccactggtaagggataggactgtggcattgccaagatgctcctcctaacctagggggtgagcagaggaggaccaggcttcttagataggcactatgtccaggatgaccccaggaccacacactagaacaaggtcagaaataggagacacttcctagacaacactgcccattctctgcaggcacgattctctcaggagacctgcaccccactcaccatccccccagatcagagggtgaggggctgagaggccatgcccaggaagcagggtctggatggggcagaagagcaggtgatgggaaggaggggcccagaccccaagaaaggagaggctctacatggatgagggtttcccgggcagaagaaggaaggagagggaggtctcctgaaccagcagaatgttagaatcaagacaagagttgggtgcagggcctttcaggccaggaatccagaagggtaataaccacagaaccaacaggcctgagagatgggaagaggttccagctcggaggggtggggcctgaagggctgccccccacctccgagagccctcagaataggtaggagtcatgctgctcctagatatctagtgtgaggtcaggctcacctggcagggccggctggatcaggagacaacagcatgacccgtgtgggagtcacctagcaggcgggaaagccgagtgtgaagccggggcctgggctgcaggcacgtggaagccctgggctccccaccggggaggcagcacagaagcaccccctccccaccgcccagcctgctggtggagctgggcccagcctggcccctggccaccaaacacattccacagaggacgcctcctcagagcccacatgaggagggggagggcagcagagccaggcacccgaggggcctgggaaaggtcagctaggaaggagccccgtggctggcagggcccagccaggcccccagcatggccttctccctgtgaggtccctctctctgctcaaactccaccctgtaaaggcacccaggtacacaccctctacacagccaggggctgtcccagcccaaagggccaccagcgcttcagcagacaggcagtcgcacagcaagatacatacacaccacccaccctgtatgtatatgcctacaacacacacacacacacacacacacacacacacagagagagagatgcagatgccatctatacacacagcacagtgacacacacagacacagccacccatgttcaaacaccacatgaagacacatccatatagagacaactcccccacacagaaacacactgcaggcacatatgtcacactcacccgagacattcagaccaccactcacatttagacatacacacgcacactcaggcacactcccctcgtttgagagtacttagttggagccctacgtactagagagctgtagaagctaggccatctcttgctatttcctctcctgcagttcagaatagtgccagggcccaagatgtggggtaagtggagtgtgtcctggaggaaggtgccatgcctggctgttcccaggcccatccccaggacctccccagactttgggtgcctgctttccacacagaccccttcttgggccccagctgaggctcctgagtccctgaaccaagaaactatggcaataccaccttccccagtggtctctagccaggagcaccaaggttggtgaagtgctgggacagacaatgcatctcagactgggagacacttcccctacttgcctgtgcccaggccacgttgcccagcccctcccatcacccagctgccaagctgtctgtgcaaaatatcccaagcgcttgcttctcccaggtcggctcatcctagcagatgaggcctgagcagggtactcctgaggctgccctgaagtgaacagggccgggcacaaggctcaggggagggtccagcagcctggtggaagccgggacactgtggccacagcccggtgggagcaggggggccgtggtcacagcctggctgggcactgctcccgaaatagcttgggggtttccatttttagtgtgcagaaaacagggcagctctatgggagcaggaacaaggctgcctctgttagccacccaagggggcggggggaagggggcagcagggaaagtctcgaacccggccaggatcccaggactgtggcaagaccaggctgcccaagagccccccacctagtttccaagggatgaggaaagaaagtttcttcccatgggaagacagagtccacctgaggatgggcagaggccacctcttgcaaggggctactgttcaattctcctgccaccgcatgccagggatgggccttgggcacagggtcccatagttagaccaatactcactcctacatgcttacaaatatttgctcagagcctactgcgtgccaaagttctccagccctcaaggggcagtaacaaaaccactccccatatgtgaaatcaaaactgcattgatgcatgacagagccttgggagatgaaaaaatggttaaaaacaaaaacaaaaaaaaaacactggatgaggagacaacaggaagaaatgggcgggatcagaacagctcctggccaggccactgaggaggtcggccgctgacccactccagggaaagtggtcaggcttctgccagcagtctccctgtgaatcaggacctagcaccccttgcccctccacacataccatgggtgtcggaaggaggacagaaagaagagcagtgactttttctcctccatttcaggcacatggatttcacttaatctctgccacaggccactgagcagctcccagcccctccaatctagcctcccaactcccaacttctcaggactttccttgagcagaattgagtacacccctcccccaagagcctctggggcaccccagagcgggagggataaaggcctacccctccagtccacacctctcccacccgatccatgccagtgctcccccacacatgcccttcgttcctgccagcctgaactgcaggctgcttggctcctccaaccgctgcacaggctcttgccgctgcctggaatgcccactccctcgctatcccattaactcctacaccaaccatcctctccctggggagcctcccctgtcctcccaggctcctgaggaggccgctgcatgcggtggacagaatggacacacctagccaccaccctgacaggcacggccgctctgcctcaggctttccgagcctcagatttcctagttgtacaatgggaggcaggattgctctgaccagtaaacatgaaacagtgtgtgcctggcattagtgatgccaaccagggtcacctttctccctgttccaccctcctactctggacttgaagctccttgaaggcagggagtatggcttctgattcagaggccccagcaacttacacagacttcagcacagaccagatgctccctgtatggtgaacgaacccccatttcacacccaagaaaacccaacaagtaggggagatagggggcccacaatccctccaagccacttggtctctcaaagggaacacattggccccacttttattaatgaccaggccagggcagactgaaaaggctgatctagaaccagacctcacatccccaacttacacagccaggatctcctgcccattcccaatatctgaggccctgctcagactcacagccaaagcctaactctgcctgtgcccagtgctcccccacacatgccctggagtctcttctggggccaccctactctgaaccttttcagggggcgcaagactgcccaacttctgtctgtagagcaagcacctcccggacccccgtggagctgtcctcgacaacaaaaggggctcacaaaccccgccattccgcacctgcagaggggccataggacagcccacatttgccttgcctgccagttagtgggaaaccggccttcccgtttcaccctcctgctcagctcccagggttcactacagaggtgagttattcattgacagtgcagtggtgcccgctgcccgccctgttttctgtgtgttgaggaggggtggggagatccaccatttaccaggcacctgcgatgacccaaggcgctcatcgatcacccacttaatatgtctgtgtgtggagaggagggtcccccccacccgcccgggggtcaggaggctcgaggtccgcctttgtcagtcccaccgggagcagccagaaagggctgttactactgaggggaagccccgacctccccactcggctcgtccttgaccctccccaacccccagaccccgaggcgaggaccccatcactggccctgggagggcggggaaggggccggccggtcccccgcggcgacggcgaggagggggcgcggaggagcagctccacctcctcagtctcccaatcgcgttccaggcggagtcgccagagtttcccttcgcgcggagaagtgtggtcccaactctcaaaaccaaagccgcccaccactcacccaggccgcccctgcccggcgggatcggggccccggcccgttccacctcgggagccccgttcctcgccgccctggccccgagccccgcactcaccacccggccgggccccgcgggatgtgcgcgccgaggcgggcgtcggccgctccgggctcgggctccgcgcgcagcggcctctccccgggtctggtggagccgcagctgttacccggagaccgaggggcggaaaactgcgcccgctgcccgcccctcccgcgcggcgctgccaccgccgggaacaaaggagacaaagccgcgtcggccgggc

SEQ ID NO: 2693 - DNA, 51525 bp, Homo sapiens
  source 1..51525: mol_type = genomic DNA
gaacccggaagttccgggccgagttcctcgtgccaacgtgtcttgtaaggtgcggctagaaactggggacatggcagcgcctggcccagcgctctgcctcttcgacgtggatgggaccctcaccgccccgcggcaggtaagtggcggccggcgggctgctggcagccgacgcggagcccgtgctgttcccagttggggctatcgaccacccagggtaggcgccaaggggtggctaaggaccgcctacgtcctcacggcgctgaaccctattctgggtgcactggaggaatgagagggaggccctaaccagctcttgaagagctctggtgcttggaaagatgagacggggctgaagaactcttaagagcaggaaacttgtgctaggttggaaaatgtaatctggactcaccgctagtgctcgggactgatagaccaggatttcaacccaagatcaggcccccttatcagctatgtgtcggccccaatcctgtaaccaatgggctgtgccgtgagtcatgatattaaaaacaggtttccaggtcaaaccgacctagtggagtctcatcttcacctcttgacatctgtgtgaccttcagcgagtcattaacctctctgagcctcaacatctacagctttaaatggggatgttacctgttccatatggtgtctgtgaggatcaaatgagattgtgtaagttcttgaaagtatgttggacacaacacactaggcctcagtaaatagtagccacctccaccacacccatctccagcccctgcaatggactagggagatggaggagccctaggttattacaggctgcccgctgagagcctctttgggcccttggaaacttgctttccactttcagattttgctgctacaggcacagataagtttcagttacgatcagccttgaggtgaggctctcctggccccttttcagaaattggccactgaacactggccatttcaacttgagactggaccccaatggtctcactatcctcagcttctaccctcacccctcatagttttcgcttggtggtaacaatggtgtgctccagaagtccaggtcaaatgcgtgtgaccttagacgtatcattttgcccttctcagccacaggtttgatttacctagtgatgacgctcaactcccaagttcttcaaaggctttttctgattctgaaattcagtgatcacacacttgggtttgttaaaagcccatagtggtctaaaactccggtccccaattcattttttgtaaagggccatatagcaaatacttctctgtctttgctgactatgtggtctatagtaaccactcaactttagtgcaaaaccagccataaaccctatataaataagagtggctgtgtaccaataaaattttatttatttattacaaaaacaaacagctgcccaatgtggtctgtgggccatagtggtctagggtttacattgccaccctttttcatatcactgaaccctctcaaccttcctccatctttcttcccaggtaggatagttgttattaccgttttaaacataaggaaacacactcagtgaagaactaacctcctcagtttcacacagccaacctggtacaagtctctgggcctcaggatattggttcctgtcaagtttgccatttcctatctgtgctaaggtggaagctgttctagtcactgggtatgccattcaggaaagtgcttctgattttctgattttcacagttctgactctttttttttttttaagacagagtctcactctgtcaccagactggagtgtagtggcccaatctcagttcactgcaacctccacctcccaggttcaagcaattctcctgcctcaggcaaccaagtagctggtgctacaggcaggcaccaccacgcctggctaatttttgtatttttagtagagatggggtttcactgtgttggccaggatggtctctatctctggacctcgtgatccacccgcctcggcctcccaaagtgctgggattacaggcgtgagccaccgtgttctgacttttaaaggccactcctccaattctagattctgtctaataggtccagattccactgtgagagtagaaaagattgcactctattacaaacccttctgtacaattttaatcacattcatgtattactctaaaaaagttttttaaagaaaaatcattgaactccaagtgtttatatactgaggttgaattaaatggttttttgtattttctaaatttctagtaaaaagatattcagccgggcacggtagttcatgcctataatcccagcacttggggaggctgaggcgggtggatcacttgaggtcaggagttcgagaccagccttgccaacatggtgaaacccagtctctactaaaaatacaaaaagattagccgagcatgatggcgggcgcctgtaatcctggctacctgggaggctgagacaggagaatcgcttgaacccaggaagtggaggttgcaatgagccgagaccacaccattgcactccagcctgggtgacagagcacgacttcgtgtcaaaaaaaaaaaaaaaaagacattcagtgtaaatgtacaactgagattgctcaaagtgctgagttataagacttgtaaaaatacattgtgatgtgtcttaatgtagggctattttttcatcttagtttataacttttttaaaattatcacacagtttggaatttaccataagattataccactaagaccactctttctagataggagctttgcttttagaagagactaaaaaatctagttatcttactcttttacatttttgttttgttttgggtgattgcaataaaatcaattctaagcttctccttttttttttttttttgttttgttttgttttgttttgagacgaagtctcgctctgtgacccaggctggagtgcagtggcacgatcttggctcactgcaacctctgactcccgggttcaagtgattctcctgcctcagcctcccgagtagctgggactacaggcgcccaccagcgcgcccgcctaatttttgtatttttaatagagacagggtttcgccacgttggccaggctgatctcgaactctgacctcaggtgatccacccgcctcggcctcctaaagtgccgggattacaggcatgagcctccatgtctggccctaagcttcctctttaatttcattatgttgttttattttaaaatcaacaacttaaatccataaatggagtatagtgtagcatttaaaaggaatgatgagctagatctgtgttggcatgaaaagatcaccacagcatagtgctgaaaaaccaaagtccctgcacaggacatgattccatttatgtttcaaaaataagacctatttgtatatgtgcccatagatgggtatataaatgcatagaaaaatagctgggacagtgcacaacagctactaacatattacctgtgtttaaaatttggtaaaaataacacttaagtttattctggtaaagatgcccccccagttacaactaaaatatttgaactatgtacagagctggtaacttaattggcatgtatgaaaataaggcttatagacctggcttatacctgtaatctcagcactttgggaggccaaggctggtggatctcctgaacccaggagttccagactggcctgggcaacatggcaaaacttagtctctacaaaatataaaaaaattagccaggtgtgctggcacataactatggtcccagctactcaggaggcagagataggaggatcaccggagtccagggaggtcgaggctgcgatgagctatgaccatgccactgcactccagcttgggtgacaagtgagaccctatctcaaaaaaaaattttttctttaatttttaaataagaaaataagacttatgtacttgtgttacccttagagttttggtctcctgattattgtgtggcttatgactgttgtattttctttcttgaaatttagaaaattaccaaagaaatggatgacttcctacaaaaattgaggcagaagatcaaaatcggagtggtaggcggatcggactttgagaaagtgcaggagcaactgggaaatgatggtaaatgatgggttgctaattacatctggtaaaagattaacttcttatgaggatattgttgccaagtatcataggctgccctaaaaccttgtccccatatggcgggctttctgcttccttttttgggaaacattttcttggcctttgcttttcctctgcttttaatccagtacatttctggagttactgatggagaactgggtactcagatgtgtgagtagattcacctagaaaggtcagtggctgtatctgcacatgataatctctctgcctggaatacttcttgcttgtacccgttgacagcccttctagccccagtcagaccggtcttcatattgtccctctgacagcccccctcacctccccatcactgaaacagaatctccagcacaggaccccgaaaaaccagagaggcttattgaccccttcactggagagtctgacttgataggtctgtggagcctgggaatcctatttcagtgagtacctctgagagattctagtgtacaaccttgctaatgtagcattctgtaattattgtaaactatccgattatatgtttttgaagagcaggagtatgggttattcatctccatagccacagggcctcctggcctgtaagaaattgtaagtggatgccaggcgcggtggctcacgcttataatcccagcacttggggaggccgaggcggatggatcacctgaggtcaggagtttgagaccagcctggccgacatgatcaaaccccatttctactaaaactacaaaaaatgagctgggcgtgatgacgggcacctgtaatcccagctactcaggaggccgaggcaggagaattgcttgaacccaggaggcagaggttgcaatgagccgagatcacaccattgcactccagcctgggcaataagaacgaaactccgtcttggaaaaaaaaaaaaattataagtggagaggtggatgaattgattgttcttttaacccctgttgtccccagagtcctcacatcttggaaccagctcctctagagcaagatttctcaccttcgcactattgatattttggaccagttagttctccattatgaaggctgtcctgtgcattgtagggtctttagcaacatcccaggcctctacccactagatgcccacagcatacacacacgcacacatacggctatgactaccagaaatgtctccagacattgccaaatgacctctgtgtaaaattacccccgtttgagaactactgttctcaaagatgtaatatgttacagtccaaatctgtatggactgtatttataggatcaccattactagaagagtaatctctgcaatctctttaaaactctctcttccacttccacttcattttcctggtagatctcctacttagaaatgctataaaccgcatactggggatcacgaagccctgaaaatcctgttacctgctcatgatcgccctttctgcatctagttgtgtatttaaccacttgctcagggaagttttgtgtagtgtagcatagtgtctgcacctgtcagagacatgcaacaatagaatcaaaacattcacaggccaaaagacagttgaaggcccacctgtatcagaatcacctgggaagcttattaaaatatgagtgtggggtccccacccaacacataggggatctgcattttaacaggtacctgaagtttgagaatcccttcattaaggttgacaacatggatagtttccaaaccaaactgattataagaatcactgaagagctttttttaaaatttattttatttatttatttatttttatttttttgagacagtcttattctctggtgcagtggcacaatcttggctcactgtaacctctgcgtcctgggttcaagtgattcgtgtgcctcagcctccgaagtagctgggactacaggcgcccaccagcacgcccggctaatttttgtatttttagtagagacggggttttaccatgttggccaggctggtcttgaacttgcgacctcaggtgatctggccaccttggcctcccaaagtgctgggattacaggcatgagtcaccgtgcctggccaccaaaggtcttttagtgctttgttttttgttttttgggttttttttgttttttttttttttttttttgacgttagacagagtcttgcaccgttgccgaggctggagtgcagtggcacaatcttggctcactgaaccctctgcctcctgggttcaagcaattctcctgcctcagcctccggagtagctggggttacaggcgcacaccaccatgcctggctaattttttgtatttttagtagagacgggggtttcactatgttggccaggctggtctggaactcctgacctagtaaaaccccgccagcctcagcctcccaaagtgctgggattacaggtgtgagccacaccgcacccgacccaaagagcttttttaaaaatatatttagcctgtccctcagcaattctgattcaggaagcgagagagcaaagcttggaaatctgcattttcacactgccctggttgctgctggtgaaccatcagcatcatggacgagtatcttcctctacagacagtcaggctgaagtcagggacataagataacctgtcaccaagtccctaatctcctgcccagtcatcatcgtttaaatgtgtaaccaaaaagagccattaaaaaaacaaggaacttttttccatactcttctcttagtctgtaagatgagatagtctttcacagtccttgctggagtttagcggttttattggtggtcattgttaatcaaggagtaaaaacacaggttttgattctttgcattctaagtgtttttttggttttgattgtagtggttgaaaaatacgattatgtgtttccagaaaatggcttggtagcatacaaagatgggaaactcttgtgtagacaggtaggttcttgagtatctgaattactatatactattaaaagtgttttctaaaagggcatttcacaatgaatgcctctaggaagatgaggaacgggtagaaatgaatctttactctgtattttttgttttgcattttgaaccatgtgactattacatattctacattgataactaaatttttatactttttaaatctaatatttctctcttttcttattttgtttttgagacggagtcttgctctgtcacccaggctggagctggagtgcagcggcacgatctcagctcactacaacctccgcctacctccgcctccctggttcaaacaattcttacgcctcagcctcccccatagctgggattacaggcacacgccaccacacccagctaatttttgtatttttggtagagacagggtttcaccatgttggccaggctgatctctaacccctgacctcaagtgatccgcccacctcagcctcccagagtgctgggattacaggcatgagccaccacacccagccttttcttcttgttttaaaaagatggggtcttgctgtgttaaccaggctggagtgcagtggtgcaatcccagtggcctagaactcctgggcacaggtgatcctctgcctcagcctcccacgtagcagggactacaggcacatgccaccaagcctggctttaaatctattaataacatttctatgatgataaaactagagcagactgcttcactataagcatttttttttttcttttttcttttttcgtggtggaatctcactcttgcccaggctggagtgcagtggctcaatcctggctcactgtaacctctgcctcctgggttcaaatgattcttgtgcctcagcctccctaggtgggattacaggcatccaccagcatgcccggctcatttttgtatttttagtagaggcagggtttcaccatgtttgccaggctggtctcgagctcatgacttgaagtcatccacctgcctcagcttcccaaaatgctgggattacaggtgtgagctgccacgcctgggcactataagcatttttaagaggtactgtgtagctcttagtagtagtaagatcattctattcagacataagagaatgccgaagtggaacaaatatattgtctgtcaatatctggagatattttaattgaataaaagtggcagcagtaagctctttggaccttacaggaagcatttgaacaataatgagtacaaaaatcttgggtgatgaagcagaaaatgcttttgactaaagcttttctggcttgcctaatgcttttgaccagagaaataagagaaggaattaaacagacagtggggcatgtcaccatcactgctacatcagcctactgattttcagcaatcgtggctgaagaccctgggtttgctatgaagctgttttgaaaatgctcctgctaaatcaagtaactcaagtattttcttcatctagaatattcaaagtcatctgggtgaggccctaatccaagatttaatcaactactgtctgagctacattgcgaaaattaaactcccgaagaagaggtgggtttgcttttaacaaagaggcgtcacaggaacatagcgtagtgtcacatggtgggctaatgtgggcattctccaaataggattataaaaatcacctaaagagttttaaaaacaaagtctgatatttagcccgccccttggcaattctggttcagaaagcctgagagccgagcttggaaatccacattttctctggctgccctggtgctgctggttcacagcagggttcagtagccaccatgggccagcgaatttaaatccgaatcccagcacttagtaaggaataattggaaacagtccacaaagccaacagtacaagaatgattacgtaaatgatggcttatccacatgatggaaatttatacaaccattgaagaccatatgctttcaaaggctgtcagtgagaggaaacagcagtgaagcagcatgtacaaaaagcaacagaaaccctagatcgggaagtctgagacaggaagccttcgggccagatccacgtaaaacccaaatctggttggcctgcagtgttaaagaaaatcggattaattgccatcatgtaaaagtctgattttatgtttgttttatttatttatgaatttatttttgagaccgagtctcactctgtggccgaggctggagtgcagtggcaggatctcacagctcactgcaacctccgcctcccaggttcaagcaattcttctgcctcagcctctcgagtagctgggattataggcgcacaccaccatgcccagctaatttttttttttttttgtatttttagtagagatggcatttcactctgttggccaggctgatatcgaactcccaacctcaactgatccacccaccttggcctcccaaattgctggtgtcaaaggcgtgagccaccttgcccagcctgattttatgttttaaacatctggatttctggcttctgttggcaaatctgagacctggctactccggctcccagttccctgccggcaggtgccacctgagcagctgccacctgactcatggacatttgttccagtcacagactgcttctctcattttctgtctccctaggctttctttttgttttttgttttgttttgttttttgagagagaggatctcgccctgttgcccaggctggagtgcagtggcatgatcatagctcactgcagcctcaacctccttggctcaagtgatcctcctacctcagcctcctgagtagctgggactacaggcacatgccgccatgcctgactaattttttaattttttgtagagatagggtcttgccgtatggcccaggctggtctccaactcctggcctcaagcgatcctcccacttcactctcccaaaatgttgggattacaggcattagccactgcccctggctttcataaatgtttggtttggggacctaccttctgccatgggtacaattatctcagttccatttttaaaataatagtaataataataatgatgaacataaatgccgacagtaaatttaaagactggcaggaaatagacccaaatgttaacagtggctatttcttgatggtgaggttgcaagtgatttctttgaaatccttctcatttttacccccagttttcaacacttactatgtaacaccttaatcatcagggttggaattaagtggcaattcaatttcagggctgggtgtacttcagaggctgcttcacactattaggattcataacctgagcgcctcctgctcagcatctccagccagagtgcaggaatgtcccttagccgagggggaggcctgcatgagacaggctggacatggacttggttattgttgcagctgggtaatgagcacatgaggacttatcctattctgtttacttttgtgtgtgttagaaattttccatggcgaaaagataaaatatacaaatatcccaggtcagttccatttttactttgggctgagcactaagggaggatttaaaaaaaaaaaaggcataatcctgtcctcaaagagcgtatcatttagcgagggagagggatgtggagagccataattccagaacagtagaagagacctggtgaatccaggaggcagaactgagacccaccttgatccacatttgtccacatttgcctgacaacactaactacatgccccacaacggccaggcagatgcagtaagacttcagagagcccaggtctttagggcggaactgattgcttagtaaaccaccttcagccttgttttggggaaggctttctaaactgcatcaacttctctctgtgccttggaaatgagaagaagaatatgtccttgagtgggggggcattaattgagctctttttctgatcattaggacctttagccctagggtcacccggggcacggtcacccgtcccctagtgcctcagtgctcatacacacgtggtagaggacaggctgggcctctgccaactccgggacggcctggacatgggattattgagagagatttttaggctcgcatattttgttacatcatttgcctctttctctgcaagttgagcaaaataggagagaggatccagacgattgagattttgctgtttttactttaatgagtattcattgcttcccagtttacaaagtacctttacataactggcatgtttgatttttaacaaggccctttggaggtaaccagagcaagtgccattagcctttctgtaggtgaataagaggaggcttggagaggtgcccagagccacacagcctcctaagaggccacactgacatggaatcaggtcatcagccctgcacgtggcatgtggtctctcggtatttccaatggccagtgccaggacatcaggtctgtgagattaaaatagtagaaaaagatgagggaaaatgtttcatagggttcccaggcatcagcgtttagaactggaagacacttttcactgcatagtttgtcagaaaatgcttaaatttcattggtcagaatgatatctagcttacaagttatctgaacttttaagaaactgggtggttttctttttttggttgtggggtttttgtttgtttgcttgttttgttttttttgagacagagtctgtctcccagactggagtgcaatggcatgctctcagctcactgcaacctccgcctcccgggttcaagcgatcctcctgcctcagcctctcaagtagctgggactacaggcatgcgctaccatgtcccgctaatttttgtatttttagtagggacagggtttcatcttgttggccaggctggtcttgactcctgacctcaaggaatccgcccgccgcagcatcccaaagtgctgggattacaggtgtgagccaaagaaactgttttcagactcaaactggaaaccgtggaaaaaaactctttgttttttgttttttattttttgtttgttcgtttgttttttgagacggggtctccctctgttacccaggctgtagtgcagtggtacgatcttggttcactgcagcttccactgcccgggcccaagcaatcctcctgtctcagtctcccaagtagctgggaatacaggcatgtgccaccatgcccggctaatttttgtattttttgtagaaacggggttttgccatattgcctaggctgctctcaaactcctgagctcaagccattcacccaccttggcctcccaaagtgctggggttaataggtgtgaggtaccgcgcccagccaaaagaacatctttaaacatcgtcatttgaagtgactaaactaatgttagcttctcattttctgtgatcaaatcaaacatttaggagctgtctgctactgggtaaattgaatttcctcagttattactgaggctcgttggacaattctcagagcctttttctgtgtagctttgcttggtactatcagtctgttcagaagctccgtagcaaaatagatgtctggtacatgtattttcaaactcttctaggaaatgactgctgttgccagtgctggaaatcattttcatagctctttattaaccacaaaattatctgcccagtagcagcactgtgcaacagaaatagaaagtgagctatgtataattttaaattttctgtagccacattttgaaagaatgaaaaggaagaggtgaaatgaattttaataatatattttatttagcctgatatttctaaaatatgactttttttttttttttttttgagacagggtctcactctgtcacccagactggagtgcagtggtgtgatctcagctcactataacccctatctcccaggctcatggaatcttcctgcctcaacctcctgagtagctgggattataggcatgcataaccatgccaggctattttttgtattttttgtagagacagagtttcgccatgttgtccaggctcaaaatatgagcattttaacacaaagtcaatatacaacatgattgatgcaattacattcctttttcatactaaatctttcaaatctaatctcaattcatattagccacatttcaagtcttaatagtcacagtagttcatggctaccatattacatagcacagagctgagaaacattgaccacactagcctctgctttttagaatttcccaagattttaggctgtttatctatgttgcccaaatgaataacgtgtttttggagaaactctgtcaccctttcattcccaggggtactttcattgaattccgaaatgggatgttaaacgtgtcccctattggaagaagctgcagccaagaagaacgcattgagttctacgaactcgataaagtacgtctttctgaaatatctttggtgaatggctgggtttatggaaataagatatggcctggtgtggtggttcatgcctgtaatcccaacactttgggaggccaaggcaggaggatcacttgagcccaggagttcaagaccagcctaggcaacatagtgagacctcatctctacaaataataaaaaaaaaaattagctgggcatggtggcacacacctgtggtcccggctatttgtttggctgaggtaagaggatcacttgtgcctgggaggttgaagctgctgtgagctatgatcatgccactgcgctccagcctgggcaacagagcaagacccccatctcaaaaactaaacaaataaataaatcaataagataatcctacctttgtggccagtagttaaaactgtgctttctaaactgcaatacaagaaacaattggtatctttttgtttttctcagaaagaaaatataagacaaaagtttgtagcagatctacggaaagagtttgctggaaaaggcctcacgttttccataggtattgtatatattgcctgtgttccaaacttggatacccatttcccagagtttgttgtgggccagtgagctattgataatgaagtatgtgcagttttaggtgggcaggaagattaaatgagcagtccagtctatagacaaaaaccaaccactctcttttctgcataattagccataataggacttgcctagtcaagaaacagcttacacgctgttgggcttggttctaaattcttacccaacagcattcttcctacctggactcctctcatcaaaagaggagcactttgattactaaagagtaggaacttctcacacctttgggcagaagagaagcactatagtgaactccataagggagacatggaattgaaccccttaggtaaactagaccgatgttttggaatcatagaatgtttcaacagcaaggaaccttaggggccaattgggtggcttttacagatcaagaaactgaggcccagaaaggagaagagacttgtccaagttcacaaagctgttgtttacacagccagtgtgtgaacgtttctggtgtctaatgcagagttcttcctgcagcacggacatctcaggcttgtcttttgttagaatattcctgccaaatgctttgcacaccgatttctcttgtcagtgctaatgagtcattgctcaaagcctcctcattttactagctttcatcaaggtagaggttgtaggaaaactggaatggcaaagggattatatttaacagatgagtgggtgggttttttgtcttcctgaactgtgagatggacatctttctgacaaagctttgaaagggtttttgttgcccgtgagcactgcctgtaaatcaccttcagtgaagattctcatttttcccgcaaaatatgccggatgcaacctgcttccgggcatttccccctgagggtgtgttaaagcccgagacaagcacagcagaatgaggctggtatccgatttttcataagcatgcttcctttaaaccacacgcttgacagggcgcttaaacgcaaatgcatttctcactctgagttggcattctgtgcctcaattttagacctatgtgaaataatgctggaaaaaaacaatgtagaattaatttctagaacctatgcatgaagtagtctaagtagcaaactagagtactgaaaatcaaccttggcaacccactaactgacaaaagagtaaattgtttttttcagtgacatatcattagcccctttttcaccttttgcctttgtgtgccccgtccccacccggcaggaggccagatcagctttgatgtctttcctgatggatgggacaagagatactgtctgcgacatgtggaaaatgacggttataagaccatttatttctttggagacaaaactatgccagtaagtagagaagtgtttgtgcaccttcattgttgcatttgcgcttgatgggggaaattgacaactgggctgtttttcctgtacctacactttacccacccgccctgctcaaactgagcagtggcttctgtcctggagaggtgggtgattgagccaccttcccctctaagctcagacccccgacgcctctgtggaggcaaggatcacactgcatgttagttgaaccttttcaccttggctttggaattaaacgttggccaccctatgtgccttccagaataccagtccccggtgccactgtcaaaccctctgcgtttcaaagctctggctgtttcaacctcatttttccactgtatttgtccacccgaggcattcattctaagttgaacacgaggggccatgaacgatgggaggatagggaatgatctcatgagcctgaaacaggagaggacaccagcaacagcaaagaggccaagtgagtcccaggcatcacacacggcgggtgcttggagctgcccccaagggatgtcagaaatctcgagttcagggccaaatctaaactgagaactgagagcagagcccagtgttaaaggccagggccagcaggaggaatacatagaagaaatgcccccaggtgtcctctccgtggggcaaggtggatccccaggaggtcagagaggcgttgctgccatcaaaggcccaagaggaggctcatcaccacccagctttgggccagctccttttctttctctttttttttttttttttttttttttctgagacagagtctcgctctgttgcccaggctggagtgcagtggtgcaatcttggctcactgcaacctctgcctcccaggttcaagcaatccttgtgcctcagcctcctgagtacctgatattacgggcatgcaccaccacacctggctgatttttgtgtttttagtagagatagggttttaccatgttaaccaggctggtctcaaacccctgggctcaagtgatccaatcaactcggccgctcaaagttctgggatgacaggtgtgatttttagtacagacagggtttcatcatgttggccaggctggtcttgattcctggcctcaaggaatctgcctgcctcagcgatccacccacctcggcctctcagttctgggatgacaggccgcgcccagccccatcaccttttcagttactcccatcctctgggcccctctgcctccctcccacatgcaggctgggggtgttggttaccttgccatcagcaggcccgtgtcaggctttctcgccatcctgcacctagcaggtgcatcataaatgctgcatattcagagtttctcatccctctgatctctggtccactccaaaatccttgctgcactgctaagatctacccatgaaagatttgcttttcagcagggtccccacgtcacagtcttccagcatgaggggtacacagtggtagtagaggcttgttacttattttcagaatgataaaactgaaacccataaagggtaagggatttgccgaaggtcacacggctaatgacagagctggtggcaccagaagaagtctacctgttctttgtatgttttaaatagctttattgaggtataattgatcagcaaaagctgtacatatttaacgctcacagtttcgtgagtttaatcattgtgcctctttggttttgggggcggtttgggatttttttgttgctattgttataagaacacttaacatgagatattccctcttaacaagtttctaagtgtacaatacagtattgttaactataggcacttctgtttgtccaacagatctgtagaacttacacatcttacataactgagacattacacccattgaacaacaactctccatctccctcctccaccgccccgtccctggcaaccaccgttcttttctctgcttatatgactttagcacctttagatatctgatacaaggggaatcatgcagtattcatccttctgtaaggggcttattcactcagtatgtcttctcagtttactcatgctggcacaaatggcaagtttccttattttttaaggcggaataatgtttcatggtatgaatacactatattttctttcttttttttttttttttcttgaggcagaatctcgctctgtcgcccaggctagagtgcagtggcaccatcttggctcactgcaacctccacctccctggttccctggttcaagtgattctcgtgcctcagcctcccgattagtggctgggattacaggagcctgccaccacgcccggctaatttttgtatttttagtagagacagggttttgccacattggccaggctggtctcgaactcctggcctcaagagattcacctgccttggcctcctaaattgatgggattacaggcgtgagccagcgtgcccggtcagaatatactccattttcttgatccattcttctgtcagtagacacatgagttgtttccgtatcttggccattatgaataatgcttcagtgaacacgggggtacagatacctctctgagatcctgacttcgtccttttggccatctacccatggattaaagacttaaacacaggacctgaaactgtaaaactcctagaaaaaaaacatagggaaaaagcaatgatattttagatgtgacaccaaaagcacaggcaacaaaagcaaaacaaacaagttggacaacgtcaaactaaaaagtgtctgcacagcaagggaaataatcagaatgaaaaagcaacctacagaggggaagagaatatttgcaaaccatatatctgataaaagggctagtatccaaaatgtataagaaactccaacaactcaatggcaaaaaaaaaaacaatttaaaacatgagcaaaggacttgaatagacagttctccaaagaagacatgcagatggccagtgggtatataaaaaaaggctcaacatcagtgttcagggaaatgcaaatcaaaactacaatgagataaacctcacacctgccaggatggccattttattttattttattttgagacggagttttgctctgtcacccaggctggagtgcagtgatgcgatcttggctcactgcaaccactgcctcctgagttcaagctattcttatacctcagcctcccgagtagctgggattacaggcgcccgccaccatgcccagctaattttgtatttttagtagaaatggggtttcaccatgttggccagcctggtctcgaactcatgacctgaagtgatccacccaccttgacctcccaaagtgctaggcttataggcgtgagccaccacactgggccaggatggctaattttgttttttttaatgttggtggctgggtgcggtggctcacacctataatcccagcactttgggaggccaaggtgggcggatcacctgaggtcaggagttccgagaccagcctgaccaacatggagaaaccccgtctctactaaaaatacaaaattagctgggcatggtggtgcacacctgtcatcccagctacttgggaggctgaggcaggagaattgcttgaacccgggaggtggaggttgcagtgagctgagattgtgccattgtactccagcctgggcaacaagagcgaaactcggtctcaaaaagataaaataaatgttggcgagggtgtggagaaattagaacccttgtacactgttgtgggaaatgttaaatgtcatagctatgatggaaaactacatagtggttcctcaaattaaaaatagaactgccatatgatccagcagttccacttagagatatatatccaaaataattgaaatcaggatcacaaagagatacctgctgtttaaaataaaataaaataaagacagggtcttgctgtgttgcccaggctgtactccaactcctgagttcaagcaattgtcccgcttcagcctcccaagtagctggaattagaggcgtgcactaccacagctggtgatacctgctgtttaaatgagtgtgctttccactacgataagctctctctcagtggggtagaaagatcttgttctaaatcccagatgaactgggtactttgaaggaggtgtagcattcaggtttgttcttaatgacagttacatatggttttataaccacatccttttgttgaaatgcttttgatgcagaaatgctttcagtgcaggctttgaaaaagatcaccgtctgacttcatgtctttaaaaaaattaagctaatgaaatgacacctaggatctaagggatgcccggaagcttcctcagtccttctctagcttggtgccatttcttgtagacagagaggagagctattaagacacacgacagcagattgttctgtaatgatgacattcttgcttcatgtaaatagccatttagaagcctcagttgggactttgcagaatggaatgcagttcttggataatcagaaaatgacttattttgggaattcttcatttgggaattagagggttttctattctgtttaaccattgcattaccatgcctggattctatttttaaaatcttacctacgttttaaaaaatgagtattatttaatggaagctttcccccaattgtaaattaacctgtgcattcattatagaaaattagagaaagtacgaagaagaaaaagaaagtcacctataatcatccaacaatgtcccagcctttctatgtatatgatcccaaaagtgggatccttacatgttgttttagttttagttttctttctcttaacgtattttatttttatcatattagtgaatattctttgcaaagaagatttttttttttttttgagacagagtcttgctctgtcacccaggctggagtgcagtggcgtgatctcggctcactgtaagctccacctcccgggttcacaccattctcctgcctcatcctcccgagtagcttggactataggtgcccaccaccacgcccggctaattttttgtatttttagtagagatggggttcaccatgttagccaggatggtcatgatctcctgacctcgtgatccgtccgcctcggcctcccaaagtgctgggattacaggcgtgagccactgcgcctggcgcaaagaagatttttaatggctgtataatattctctcattaggcatcagttactcacctcccttgcagaggcacgttgggtggtttaaggggttttgctatcataactaatgctgtggtgaacattcttgcacgattctttgcccccatccctgatccttttcgtcagcggttttctagaaatggaaattagcagtccagccatgtaaaccttcaaacaacctatcagttcttgaaacttcaggtgcagagcaatccaaatactagccttacactttgcattttcagtgatagacatttagaaagctggggttttttcctttcctaatgaagtttgatgtttttgccggcgtccagggaagtgatcctgagctgaggctgtcagtaaaaaagccatttctcagccaggccctgaggcttagcagcctcttccagcagcacagcctccaggaggcagagtctggtgttacataaagggtgccatctgcttggagcaactcgagagcagagtgaggaagtgtggcgttggccgttgcttttcaaaatatttgccatcttcagaaaccctgtcattcttcccatcagccacaaaagccagtgtttcttaaaatctggctctgagttcagcatggaggccctgggcctggcatggagtaccttggtttgttgcagagagagagagacggcaagggcagagagcacacaccacacatggctctgcatggctttccagaaaccaccctggctggatcaccctcagccactctgaattcgcaggcaagagaacctgtacttacccatgctttctgtaaaagtcatcttggctttaaggcagttgcaacatgaaaacattctaacacttcatgaatatcaagcagctggtttggtttttgacttgacgcttccattttgggtaatttggctatcagtgcactcaagcatgtgtgaaagactcacgcagagggttcagggttggggacagccccgctgctcctcaggaggctggccacatgacagtggtctgtctctgcactgggatgccatgtagctgtaaaaagagtccatgtggacccatctctagggctttttgttaggtgatcaaagcaaagtgcaggacaatataagtaatgtgctggctacatttttgtctaaagagggcaaaggaatttctctttttgttagcttataaatgcataaaaggagtctgaatggatgaaatttacagaggttactgtgggggtggggaggacaggagagagaattgccacctaggtcttaactctttcttaatatgtttgaactatatgaatgtgctatctattgaaaaataaaatttttaaatcaacttgagaaaaggatctgagtaatccctgtaatcctggctactagggaggctgaagtgggaggattacttgagcctaggagttcaagattatagtgagccacgattgcgccactgcactccagcctaggcaacagagcgagacctcgtctcttaaaaaaaaaaaaaacaataaaaattaaaaatttttaaaaattgaaaaaagggaggaaatgtaaatcttccagcacttcctcagtgtcagaccctgagctggacacttatgttgtacatgctcccaggggagacagcagcatcctccctcttacagaggaagcacagtgggaagtccagggtctcagctagtcagagactaagctgggatctgaaagcctcgcctctgtcattctcctacatcgcttctaacatgctacctgccttccttttaagtaaattgtgcaacattttattctccagaaatgttaataaggaagatctgcctttaaaattagcttaaaaatacaaaaattagctgggcgtggtggcgcatgcctggatcccagctactcaggaggctgaggcaggagaagcgcttgaacccgggaggcggaggttgcagtgagctgagattgtgccattgcactccaggctgggcaacagagtgaaattctgtctcaataaacaaataaagaaaaacaaaattagcttaaaagaggtttgtatcagtgtggaccatgttgacccagatctggccccaccattcaccagtgaccttgtgacagtgaggacagtgacagtgacctcgtcagcccagtgaggacacagttcttctttttttttttttttttcctgagacaaggtctcactctgtcacccagactggagtgcagtggcgcaatcttggttcactgtaatcttgaactcctgggctcaagtgatcctcccacttcagcctcctgagtagctgggattaccggtgcccaccaccacgcctggctaatttttgtatttttagtagagacggggtttcaccatcttggccaggctggtcttgaactcctaacctcaagtgatccgcccaccttggcctcccaaagtgctggaattacaggcgtgagccaccactcccgaccacagttgctcttctgaaggagtcatatgagaatgaagtgaaggcatctgaggaaagtgggtgacgcagggcctgactcaggaaaggcagctgggacatgcatctttggcctggtccacaaccagcgtctgcttccttcactttctaagaaagttattcaaaggctcatctgttattgagattttcctaagagattggagcctgccaagtccctcagtgaagggccatccttgtgagtgagcaccttcctacacaccttccaacagttcattagagcgtgaattagtgaaccatgtcctcctgtcctcaggttccaagttaggctttggatggcagttggcctttgcgatcctggacttaaccatgcctagcatctgtagctctttcaggactcaaggctaaggagggcacagaatggattctgtggatagatctgtcttactacttattgctgggaccacatgatttgagacccaggtcttcttgtgtggctggtggcagacttagcttcttaacatgtgagtccctcactcctggagggaccctgagtgaattgccgctcccacagtcagcttccagaactgactggcagaaattgatgagaggttctcagcctggtggagatgtcccacccgctcctgtgtgggaggccaggaagcagggtgtcatgcatgggagccacgagcttcagatgttcctgctagcccaccttcctcctgagtgccagactccacagagtccatggccctgggtgttggtcccaggaataggactgtggctaacaaccagcccacagagtgagcatccctgcctgtgtctgtgctgaagctctttcattcagggagacactggcttcaaacccctggagtggggctggccttccagggagccccttgatgtccgcagaatcggcatctcctgtgggcattccaggcccagatccgtcacagagctgtctcctctgcccttgaaggccggagaggtgaaatgagagggctgtgctcagagccgtcaacagacccaagggtcactcgccctagggccactagccccttggccagctcaggttccaccctcgcccccaagccaaggggtgttttttcctagattctaagtcactggtgctcagccctggatatatattggaatcacctgatcactttcaaaacatcatgaccctgggcttgggccatgccccaaacaagcatttttaaggcatccccagggactctagccagggagagccactactgctctacgccatttcagagcaggctcttgtctcattggccctgtaactgcccaacaggttctccttgcccactgcctagacaagagccgatttatcaagacaggagagttgcagtagacaaagggtaattcacgcagagctggctgtacaggagactggagttttattattcctcaaatcagcctctccaagaatttggggatcagagtttttaaggataacttgctgggtaggggcttgggaagtggagattgctgattggtcggcttggagatgaaatcatagggggtggaagtgagtttttcttgctatcttctgttcctggtgggatcaaagagctggttgagccagattacctgtctgtgtggcatcagatactgcatcagaacacagggtctacaaaatatctcaggcacaatcttaggttttatgacagtgatattattttcaggagcaatttggggaggttcagactcttgtagctaatttgttagtcctacaaaggcagactggtccccaggcaagaagggggtttatttcagggaaagggctgttaccggcattgtttcaaagttaaactataaactgaattcctcccaaggttagtttggtctgcatccaggaatgaacaaggacatcttggaagttagaagcaagatggagtcatttaggtcaccatcataattttctcagttaaaatttttgcaaagacagtttcagttcctcctgttgggttttataataccttattcctaatacttcatactgtgggatatgaagatgggaaaagagtgataaccgctctagcttctttctgctgacagggagcgtagtcagggtaggtgttgacccaaaggtaggaggagtgaaaccactttgcagctgtctgcttctactcaggggttcctggttagggtttgaaggcctgcatgacaaaggcattagtattctcatctatagttttaacaaatgagtcctaggataaagagtgaaagtcctggcttcagaagcttttgtagaattgatcctaagctctgagggacccaggtaaatagctccaagaaccaatcagacatggggttactagcagagagagatttgggtcagaggttgttagacagacagattggggtagacaggaaagaggaaatttaaatatactcatccttatctttttagtcagttttcctagtcctaagactagatcagttcagttaaacagctgtttccattatcaagagatggcactggagatgggctaggcatctttagttatagaggaggaaggcagtggcaatttgacatgtttttgtcatctgtattacaaagaataagcttcagcttgcagggcctcaggaaaaaggtagtagcaatttaattgagtccaagtcagaaaagtgggaaaaaaaaattgaaagcattagtttgggaattgtagcccacagagaattcaggatttagtccaaattgcaggaaataataaaaactcaagaacaaaggacaagactagaatctaacagcagggtgtatcatagttttttgaaacacttttttccctctcccatccttatttttattaaagacaaaccgtagtaggacaagtttacttgcaaaataagtcatagtcttattaagcttggcctgattatttgtataaagtaaagcaagaataattgtttgccagataggctgtttttaaaattggctttgctgaaactttgttccataagaaatctcaggttagacttttttaaagcctcgagcccagccatggatttatctactatacctgcaaagataaacctgtatgagttgggtgaaattttttcttctcatggtcctaagataatttggggctcctgggcctgtcaaaaagtgacggtctttatttaccacagttcaggaaccccgtacagggactgtgtagacaaggtatgaggccagcttttccaagggacttctattggctctgttagtcaactttgttccttaaagcagtctgtttatatttgaaagtatgtcgtaccagtcaaagccttggtaaagtaaccggcatctctaattgtatcctattacaaaagaaaacagattgttactgcccttgcacaaataattatactgccataagttgagaatactcacaaatagtttccaaattctggagaaatcagagagaaggcaatatgctctaaattttgctcacagaagtatactttaactcaattgttaaagttgtaaatagctcaaaagaaaaatagttttctggactctgaaaaacaaaaggattaacaatgtttaacacatcagctctccatgaggatcctagaagttttttttcctccattccaatggcacaatttgtaaagttatcagagacctgcattcaagagtacccattagagtactatatctgattataaactgccttttgaaaaggataaaaccaagacagcaactgcctgtgggtaacaaaagtctcaggacagccgtagttaaagatgcagtcaacaaggaaatctggtcatctctgtgacacacagtttaacagaacagttataattattactcataacatatactgagacgtatcagaattataggagtcttacacaattttgtaacacatactaataacatagttatacgactataaacccaaagaaagttaaacacttttttatatttgacagtgcttcctacataattttaatacaccaaataagccaaatatgcctcttttggactttaggggactttttttttttaacttagaatttgatcttgggaagtttgttaaatatcaaaggtttgaaacactagatatcacaaagtagaatcccaggtcaccataagtaattcatttagccacaatgataactcaaacattttgtaacaggaaaaacctttactctgatagagagaagactcagctttctaaacaacaaaacccagtgaagatagcatgaggccaactgaatctttcttttattttttttaatagtttactccaaagccaaataaaaatctttcattgtctctctctgtcaatattacataaaaatattcttcaaaagagaaaaccaaattttatctcgcattagtgcatctttaatgctaaagctagttttgtttttgttgttgtttgaggtggagtctcgctctgttgcccaggctggagtacagtggcacgatctcagctcactgcaagctctatctcctgggttcatgccattctcctgcttcagcctcccgagtagctgggactacaggcgtgtgccaccacgcctggctaattttttgtattttttagtagagacggggtttcaccatgttagccaggatggtcttgatctcctgacctcgtgatccacccacctcggcctcccaaagtgctaggattacaggcatgagccactgtgcccggcctgttgtagttttgagacggagtttcactcttgtcacccaggctggagtgcagtggcatgatctcggctcactgcaccctccgcctcctgggttcaagcgattctcctgcctcccaagtagctgggattacaggcacccaccaccactcctggctaatttttgtattttttagtagagactgggtttcgccatgttggccaggctggtcttgaactcctgaccccacgtgatcgcccacctcagcctcccaaagcgctgggattacagttgtgagccaccactcctagccaaagctagtttttaataaaattttacaaacaaatgtatccgattttagtttgactgtagggtaacattttcgtaaaccttttatataaccctttataattgtttgttaacaaatcagtgttcaaaaataaaacactatttttttttttttttttgagatggagtcttgctccattgcccaggctggagtgcagtggcacattctcagctcactgcaacctctgcctctcaggttcaagcaattcttctgcctcaacctcccgagtagctgggactacaggcgtgtgccaccacgcccggctaatttttgtatttttagtagagacaggatttcaccatatgggccaggctggtttcgaacttctgacctcgtgatctgcctgcgtcggccttccaaagtgctaggattacaggcatgtgccaccgcatctggcataaaaccctattattttgatatatgggcccagattctggccctgcatcagtatgcttttaatatttaatttatggaaaaaattaaataataccctttcgattttagccagcttgctcacacacagagttgttcacaaagttaatttttcacaaacctacaatttgcttaaactttcagttttattttgtctttcaaccaaaaataatctttaaactctctaaattagagaagattttctcttttaaaaaaacccatattcccatgtctttaagcagttttaattacataccaagtgcagagcctagaatacaggacagaactgcagataaagtctgactctctctggcctagctaggagtcatggctacctccatatgtccccaggccttatctggaatctaatggctctaaagtaggtaaattgaacaattacaaaagtcacagaagccacttatgaccttaaagcatccagcagaaacagtatctgatctgcctaattcagaccaaatgaagacagttttatttcatcaataatctttaaaactatctttatttaccaaagattactaacgtcatgtgaactaaaatgcattagagttgctatttctttgaaaaaatatttaagtgcttattttttaagccaattaattacagctcttaaacatcacacacacaacattataaatatatagaccgaagaagatgcattagttaagatttttcatttgctgattttttaggggttttttttccccattttacaaatcttgtcacgactcacagagaccatctatgccatgcttggactgtctgacttgtcctatgtgtccctctttcgtgaataatcagtcgttctattttaggacaagaatttaccatacaagatcttttctcatataaatttctttttttataatcatccttaccaaaaatacatctttatagcctcaacttttttcacatatctctctcccctactaaagtaattcctgatgccctcaaaagtgaaaaaggccaagtaatgtgattcaaaacagaacagagccttagattttgagaggggtctgtctgcttacacttcttggggttttatgaggaaaacagagtttctcccaaaacagggtctgtggagccttctctctttttcccaaggagtccccagctgtcagaaagtaccttaggtcctctcatgtgggcattcagagtggcaggaagacagactggggaaataattcagttgactgagaagaaagacaaacaaaaactcattcctcgaagaaaaaaaaaaaatccaggaagagaaaaagcacaaaggccttttttttatttttttatttttatttttatttttttttgaaatggagtcttgctctgtcacccaggctagatagagtgcaatggcatgatctaagctcactgcagcctctgcctcccgggttcaagtgattctcgtgcctcagcctcccgagtagctgggaccacaggcacacgccaccaggcctggctaatttttgtatttttagtagagacagggtttcactatgttggccaggctggtcttgaactcctgacctcaagtgatccccctgcctcagcctctcaaagtgctgggattacaggcatgagccactgcacccagcccacaaaggccttttaaatgtgtgcatatatatatatatatatatatatatatatatatatatatatgcacacatttatatatatatatttatatatatttatacatatttatatatttatataatatatattatatatattgtataatatataatatatatgttatatattatatatatgttatataatatatgatatatatgatatatattatatatattatgttttatatataatatatatttataaatatatatatttataaatttatatatatatataaaacttggatatccatttttaattaagcagattttaactgtagaactctttttttttttttttttttttacaaaatctttttaaatttcttattaccagactctagccaggatagacagccagtatttctggcttttgaactttaccacaggtaacctcctagcaaaattaataagtcttatctaagattatgacttaactacagaagtataagatgtctcaaagggatggtaagcagttttttgtttttttcttttacaagatttagaatctccccaaacgtagtttagagaaaagaaaatttaaggcagatttcaaggcaagctgtccatggtggggaaagaatcaataaatggcacacaaaaaaaacttacataaataacaaaccagagagcacccattccgtaagctgggaaccagacccaggctaccactgtgaaatagcaaagcttcagctactgagctaaagctgaaggctgttacactggtcttcctgggaatccaggactttactcaagataattcttaaggctagacatgacactgtcacatgtcctctcagaccagctaccgacatgaacccaaaaattcatgccctctggatgccggagaccaaaagagggtaccctgacatggtcccaaagtcaagtttttcaggacgtaaaacaagagaagagggaaaccttatctggtttttgttggagcaaagtttggaactgaccagtctgccaggctggattgaacagcgggcttagaggggtcctatgtccacatcctattctgtggtcctgctctccatgacagaggatgcagctgtgagtgggtttggtttgcgctgtatctccagctactaaagcaatgcttggcaggtagtaggtgttctagaaaggtgtgtcgtattaatgtgtgaatactgactccccctcctaagtcactgagtgaggagagaggatgtgtgattcatctgaggcatgtgagagctggttgtgcctttgtctttgtttttcttttttcttttgagatggagtctcactctattgcccaggctggagtgcagtggtgcgatcttagctcactgcagcctccacccaccgggttccagtgattttcctgcctcagcctccagagtagctggggatttgtattcacagcacagagtgcaccagattccctacagcctaagtctaggctcataagattttttctattaatcagacccttgcagaggagacaaacagtgatgttttccattcatacacggcgagaggggccagaagcctggctggtaagaaatgtttaccctttttgcctgcatgtcaggtttctgggttcccattctctgtagcttccagaagaacggagcagctcttgatgaccctgatcgctgcacgctagctgtgggcgccaagtcgcattgcaaaggaaaaccatccgtttctgttttatggaaccacaggcaaaagcctctcaatttttcaagatgctgcccaatgggctgcatggggaactgaattaacattttccatcctggccagagcagagtacacatgacaaaactagtcactatgctcagtgcccagcatcaacttggcaaggctcacacttgctcccgttggtctctgtcatctttgatccactccactcaaggtgggaagggacgccttccaccgggaattcaaaggatggtctctgagccagatggaagagcggatggtcaccctcgaggcagccctgtcaaacttccgagcttctgctgacaagtccttcagggttcagtgaatgtgaccaaccagacaaactaggagagcctgatggacttccttcagcaattcccttagacatctcctccacatatacaaacacatacagcaaaacaccttccagaaagagtttccagactaaatcacaaaccaagagtattcctccaaacaagtcccctattctctgtacaattagggcagataccccatgctggggctacaaacagataccacctaatagagctagagatgccccatgatggggctacaggcagacacccaatgatggggctacagacagataccctgtgatggggctacagttacaggacgtctccccaggactgtttattgcagttaaatccatacaccatgggttggcagcaccccattagtagagatggtgccagtgtcagcccccagtcgaagagaactaggtggccgcctgggctggcctctggatccatcaccagtgaggggggttggggaggctactgaatcgctggaagatagccacaagggagatcacagatgagcccccaaatttgtaaccccctccacaggttctccttgcccacagcctagacagccaatttatcaagacaggagaattgcaatagactaattcacacagagccagctgtgcaggagactggagttttattattactcaaatcagtctccaagaatttggggatttgagtttttaaggataacttggtgggtaggggctctggaggtgtggattgctgattggtcagcatggagatgaaatcatagggggtagaagtgagtttttcttgctgtcttctgtccttgggtgggatcaaagtgccggttgaatcatattacctgtctgggtggcgtcaactgctgcattggaaggcagggtctgcaaaatacctcaagcactgatcttaggatttacaagcgatgttattctcaggagcaatgtggggaggttcagactcttgcagccagaggctccgtggctccaaaaccataatttctaatcttgtaactaatttgttagtcctacaaaggcagactggtccccaggcaagaagggggtttatttcaggaaagagctgttatcctttgtttcaaagttgaactataggccgggcagggtggctcacgcctgtaatcccagcactttgagaggctgaggcaggccgatcacttgaggccgggagtttgacaccagcctggtcaacagggtgaaaccccgcctctactaaaagtacaaaaattagccaggtgtggtggtgcacacctgtaatcccagctactcgggaggctgaggcaggagaatcacttgaacctgggaggcagagattccagtgagccgagagtgtgccactgcactccaccttggtgacagagtgagactccgtctccaaaaacaaaaaaaacaaagttgaactataaactgaattcctcccaaggttagttcagcctgtgccctggaatgaacaaggacagcttggaggttagaagcaagatggagtcaggccagatctctttcactgttaacattttctcagttataatttttgcaaatgtggtttcagtccctgcatccataatacctagaaatttgataaatacttgttaaacaaccaaaataaacatccatagcaagaatcgactataaggcatggtggtgcacacctgtagtcccagctactcaggaggctgaggtgggaggatcgcttgagcccaggaggtggaggctgcagcaagacatggtcgcaccagtgcactccagcctgggcaagagtgggaccctgtctcaaaaataaataagagtcccgaccacgagctacagagagtccatctgtgctataggaggcatccacacagcacacacccactgctaccagcgaagcagttcacgcaggctgtgatagatcacactgttcctctctttggatgattggggttcactgctacactgcacaggtcagcaacagcatgtacagaaatgggctgcggtggggagactcatcagccccctggcatctgaacatggccaacactatgccttctgtttcatcctcagactttgggactattagggatttaaatattaatgcgcggatttcactgagccctggcctctctttggtgcctgtcaggtacactataatgagaaattggatcgttcattcttccctccccccttccctcccttctccagggaacagggtttttgttcttggagcttgggaggtggctgagttccccaactagaatcaagtaacctttagtgcatatgcaaatccagcatttgaaatttccggttctctagccttattattctagagggcagccagctttcctttcatttcatttggggtccgcttcacttgctttgcagctactctggtatgcaagctcgacacagccccaagaaggctgcaccccaggaaggagcccaccatgctctgagagtcacaaagaaagaagcagacccttggcgggagagaaaggaaggcctgaggcaggttgtgtttgtgatgcagatgctcctgcgagccgtgcggctctctgaaagcgggtggagctgagaagcaacccagagaggctcctgcagccagggtcgggaggatttcaccttcctggatgggaattgattctccagacctagctttattaagtgtcagcgagttacatgcacacagatcactcagattccacagacacctccccaccagcccccagcaggaccacgggaggagactcgtgccgttaggcctctgtccctgcatgtgacatctgcagggaagggcaggcctagcaactgtcaggggactagcataaaccctttttgcttcaggggtctcttcccaggtaatggcctctgtcctctttgcaccctggccggctgcaggagcctcctaactgctcccttcaattgcgtcctcaccccgcacccgttctccagaaagatcctgttgtaaagtaatctgatcatggcccgggcttgcaggcttcaggcggctacccgtgaaatcccaggtgcttaccacaatctgtgaggcccgctgtggcccggccccagcccctgcccatcctccctcttcagcgtcttctctgatggccacatggcctgtgccctcacgtccctcagatgccagggttccctcaccctccaggcctggcagcccttccctccctttgctcaacaaggcgcccaagagctgtctgttgatgactggtctccccagggcagctgtgatgtggttttggtttgcgccgtatccccagctgctaaagcaatgcctggcgggtagagggtttcgtgcgcgtccgtgtgaagagaccaccaaacgggctttgtgtgagcaacatggctgtttttttcacctgggtgcaggcgggctgagtcccaaaagagagtcagcaaagggtggtggattatcattagttcttatgggttttgggataggcggtgaagttaagagcaatgttttgcgggcaggagtggatctcacaaagtacattctcaagagtggggagaattacaaagaaccttcttaagggtgggggagattacaaagtacattgatcagtttgggtggggcagaagcaaatcacaatggtgggatgtcatcagttaaggctatttttacttttgcggatcttcagttacttcaggccatctggatgtatacgtgcaagtcacaggggatgcgatggcttggcttgggctcagaggcctgacattcctgccttcttatattaataagaaaaataaaatagtgttgaagtgttggggcggtgaaaatttttagggggtggtatggagagagaatggacgatgtttctcagggctgcttcaagcgggattaggggcggcgtgggaacctagagtgggagagattaagctgaagggaggtcttgtggtaaggggtgatattgtggggatgttagaagaaacatctgtcgtatagaatgattggtgatggcctggatacggttttggatgaattcagaaactaaatggaataagagaaggagaaaaacaggtataaaaggtctaagaattgggaggacctatgacatctgattagagagtgcctaaggagattcagcatagtcctgccagcaaagattatttatttacctcaagagtttagagtggcagtttggggatagcaccaggagatatcagctgtgatggcttggagaaacagtgtaaaccggcagtgtaaacaagagcagggcatgtatgagtagttgagaatggcgaataggaatatgactagacaggagatagtagggatgacaagttttggggggcacagtctaagttggtctggtgtctggaatgagactggggcctaataaaaaggagcgtctatacaggagcttacatgggctgtaccttgtagcattctgaggacaggcctgaattctgagaagggaaagtggtaaaagtattgtccagtcctttttaagttggaggctgagcttggtgaggtgtgtttttaaaagacctttagtccattctacctttcctgaagattgaggactgtaagggatatgaaggttccactgaatactaagagcctgagaaactgcttgggtgatttgactagtaaaggctggtccgttatcagactgtatagaggtgggaaggctaaactgaggaattatgtctgacagaagggaagaaatgactgcggtggccttctcagaccctgtaggaaaggcctctacttatctagtgaaagtgtctacttagagtaagaggtattttagttacctgactcggggcatgttgagtgaagctaatttgccagtcctgggtgggggcaaatcttcaagcttgatgtgtagggaagggagggggcctgaataatccctgaggagtagtagaatagcagatggaacactgagaagttatttccttgaggatagatttccacgatggaaaggaaatgagacgttctaagaggcgggctagtggcttgtactatagcatagcctgcctttgctgctatgtggcgattaggcctggtggaaccgccatcaataaatcaagcgtgatcagggtgaggaacaggaaagaaggaaatatggggaaatggggtgaatatcaggtggatcagagagatacagtcatgggggtcaggtgtggtatcaggaataatgtgggaggccagattgaggtccgggccaggaacaatggtaattgtgggacttaacaaagagtgagtacagctgaaggagccggggagcagaaagtatatgcatcaggtatgaggaagaaagtagattttggaagttacgagaaatgtagagagtgagttgagcatagtttgtgatttttacggcctctaaaagtattaaagcagcggcagccgctgcacgcagacatgagggctaggctaaaacagtaaggtcaagttgtttggacagaaaggctacagggtgtggtcctggctgttgtgtaagaattctgaccgcactaaccatgcctaggaaggaagggagttgttgttttgtaagggattgaggtttgggagattaatcagacacgatcaacagggagagcacgtgtgtttttatgagaattatgccgagataggtaacagatggggatgaaatttgggcttgactgaagtagtgggggctgtctgtgaagccttgtggccgtacagcccaggtaatttgctgagcctgatgggtgtcagggtcatctaactgaaagcaaagagacgctgggatgaagggtgcaaaggaatagtaaagaaagcatgtttgagatccagaacagaataatgggtagtagatggaggtattgaggacaggagagtatatgggtttggcaccacggggtggataggcaaaacaatttggttgataacgcgcagattctgaagtaacctgtaagccttgtctggttttaggacaggtaaaatgggggaattgtaaggagagtttataggttttaaaaggccatgctgtagcaggcgagtgataacaggctttaatccttttaaagcgtgccatgggatgggacattgagtggggtaagggtgattaggttttaatgagatggtaaggggtgcatgattggttgccaaggagggagtagaggtatcttatacttgtgggttaaggttgggggatacaagaggaggacacaaaggaggctttggattgggaagaagggcggcaatgagatgtagctgtagttcaggaatactcagggaagcagataatttaaagtgtctcggcctaataagggaactgggcaggtggggataactgaaaaggagtgcttaaaagagtaatgtctaaattggcaccagagttggggagttttaagaggtttagaagcctggccgtcaatacccacaacagttacggaggcaagggaaacaggcccttgaaaagaaggtaatgtggagtgggtagcctccgtattgattaagaaggggatggacttaccctccactgtgagagttacccgatgctcggcgtccgtgatggtttatggggcttccgaggggattgggcagtgtcagtcttcagctgctaagccgagatctgggaaggagtcagagagccttgggccagagttccaggggctctggggagtggctgccaggtgagttgaacagtctgattttcatggggtcccgcacagatgggacgcggcttaggaggaatcccgggctgtgggcattccttggcccagtggccagatttccagcacgtgtagcaagctcctgggggaggaggttctggaggaacgcctggctgctgcggttcaggcgtttggaagttcttgtgtgctggagatgtggctggggtttgtctcacagtggaggcaaggaattgccacttttttctattactgtccaccttgaaggtgaggttagttaagtcctgttatggggtttgagggccagattctaatttttggagttttatttaatgtcgggagcagattgggtaataaaatgtatattgagaataagacggccttttgaccttttagggtctagggctgtaaagcgtgtcagggttgctgccaaacgagccatgaactgggctggatttttatatttgatgaaaaagaacctaaacgctatctgatttgggataaagaaaaaggagcattaactttgactatgcctttagctccagccaccttttcaagagtaaattgctgggcaggtgggggagggccagtcacagaatgaactgtaagctggtccaggtgtgaggaggggaggtgataaaaggattatagggtggaggagcggaggctgaggaagaattggaacctagctcagcctggcgaggaggagaggtcagatgggtctgtagaaaaggaatattagaaagactcagcgacgcttggggttgcgactgaggggacaggtgggagggaaagaaggaagatttgggacgagttgcactgggcacagagactaggaagggactgatgtgtaaaagaatgcctggacatcaggcacctcagaccgtttgcccattttacgacaagaattatttagatcttgtaggatggaaaaactgaaagtgccgttttctggctatttggaactactgtcgagtttgtattggggtcaagtggaattgcagaagaaaataaggcatttatttaggttttaggtcaggtgtgagttgaagaggttttaagttcttaagaacacaggctaagggagaagaaaggaatggaaggtggaagcttgcccatagtgaaggaggtaagcccagagaaaagagtagagacacggagaaggggtggggggttcttgccctccagaaaagcagagaaggggttggggcacggaaataagggattggggcacagagatataagagattggggcgcagaaataagggatcggggcgcagagatacatggggttggggtacttacccctcccctagaaaagcagagaaggggtagagacacggagagaaggggttggtgtacttgcctctccgccagaaaagtgggacttgccgctaagggtgaaggaccaaggcaggcgtccctgcatggtctgacacctttgaaacgtgggtaaataatcaggcgtccctgcagtgattaaacaccaagggaaggctgccttcccagtctctgaccggcgccggagttttgagtccacagataaaatgtgtctcctttgtctctaccagaaaatgaaaggaattgaaattaagggagagattgaagtgtttcatgcgcgtccgtgtgaagagaccaccaaacaggctttgtgtgagcaacatggctgtttatttcacctgggtgcaggcgggctgagtccgaaaagagagtcagcaaagggtggtggattatcattagttcttatgggttttgggataggcggtgaagttaagagcaatgttttgtgggcaggagtggatctcacaaagtacattctcaagagtggggagaattacaaagaaccttcttaagggtgggggagattacaaagtacattgatcagttcgggtggggcagaaacaaatcacaatggtggaatgtcatcagctaaggctatttttacttcttttgtggatcttcatttacttcaggccatctggatgtatacgtgcaagtcataggggatgcgatggcttggcttgggctcagaggcctgacattcctgccttcttatgttaataagaaaaataaaatagtgttgaagtattggggcggtgaaaatttttggggggtggtatggagacagaatgggcgatgtttctcagggctgcttcaagcgggattaggggcggcgtgggaacctagagtgggagagattaagctgaagggaggtcttgtggtaaggggtgatattgtggggatgttagaagaaacatttgttgtatagaatgattggtgatggtctggatacagttttggatgaattgagaaactaaacagaagatccaaggtccaaataaaagaaggagaaaaatgggtattaaaggactaagaattgggaggacctaggacatccaattagagagtgcgtaagggggttcagcgtaattacttgcttggttggcaagtttttgggctctatgcttgagtttttttatgttgtcatacatcaggccagattgatttaggtaaaaacaacactcttcatttaagaatatgcagagtcctcttttttcaacagtgagtaagcaaggcctcggtggttttggaggacaactgcagctaaagagtcaacttgggcctggaggactgataaagtttgtgacatgtctgtgatgctagcagagaagtcattagacaggctacggaaggtcatgacagaggttgaaatgcctgctattccagtaccgagagcaatagtggaggcagaaagtcctaaaccgaccatcaagggaattagtggaatgactcttctttgttgtgtcggtgtcatgaggggaacagggagctcttcgttcctatttgcaaattgaattttgggagtaaggaagactagtgtgcatgtgcctgtccaattagcaggtagacacatgttaggtaaaggatccacagaggaagaagagaccttgtgcgaggcaaaactggagatgtaaagtaaaaagatgaggagtgctgcaaggggtgtcttgtacctagagtcctagggatccagctagggcggcagctgtcagaggttgtaatggggactgatggggtaactgcatagagggggaggttcgattttcatggtgtatgagaaaacgttgagtatctacaagcaacctttcactattattttcggggctgggtaaaagtaaacaagaggagggcctgggaggaagagtctgatgagcaaggggaaagtagccaaggatggagtgaaatacagggcaagtgtcttcctaagcaataattactgctaatgtttttaagtttgtcagtattgatagcgggcttgtctgtaatatggagctggaaggctcccattgtttgagtgatgtgtgtagttggactttggagatgaagagtaaaggaacatcgagaaggtgaaagattacctaggggaattccagtgggtctttgccgagagatacatataggagcggccacaggcatagtagtttgtgttgtgagaggtccgaatatggggggagaaaggagaaaggagaaaggttttttaaataagtgtgaaggagggcggcagcttgctgatgtgaaatgtctggggaagtcttgctggacctgtctagaaagtaaatgagttcttcaggagggtaaaggtgagggctgttacaggaagttcggaggtgtagggagatgggagatgttgcccagtctgtctgtaaggtggggacagctgtgtaggcactggaagaaagggaaatgcaaagccagcagttgttcactaaggagggattagaagcggctaggagagaatgggtaaggttgatagtgtggtggagatagctggggagaggtagagggtggcataagaatgggaatgagaataagagtgagtataaaagtaaagaatagaacttcatcagggtggaaatattggagggtgccttgccagcaaagatcatctatccactctaagagggagttaagagtggcagtttggggatagcaccaagagatatcagctgtgatggcttgaagaaacagtgtaaaccggccgtgtaaacaagagtagggcatttataagtagttgagaatggagaataggagtatgaccagacagaagatagtagggatgactagttttttggggctcggcctaagtggtgggggtgacttcgtaaagccctgttgcaaaaagtagggtaaggacgaaaaacctaatagaatgaagggatgtattaggctcataagggttatgactgttcttcgaaatacgactgagtttaagggaagtaggggagagtacttgcaacttccaggaggaagaggagggattaggctggctgtccgatggacacagctttattctggaacggtgagcctagtggggaggatcctgcaggcggacagcagtcggggtactatagatgactaagtagggtccggtccatcgaggttgtagagtttgaggagtcagattaacaagaactgatcgtccagctagggtgtcttcatatggctggggatctggagtaggcaagagaagcttagcagcctggcgaatttcctgtctagcctgctggaggactggaagacagtcgcctagagggctggtgtctgggatgaggttggggccaagcaagaaagtgcgtccatataaaagttcaaatggactgtacctaccctgtagcatctcgagaacaggctctaattctgagaagagcaagaagtaaaagtactgtccaatcctttttaagttggaggctgagcttggtgatgtgtacctttaaaagaccattagtccgttctacctttcctgaagattgaggactgtaagggatatgaaggttccactgaatactaagagcctgagaaactgcttgggtgatttgactagtaaaggctggtccgttatcagactgtatagaggtgggaaggctaaactgaggaattatgtctgacagaagggaagaaatgactgcggtggccttctcagaccctgtaggaaaggcctctacttatctagtgaaagtgtctacttagactaagaggtattttagttatctgactcggggcatgttgagtgaagctaatttgccagtcctgggtgggggcaaatcttcaagcttgatgtgtagggaagggaaggggcctgaataatccctgaggagtagtagaatagcagatggaacactgagaagttatttccttgaggatagatttccacgatggaaaggaaatgagaggttctaagaggcgggctagtggcttgtactatagcatagcctgcctttgctgctatgtggcgattaggcctggtggaaccgccatcaataaatcaagcgtgatcagggtgaggaacaggaaagaaggaaatatggggaaatggggtgaatgtcaggtggatcagagaaacacagtcatgggggtcaggtgtggtatcaggaataatgtgggaggccagattgaggtccgggccaggaacaatggtaattgtgggacttaacaaagagtgagtacagctgaaggagccggggagcagaaagtatatgcatcaggtatgaggaagaaaatggattttggaagttatgagaaatgtagagagtgagttgagcatagtttgtgatttttacggcctctaaaagtattaaagcagcggcagccgctgcacgcagacatgagggctaggctaaaacagtaaggtcaagttgtttggacagaaaggctacagggtgtggtcctggctgttgtgtaagaattctgaccgcactaaccatgcctaggaaggaagggagttgttgttttggaagggattgaggtttgggagattaatcagacaagatcaacaggcagagcacgtgtgtttttatgagaattatgccgagataggtaacagatgaggatgaaatttgagctttggagggggatacctgatatcctttggagagtaaatgctgaaggagcagaagtgtgtcttgttgagaagattcaaaggaggggctacaaagaagaaggtcatcaatatattaaataaggtgagaagcggaggggtggaaagaaagtagatcatgagaaagagcttggctgaagtaatgagggctgtccctgaaaccttgtggcagcacagcccaggtaagctgctgggactgatgggtgtcagggtcagtccaggtgaaagcaaagagaggctgggacaaggggtgcaggggaacgctgaaagaagcatctttaagatcaagtgtggaatagtgagttgtggaggaaggtattgaggatgaaagagtgtatgggttgggcaccacagggtggataggcaaaacaatttggttgataaggcgcagatcctgaactaatctgtaagacttgtccggtttctggacaggtaaaatggggggattataagaagagtttataggttttagaagcctatgctgtagcaggccagtgataacaggctttaatccttttaaagcgtgctgtgggatgggatattggcgttgagcggggtaagggtgattaggttttaatgggatggtaatgggcatgtgatcagttgtcagggaaggagtagaaatgtcccatatttgtgggttaaggtggggggatatgagaggaagacgcaaaggaggctttgggttggggagaagggcggcaatgagatgcggctgtagtccaggaatagtcagggaagcagataatttgcttaaaatatctcggcctaataagggaactgggcaggtggggataactaaaaatgagtgcttcaaagagtaatgtctaagttggcaccagagttggggagttttaagaggtttagaagcctggccgtccatacccacaacagttatggaggcaagggaaacaggcccttgaaaagaaggcaacatggagtgggtagtccccgtttcgattaaacagtgggtggacttaccctccactgtgagagttacccaaagcttggcgtccgtgatggtctgggggcttccaaggcgattgggcagcgtcaatcttcagccgctaagccaaggagtcagtcagagagccttgggccagagttctaggggctctgggagtggctgccaggtgagttgaacagtccgatttccagtggggtcccgcacagatgggacacggcttaggaggaatcctgggctgcaggcattccttggccctggtagtcagatttctggcacgtgtagcaagctcctgggggaggaggttctggaggaacgcctggccgctgcggttcaggcatttggaagttcttgtgtgctggagatgtggctggggtttgtctcacagtggaggcaaggaattgcaacttttttctattattgtacaccttgaaggtgaggttaattaagtcctgttgtggagtttgagggccagattctaatttttggagttttatttaatgtcgggagcagattgggtaataaaatgtatattgagaataagacggccttttgaccttttagggtctaggggctgaggaagaattggaacctagctcggcctggcgaggaggggagaggtcagatgggtctgtagaaaaggaagattagaaagactcagcaacgcttggggttgggactgaggggacaggcgggagggaaagaaggaagatttgggacgagttgcactgggcacagagactaggaagggactgatgtgtaaaagaatgcctggacatcaggcacctcagactgtttgcccattttacgacaagaattatttagatcttgcaggatggaaaaattgaaagtgccgttttctggctatttggaactactgtcgagtttgtattggggtcaagcggcattgcagaagaaaataaggcatttatttaggttttaggtcaggtatgagttgaagaggttttaagttcttgagaacacaggctaagggagaagaaggaggaatgtaggaaggttgcccatagtgaaggaggcaagcccagagaaaagagagcgtagagacatggagggaaggggtttgggggttcttaccctccagaaaagcgggaaaggggttggggcatggaaataagggattggggcacagagatacgagtttggggtacttgcctctcccccagaaaagcgggacttgccgctaagggtgaaggagaaggggttggggggttcttgcccctgccccagaaaatcagagaaggggtagagacacggaaagaaggggttggggtccttgccccttcctcagaaaagcgggacttgccgctaagggttatggaccaaggcaggtgtccctgcgtggtctgacacctctgaaacgtgggtgaatgatcagaggcgtccttgcaatgattaaacaccaagggaaggctgccttcccagtccgtgaccggcgccggttttttgggtccacagataaaacgtctcctttgtctctaccagaaaatgaaaggaattgaaattaagagaagggagagattgaagtgtggcgcctagattgaaaggagaaagacggtgagggatagggaggttggagaagagagtaaaaagaggctgcttattggatttgaaattggtgagatgtttcttgggctggtgggtctgaggacctgaggtcgtaggtggatctttctcatggagcaaagagcaggaggataggggattgatctcccaagggaggtctcccgatctgagtcacggcaccaaatttcatgcgcgtccatgtgaagagaccaccaaacaggctttgtgtgagcaacatggctgtttatttcacctgggtgcaggcgggctgagtccgaaaagagagtcggcaaagggtggtggattatcattagttcttatgggttttgggataggcggtgaagttaagagcaatgttttgcgggcaggggtggatctcacaaagtacatcctcaagagtggggagaatttcaaagaaccttcttaagggtgggggagattacaaagtacattgatcagttcgggtggggcagaaacaaatcacaatggtggaatgtcatcagttaaggctatttttacttcttttgtggatctttagttacttcaggccatctggatgtacacgtgtaagtcataggggatgcgatggcttggcttgggctcagaggcctgacagtaggtgttctagaaaggtgtgttgtgttaatgtgtgaatactgactcccctcctcagtcactgaggcggggagggtgtttggctcttttgaggcatgtgagagttggttgtgcctttggttttttgtttgtttttttttcttttgagtctcgctctgttgcccaggctgaagtacagtggtctgttcttggctcactgcaatctccgcctcccaggttcaagtgattctcctgccaagcagctgggattacaggtgcgcaccaccacacccagctaggttgtgcctttgttaggttctctgtgacttttacccactgtgccattcctgaaagaaatctttttttttttttttttaattagaagaattactggaactagcttggcactgttggacacagtctttgtctcagctactcgagaggctgaggcaggaggttcgctcgagcccagcctgggcaacatagcaagaccctatgtccgaaggaaaaaaaaggcaaaatcagaattaccagaactgatttcacatgtgtaggtagcagatggtggccatgcaattcaggtctgtctgaaggcccccaggcctggtacaaaactgtgtaaggccagtacaaggccctgacaggttcccaagtggctggactggaagagatgccaagttcatggcctcctaacctgactccacccagcactccctgggcccagcgacgttccctcctgaagcctgaaattcacctccacctgaggaggccatctgcctggggataggttcttgcaaaaatgaaaacactcatttccagaggcaattaattcttttaaaggatgtcagatttttggtacaaaatcatggtttccacgttggcttcatgctcggtgctttatgagaaaaatcccttttttctacggttgtgttcattgtattgtaaagcaatcgtagattattttaaggttttgagttagagtgattatccaattttatgagggaaataaaggaattccatgagaaaaacgggggctttcctgcagggctcggggttgcgggagcggcagataacctgattcattaacgtgagcccagtgggattggtgggggtgatggggacacagatgggagcactcaactcaggcacaggaccccagcagaacatgcccaggtcctcctagacatgggcccttgcagactttctgaggcctcggtttcgtcatcttaccaaggtgtgaccccaaccatcatctcctgaacttctggccacagagctgtgagcaagcttccatcatgaccccattttggagatggggagttggcgcagccacactgctgctcagtggtagaaccagcatctgacccaggccacctgttccagagaccctgcttttagccagcagctcagaccccagtcatgtggggccatttatttatttatttaagatagagtctccctttgtcgcccaggctggagtgcagtggtgcgatctcggcttactgcaacttccacctcccgagttcaagcaattctcctgcctcagcctcccgagcagctgggatttcagacgtgcgccaccatgcccagctaatttttgtattttaagtagaaatggagttttgctgtgttagccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacgctcccttgtgacttgttagaaaagcgtaggtacagctaaaaaaaaaaaaaaaactgatggctgtgagaatactgtcactcgctgatgccttctgtgtagaaaaataagccttagacagatcttcgcaagaacatcgtgatggctctcataggcataattacgtgttccaagccaaattgcagttcaagagaaggttataaatctcttcttaataacaattgtactcacgttcctctcctggaaactaagaggaaggtagctgaagaaactctccctgcccagttaaatcttgttttttgggtacttttggactccagggtcacatcagcaatggcccgggacagacgagggggagccttcatctgtacttcgtgtctttccagggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttcctgtttctca

SEQ ID NO: 2694 - DNA, 44829 bp, Homo sapiens
  source 1..44829: mol_type = genomic DNA
tcctaaagtttaccataattttattgtaatatcagaatcacataagatatagagttaagcagaaaactgatgaattttcttcagatgatctttaagaatctcaaaagccttgaagtttgctgaaaatagaaaaaaaaattaaatatttggaaacctaagttgtatacttactaatagttgtagttaatttttttaaataggtatagttaattgatttttaaaaacaggtcaatacatacatactgtttcaaattcaaaaggagactctaaaaaataagtcattctcatgcccccttttctgctcccaaaaagcaaatgtatgtctttttttttttttttttttttcgagagggagtctcactctgttgcccaggctggagtgcaatggcgtaatctcggttcaccgcaacctctgcctcctgggttcgagtgattctcctgcctcagcctcctgagtagctgagattataggcacttgccaccatgcctggctaatttttgtatttttagtagagacgaggtttcaccatgttggacagactggtcttgaactcctgacctcaggtgatccacccgcctcagcctcccaaaaagtgctaggattagaggcatgagccaccgcgcccggccaacaactatatgtcctttataaaggtagactaatttttaaaaaaagtagccgggcgcggtggctcacgcctataatcccagcactttgggaggcagaggcgggtggatcacctgaggtcaggagttcgagaccagcctgaccaacttggagaaaccccatctgtactaaaaataaaaaattagccaggtatggtgacgcatgcctgtaatcccagctactcgggaggttgaggcaggagaatctcttgaacccagaaggcggaggttgcagtgagctgagattgcgccattgcactccagcctgggcaacaagagcaaaactccgtctccaaaaaaaaaaaaagtattctaatcatatataagcacatgtatatgtgggcttatgctttaaaaacatacagaagtgataggatattatgcatactttctacaccttttttccattagtagtaaatacattatatttacttctttgaggcttagaaatttaagtaaatcagaaagttctgaataagtacaaatatttagatatatatacatttttaaaatttcttggtataaaaactgcagtaaaaaggctgggcgcagtggctcatgcctgtaatcccagccactttgggaggccaagaccggtggatcacctgaggtcaggagtttgagaccagcctggccaacatggtgaaactccatctctactaaaaatacaaaaaatcagccaggcgtggtggcatgtgcctgtgatcccagctacttgggaggctgaggcaggagaatcgcttgaacccaagagatggaggttgcagtgagccgagactgtgccgctgcactctagcctgggcaacagagcaaaactccgtctcacaaaaaaaaaaaaaaacactgcagtaaaaagccagctgtacctatacatgatgtacctacttgtatgcataggcttaagtatacctatagaataaattcctaaaagtggaattgttggtgtaggcattaataaatcttgtcaaattgccctccataaaggtttctgccatttttcattctgaccaactacatgtgagaatgtgtatttcctccaaaacatcaccaatattgtgtttttaaataaaactacttgaaagtcatgtttaaacagggttaattttatcaactttgactacatttctgtgactaattccacaatatgatttcacaaatattctaacagaaggcttcttaggagaaactaagtggcaagaaggccagattatttcaatatatcttgaaacttttctgttttcctaaaacataaacttacatcagtttgtttgatctagcattgaaaagattccccagttaccaatacaaaattatagtttggaaattatgtcaaggctttcagcatctgaggccacagcagataaaggaagcaactatttcagtggacaaagagtgagcatcaactgcaagtaccatgagacagggtacttgacagctgtcacccaggctggagtgcagtgtggaccaatcacagttcactgcaacctctgactcccgagctcaagtgagctcaagtgatcttcccacctcagtctccccagtacctgggactacaggtgtgggccaccacacccagctaattttttgtatttttttgtagagaacaggccttgccatgttgcccaggctggtcttaaactcctgacttaagtcatctgcctgccttggcctcccaaagtgctggattacaggtgtgagccaccacgaatggctgcagactgttttatgtctacaagttttatgccaaatgttatttcagtaaaagacattctaacagtggataagactgtatgctccaggctgacagccctcagagttgacttagtcctggggtcacaaaatcaagtgccctcaggatatccagcgtagacaagtgggctggaaaagagccacagcgtctggcctcctttttaattttatatttataagcatgttttgaaaattattcattttatattcacttttattttaaataaatatgttaattccaaaaagaaaaagacaactgggctgtgttcaagattatattctctgacaataacctggaggggagttacttgatttggtcagttgtttttttgttggtttttttttttttttttttttttttttttttttgagatagagtctcactctgttgcccaggctggagtgcagtggcgccatctctgctcactcaacctgtacctctcaggttcaagcaattctcctgccttagcctccttctcctgagtagctgggattacaggcacacgccaccacacccgggtaatttttgtatttttaataaagacggggtttcaccatgttggtcaggctggtctcaaactcctgagctcgtgatccacacacctcggcctcccaaagtcctgggattacaggcatgagccaccgtgccctgcctgggcacttgttcttaaccagtggtgggaactttttcaaaatacagttatctgagaaatcacatgttaggatgcctgaaattacaggaaataatatttaaaatgcctattctttacaattagaaagtcatttgatgagtctggggcaaaatcctaacttaacatttttaacaaggaccccagaggattctgatgtgggtgatctatgtagatcaccctgtgaaaactactacccactaggtgattattttcttctttctcaagacctttccgtaactccaaccccataccatcaccaaactcacacacagctccctcactgtcaatttaagggaaagtacctaagaagcaaccatacggagggcaggactgacctctcagaagagtgagaccatcgtcaggagttggcctgtaagagaactagctcacctccacagctggcctgagatttcccccagaaaacagttcttgatctatttcaacacaaacgtaccatcatgtacccacaattctgtgtcacacagcataaccgtgataagctcagccaataatatttctttatgggccactgtagacattttcaaaaatcccaacacactgatagaacatctcattttcagtaatttaacacctagagaaagatctttcttgctgtgtctgtgcacacacttacctatcttctactgtcttattagaaggataaaaaactttgaatgaaaatccacttcttggaaaagagccctttgggggagaaaaatgcctgtaagtgaatgctcagacttttttttaaaataaatttttttaaacacaatatgtatattttttattttttattttatttatttattttttttttgagacatggtctcactctcatcacccaggctggagtgcagtggggcaatctcactgcaacctccatttccgggattcaagcgatcttcccatctcagcctcccaggtagctgggaccacaggcatgggccaccacgcctagctaatttttgtattttttgtaaagagggacagggtttcactgtgttgcccaggctagtcttgaactcttgggcacaggtgatctgctcacctcggcctctcagagtgctgggattacaggcatgagccaccgtgcccagccgaatactcaagttttataaaataattcctgttttttaaaagtccttggttgtgacttaaaatgacaagatgtgactataaagtaacacaacagatttttacacgatctttttacagagttgttactataaaatatctccacttgaagcaaaagtcttttgagttggctagacagtcttaatgctaaaagatgaggttggaaatgcttaggaggagctctacttagtgtaaaaaataaacagactgtgtaacgccaaatatgcatgtgagacaatcagcaagttcaagaagtctttcctgcccctctctctaatgcaaaactgatttgcattcctatgtacctgtttgattcccttcctatgtgcctgtaaagcaactgagcaataatcacacatacaattgtttgtctactatgaaactctcacgtggctgagcagaggccctgtcttttcagtctttgtgccccaagcaccgaacccaacacctagcctatggcaggcattcgttaatgtgaataaatatcaagaaaggatgaagtaatgtctaaggctagttttgagcttgcccaaaaggtataaataaggtaaaaaagatataatgatggtgtaggaggtggtggtttactcacagggatgaaaaagtagaaaaattcagaaataaggtatattcaaatagagcattaactaggagaatgcccaaagtttaagtaaggaaatagcatcaccatgaaagactatttcaatgtgaataaaaatcaggtcataaatttctaagcaataaaaccaaatcagttaactgtgttcattcttaaagcagaggctcttaaccagggttcctttgtccctcagggggacatttggccagtgtctggagacatttctgattgttacagctggggaatactactggcatttagtggacagaggccagggatgctgctaaacagcttacaatgcacaggatagcccccaccaccaaaaattacttggtccaaaatgtcaaaagtgccaaggccgataagccatgtcttagaagaagctggacaaactgtgtgtttgaggaaagcaaagtagagacaggccctttctatgttgcccatgctggttgtgaactcctggactcaagccatcttcctgcctcggcctcccaaagtgctgggattacaggcccagcatcatgccaaaaataaggcatgatgtttctagaaattactcagatgaaacaaaaaattagtaaagtctaaaattcacaagaatcaaggaagcatgcatattaaaaatctctagtggagataatattttgtttgacataactgtgtttatgtcattgtttatgcagtatttattctccaagttcaaaaagtcaattatatttctttccctttttttttttttttttttttttttttgagacgcagtctcgctcagctgcccaggctggagtgcagtggcgcgatcttggctcactacaagctctgtctcccgggttcacgccattctcctacctcagcctcccgagtagctgggactagaggcgcccgccacctcgcccagctaattttttgtgtttttagtagagacggggttgcaccatgttagccaggatggtctcgatctcctgacctcgtgatctgcccgccttggcctcccaaagtgctgggattacaggcgtgagccaccacacccggcctatatttcttttctttttttttgagatggagtctcgctctgtcgcccaggctggagtgcaatggcgtgatctccgctcactgcaacctctgcctccctggttcaagcaattctcctgcctcagcctcccaagtaggtgggattacaggcgcgcaccaccacgcccagctaattattgtaatttttagtagagacggggtttcaccatgttggtcaggctggtcttgaactcctgacctcgtgatccacccacctcggcctcccaaagtgctgggattacaggtgtgagccaccatacctggcctaaaagtcaattatatttctgcagaaattctgaagcaacctcaagattctgaagcaatttcaaggttctacataaaattaagtaataaaatatgtaccaatgaggtttctatattaatcaggcttagatttttgggacctgtgcaatttccaaaaatcaaaatcattctcaaaggacaagtaccaccaatatgcaggctctgaagcaattcccagaaaggaatcccaagataagttctgaagaggagaaaattactcttttggatttatgttttggtatgcttgtgggtatgcttgtttttttgttttttaagtcatgttactttatagtcactatactgaaagtttaagaactttctgtgtataccaactttctgtgtatagaaacttaattcagtgtttcactaatagcatatttttacttcgacaataatcttattaaatatatatttttaaattaaaaaatgcactctaatcttgataaataatgactatataagattaactacattcttacagggtttatgcagaggcattcggtatttgtcgtagtgaaaggatcatatttgtctgcaatgacaagtagatcgggcacaggatacactctcaaagcatagtcatatgcccaatacactgggcagacataaagaggtaggggagtcagatgtccttgggataagatagtctttacaaactacaaaagagcacaaaacaaagcaaacttcagttcatttgcaaaagtgaaaatagctaaacaaataatttcaaattaaatattaattaccaaaaggaaccagaaaatttgagaaactaggaaagctttgactcacagagctttgggagacactaatttaaaagtgaaataaactattctgtattttaggaaaaaaaatctatgagttttcatttaataacatatacatcattatgctgcccaggctggtctcaaactcctggcctcaagcaagccacccaaagtgctgggattacaggcataagccactgcacctggtccataaactttaaatattataaaatgaataataaaaatgctctgtaacatctatttccgtacttctcaaatgggggtgtatgtaacctgtgattgacaactattgtcagggaacctcgaagctacaagataaatactgcacattcttgtgatatggacatactatataaaatatgtaaccaatgggataaataagaacagtttattaaaacaaatatacatatattttcaagtataatttaagagtttaaaaggcaaaacacgaagcttgaaagaaatttcatgcttattctcagcttttctctgtcctctaaaggacatacacttaggtagaaagctgagaaacactgacttcactaacaaaaattaacttactgacaaaagtacgttcaaactattttgaaccataaataaatgtcctaacccaaggacaaattattaagtggcttaataaaattttatataatgcaacatgtaaggcagtttaataaaaaagttgtttcacttacgtgattaggaatagccaaattgctgctaggaaaacggacgcagtttctgcacattttatttactaagtcttcacggaagacagtaatttcctgtgtacagtactgaattctgaaatgaaaacagtagttgaatttgacttctcagaaaaaaatgatattaattttaaaggtaaaatctcttacaatacaaccccattcccacattcactgttcaccacacaaaacttcaaccagagtctgtctattcatctattcatttaacagctatgtattgagctcttaatatatgcctaccccattctagggattagcgaacagaaccaaaagatcccagccctcatacagtttacattctagtagggggtggggctgagaaaataaaaagcgaacataatcatatagtatgttttaagataattaagcataagagaaaaagaaaaagacaggctaagagggacagcatatgtggtaagagagagcctagaaggcgggcatattaataggatgatcagaacaggccgggctcataatttagtgtgacttgagcacaggcttgaagcggaagagggacttagtcaagcagatacccagaggaagcgcactgcaggcaaagggaacagatggagcccaggccctcagactggagctcgcctggcatccttgaggaacagaagggaggctagtgtggctggagtaaatggggaggagaggaaatcagagaggtaacggagccagataacacagggccttgattaccactgcaaggatacggctgtcactaaatcacgaggggtccctttttccaatgagggtccctttttccaggatcgggaaggtggatgggatatgccttatgctttacaggatcactttcacactgcgttaagaatagaatacggagaggagaatggcatgaacccgggaggcggagcttgcagtgagccgagatcgcgccactgcactccagcctgggcaacagagcgagactccgtctcaaaaaaaaaaaaaaaaaaaaaaaaaaaaaaaaaaaaaaaaaaaaaaaagaatagaatacggaggggaaggagtaaaagctggagaccaattaggaggctattgtaataatccaggccgagaagatggcagagcagggctcctcaacctccaggccatggactggtaccagtccatggtctgttaggaactggaccacacagcaggaggtgagcagcaggctgcaagcaagcaaagcttcatctgtatttacagccactccccatcggttgtattacatcctgacctctgcctcctgtcagatcagcaggggcattagattctcacaggagcacgaatcctgttgtgaactgtacacgtgagtgatctaggctgcacactcgttataagaatctaatgtctgatgatctgtcactgtctcccatcatccccagatgggaccgtctggtttcaggaaaacaagcttagggctcctactgattctatattatggtaagttgtataattgttttattatatattataatgtaataataatagaaataaagtgcacaataagtgtaatacgcttgaatcatcccaaaatcacccccaccccccctggcgtctgtctcccataagatcagtccctggtgccaaaaaggttggggaccactgtggtagagggttgtggaggtagaggtatagagagagagcagattctggatataatttgaagttaatgggacttcctgaaaaaacatgtgagagaaaccccaaagtgtttggcctgaacaactggaataatcattgttcagaccatgaaggtgtcatgaactaacatggagaagtctacagaagaggttagggacactcgtggggaggaagatcaggagttcacttaggttgggatggtgataagtaggcaactggatacctgagtctggagtttggaaggtaggttgaagtggaaatataaatgtggaaggtgtcaatacacagatgatacttaaagccagaggacactggagaaggccagcaaaggagtgaatgtaggcagaaaagaggcgaaccaaggctgcctctgatggtattcccacaggaagaacttatgattacaatgagcaatacgaacagtaaataagtaatctttgtattcttcctttgtaacctttcttaaaggatatgtagtaataatatctatttttaaactgctatccattattcaagagtctgaattgactaccaataaattatttaaatatagttaaactattttcaaagttttgagaaacctaaaacaaaaataaattttcttcttatatttattccataacagtcgaaattcagagacacattttaggaatcaagttagtttttttgttttttgttttttttgtttttttgttttttgtttttttgagacagggtcttgctctgtcgcccaggctgcaggctggaatgcagtagtgcattctcagctcacagcaacctctccacctaccaggctcaagtgatcctcccatctcagcctcttcatagaaccacaggcgcgtgccaccaagcccagctaatttttgtactttttgtagagatgggtttcactgtgttgccaaagctggtctcggaactccaagcaacctgcctgcctcggcctcccaaagtgctgagattacagacatgagccaccacacctggctaatttttaaatgaaaggaaaaatgtataacacaaaatactaattcttacctgcaaggattagtagtaaaaactgaaaatggtaccctttgtctgaattcattagtgatgctttcagcaagtggtggcctataaaaacaatttatgtgatatagtttatctttttaagttttacaaaattttctacactgttgcaaaaatctgaacaaaacttaccttggtaagatggaaccaaatccaggatcctctggaccaggtacaaacacaaaacgactactgtagcaaaattcaacacaattcatttaaaaatattattgtaacactatccaatagcttaaaagcaagttattccctttgttttctctttaaaattaaaaaacatttaaatttcatgcattataataaatgaactattaagtctccagaccaacactgtctagtaatgtcatgatagaaaagttctatatctgcactgcccaattgaacacttgaattgtggctagcatagctgatggactgaattttatatttaaatttaattaaacttagatttaaagagacatgtggccagtgactatcatatcggagagtgaagctctagactcttaagagtaatgccacgaagaaattccaagtatggctgaaattacctctatccctttcaatacttttcattataaacctctagtacaatgtgaggataactttatctcttagttcttttaattttctcaactttatctttcttccttagttttgtaataattgctgatataacaaaattcattttttgttttttttttaagtaaaacggtgaaaaaatatatagtgctagagatcattacctttggtgaatatctgggtattcacatattatatctgccaaagtttttagggaatctaaaattttaaaaaggtattgaattaaatttgcatataatgccataaaattatatttgattagatacaatcctgtatattcttaattaaaatattatggataatttcttattactttagtttatatgactatagaaacacttcttattaaatagatcgttaatacctttcaaagcttgaacttgattttttccatatggtgcagatgaaaaattaccacacagaataaagcaggttggaggtgctggtgaataacctaaacaataaaagagtaaatgaacaatacttttctagtctacaaatcaagttaaaaaccctttaaccatgactttctaataataaaaatttattttaattaaaataacattttaataacttattaaaataatactaataacagtagccattcattgagcacttactataggccaggcctgcattggcttaattactcctcagaacatccataaaatctgagacttaggttaagtaacctgcccagggtaataggcttgcacttaaacccagtttgtttttgtttttgtttagagatggggtctcactatgttgtccagctggtcttgaacttcaggactaattcttacttatcatgactataaacacacacacacacacacacacacacacacacaggtttttttcttaatgtaaaaatttaagtctttaaaatgaaatctaatttaaattatctcattgctaactctgtttttttttaaatagaatactcaaaaagataaatagaatactcaaaaagttttaaaacatgaacccttaaaagagttcaagaaagaagaaaaaaaataagacctaccagcaaacattatgcgaagtttttccaatacttccacctggtccaaccaaacatcagataaaaacacaaacatagcatctttattctcctcttctagctgttttagttttgcagaagtcttcacagatgtattagaaggacctccaaaaaaattaatatttccatagtatgccctagataattataacataattatcttctatataccactagagatatttttctaatagttgtatacatttagcttctttgtatctaatgaagttattttccagtgtaaaaaggtactctttgtaacactttaaaagtacaaaggttatctaaatattctaaaacaagataagcaatatggaagcagtaaataaaataataggctatatctgtgtcttaaaactgactaaacggccgggcacggtggctcacgcctgtaatcccagtactttgggaggccgaggcgggcggatcacgaggtcaggagatcgagaccatcctggctaacacagtgaaaccccatctctactaacaatacaaaaaattagccgggcgacgtggcgggcgcctgtagtcccagctactctggaggatgagacaggagaatggcgtgaaccccggggggcggagcctgcagtgagccgagattgcgccactgcactccaacctgggcgacagtgagactcttgtctcaaaaaaaaaaaaaaaaaactgactaaagcaaacattaaaataataatttcctatgtcactgaaagtagaagaaatgagtacaccatttgaacaatatctcatagaaacctcaaaatatgtgctaaccatctgcccaagtaattctacttctggaatggctaatcctaaggaattaaagatatatacaaagactagcctatatccaagaactgtgaaaaaattattcaacggttccttcaaagcttggttttattcaatgctcaccaagcaagggtcagtaggaaagtgggtaatctacacactcccagcctccaccactcttgcccactctacactgacatcctgcagttcccagcttaaatgcaaataccccataggcctcctctgaggatcccaaaagaggttagattttcccattatacactctcataggaacctgtacttctcctttgcagatcttatcaaatttgtaatcaggccagggtggctcacacctataatcccagcactttgggaggccgaggtggggggattgcttgaggtcaggagttcaaaaccagcctgaccaacatggtgaaatccaccccatctctattaaaaatgtgaaaattagccgggcatggcagcaggcacctataattccagctactcgggaggctgaggcaggagaatcgcttgaacctaggagatggaggttgtagtaagccgagatcatgccactgcactccagcttgggcaacaaagcaagattttgcctcaaaaaaaaaaaaaaaaattgtagtcagccaattgtaattgggcgattgtttcatgtctgtctccccacctagtggcaatacagtatgtgctcaaaacatatttcctgaatgtcacgaatcatgctataaaacaatatttcacagtaatagaaaatgttgatagcatattattagatgaaaaacacaggttacaaagcaaggtacagtatgtatccatttataatgccaaaaaaagggaatagatatagacctgtgcattcatgcataaaaagaaactctccagatatacacatacatatcttgttatagttgattccttttttttttttttcttttttttgacggagtctcatgctgtctcccaggctggagtgcagtgctgcagcggtgcgatctcagctcactgcaaccttcatctcccgggttcaagcaattctcctgcctcagcctcctgagtagctgggattacaggcacatgccaccgcatccagccaattttgtatttttagtagagatggggtttcaccatgttggctaggctggtcttgaactcctgacctcaaatgattcaccctcctcgcccttccgaagtgctgggattacaggcatgagccaccacgcccagccagttgattcttgttattagtgatattatgttctataaaatctccacaaacaatgaattggcaaacactgaaccattgctccttgggaaaatttgtacttatatatacatggattgattatagtcttaagtcctaaaaccaatttatcctggtagattctatttttacaaatgagaaaagttggttcagaaatgttaagtgacttatctgaggttgctccaaaaacaggtgccagaggtgagattcaaatgccccctccccacacaaaactggccccagggccagagcttcttgcactaccctgtactgctccctgcagtctctgtcctctggtcatctttttttttttttcttttgagacagagtctcgctctgtcccccaggctggagtgcaatggcatgatctcggctcactgcaagctctgcctcccgggttcatgccattctcctgccccagcctcccaagtagctgggactacaggcacctgccaccacgcccggctaattttttgtagttttagtaaagacagggtttcatcgtgttagccaggatggtctcgatctcctgacctcgtgatccgcccgcctaggcttcccaaagtactgggattacaggcctgagccaccgcgcccggcccctctggtcatctcttaatgaggctgaaacaagaaggcagtatggcctgttcgacttcagctgggaacatgcatgccaggtgactcaaaattttttgctgttctgctaagcataaatgaccactaaagcacctttagtattgactttaggaggtacaaaaacattttagcacaaatctgtaaattaatgaggatctactacatatggactgtcatgcacggcataaaaacgttttggcaatgacggactgcatatatgagtggtttcacagaatgataatggaactgaaaagctcttattgcctactgacatcttagctgtcacaatgtcctagtgccacacattactgtgtctgtagagacactggtgtatacaacctactgagctgccagttgtaggaaagtacagcacatataataatgtacaatatgtaacacttgataacaataataaatgactatgttactagtttatgtatttactgtacttttaatcattattttagagtgtagtccttctacttttttttttaactgtaaaacagcctcaggcaggtccttcaggaggtccttcaagaagaacgcattgttactacagatggcagctccatgaattattgcccctgaagactttccagtggacaagatgtggagatgaaaaacagtgatactgatgattctgtgtataggcctaggttaatacacttgttttagtttttaacaaaaaagatttttagaaaatataaagatggaaaaaagtggctgggcacagtggctcatgcctgtaatcacagtactttgggaggctgaggtgggaggattgcttgaggccaggagttcgagaccagcctgagcaacatagtgaagacccccaccaatccctacacaattttttttttttaattagcagtcttagctacttgggaagctgaggcaggaggaacacttatgtccaggaatttgaggttgcagtgagctataatcatatcactgcattccagcctgaagaagagagtacagttgtatcagtaaatcaattaatcaataaaagaaaaaagctcacaaaatcaggatacaaagaaacaatttttgtgcagctgtagaatgtgtttgtgttttaagctgtttattacaaaaagagtcaaaaatttaaaattttttaaaggttataaagaatgttatagtaactaaagttaattaattttattaaaaaatttttatttcaagacagggtcttcctttgtcactctggctgaagtatagtggcacaatgataattcacagcagcctttaactcctgggctcaagcaatgctgccacttcagcttgccaagtagctaggactacaggtacacactgccacacccagctaattttgttgttgttgttgttggtagagatgaggttttgttatgttgtctagactggtctcaaactcctggccttaagcaacactcccttcagcctcccaaagtgctaggattgattataggtgtgagccactgtgcccaggctaggttaatttcttactgaagaaagaaaactctttttaaacaaatttagtgtagcctaagtatacagtgttaatagcctacagtagtgtacagtaatgtcctaggccttcaaattcactcactactcactcactgactcactcagagcaacttccagccctgcaagttccattcatgataagtgttccatacaggtgtaccaattttatattttataccatatttttactttatcttttctgtatctagagagacaaatacttatcattgtgttacagttgcctatagtattcaatacagcaacgtgtcacacaggtttgtagcacagaagcaacaggctgtaccatacagccttggtgtacagtgggctatatcatctaggtttgtataagtacactgtgatgtttgcacagtgacataatcacctaacaacacatttctcaggatgtatccccgttgttatgcaatacacaactgtatatacatatataaagtaatgttaacagtttttttctgtttagtaaaattacaggtgattttcctttccttttgtgtgccttcatatattttctaatttttttttttgcaatcatgaactacattattaataagaaaaaacttttctttttttaaagactcaactacttttccaatgcagcatactggcttgagtcggaaaccttgggatcaaagcacatctctaacaataaaaagtttgggccaggcacagtggctcacacctataatcccagcctccctctgggaggccgaggccagtggatcacctgaggtcgggagttcaagaccagcctgaccaacatagcgaaaccctgtctctactaaaaatacaaaattagctgagtgtggtggcacatgcctgtaatcccagctacttgggaggctaaggcaggagaatcacttgaaaccgggaagtagaggttgtggtgagccaagatggtgccattgcactccagcctgggcaacaagagcaaaactccgtcttaaaaaaagtttgtgaccatggacaaattacccaacccttcttttttggggggtagggggacaaagtctcagtgtgtcacccagggtggagtgcagtggcaggatctcagctcactgcaacctccgcctccaaagttcaagcgattctctcacccaagtagctgggactacaaccgcatgccaccacacctggctaatttttgtatttttaatagagacagggtttcaccatgttgcccaggctagttctgaactccaaagctcaagcgatccacccacctcagcctcccaaatcgacacttcttaacctaactcttcaaatgcaaaaaaaaactaaactgatatctactgcacagggttactagaaggaatacaagtgataatgtacagaaagcccacagggcacagtgcttagtacggtgtgagcccttagatatggtaactgatattgttattgttcccaccaagtggaccaactggcattttcaaaggtacagtaataattttatagttgctagaggaatgcagtaagtagacataattgtatgatgatttcagttaagcatatacccaaacataaatcagagcatcacagaaacacctattaagctaaatattgagaaattaaacttcagaaaagccttactcacatcttccgtttaaaaaaaaattatttgcattaactacacaatggtagggagggtattgagtcagtgtaaatctctttaggataggaccatgctgtagacctatttgcacttatttgtaaaacagtattttacacataaaacatactcactaaaatattagttgttgaattgattgactaccaccagatttagccccctgaattttatattttgaaggcattttagagaaaatttataatcctaacaagaataaaatgatcattttattttaatgtactttattacacctcataccaatcctttggtttactaagcatatactaagcagttggatttagagaaaatggtataatttaagtggaaaattatttgaaacattataataatgatctcttggctaaagagaaacaaatggtaaactcacagccagccaactcaactatacctctcattccaaagtagtaattttgaagcttgtacaaaacaaaaataccatgacaatggcaattttgctctaaatatattccaaaggaaacttaccatattggaaaaaagccacaaactgcaccaaaagcactcaaatagaggtgagcttggcttgattagggcttgtgttctccttagcaagatcagcacctttccctcagttacttcaacagcaagagtagatgctctgcacaggccgccctgccagtaaactcccagccaggaaatgttgcctttgcaccttgaatttatacaggcatactaaaactaaaatccttgttgttgttgttgagacggagtctcgctctgttgccaggctggagtacagtggtgcgatctcggctcactgcaacctctgcctcctggtaaaactaaaatcttaatctttatgcttccttttgaaatcatcaccattatacagaatctcatggttagaaggcaactactttaattcccccagaggtggcaaactcaaatgcttacaggctccaggaagataacactaaatagcaaagcagcagtccactgacactaactagggcacacatacatgccctgcccaaagtgggcaaccactgcagtttagtttttgctgtgtgagaattcaggctctgtattgccagatcctcctgttaagagaactctgaaacctaggcctttatgagaaatcttctagtttttatacactggaaactaactcgaaatgtttttaaacacctcaaagtggggagaagaaaagaaaggtctataaactactttcaacccatgggacaccaagtacaatttttatactatcattcaggttctgcccaaataattcaagtgacagggagctcagctcctctaagagaaggccattttggaatagctctaatattatgatgctttcacttatattaaggagctataagctacctcacataactttcattcattggaatataaaaatgagaattttatattaacatggaattatattcttctaagtgttatcctagttgtcttatctcacttcaacttctcatcaaccccagagataaaacagactggaaatctttcccagttaaagccgaagtacaaagacggtattgcaactaattgttggccaatctgctagttttcacattacatacaaaacccagtcttctaattctcattttccattgctttttccattttgacacaaagcctgacaccttttagtaactgagatatgacgtactatcttacattcactcctgccagtattaccaaattcccatagagtataaaccaaacattttaatacctagtagtactagagggctcagtgggtggaaatccaaaggcattgacatgaaacacttgatcttcaaaccaacctgaaaaaaagtaacgtcactttcatttgtctaatcctctatgtttgaaaggacaaaattatgttacaacaaagcaataatgccaggctagtctcatgccctgtgaactaattacagaggttgccaacctcaatgaaccacagtgaacaactttagatccacagagagtctcaacttataaaattcattaaatagaaatagattcagaacttttcacttttcagtttggcagtacgtgttgatacagattaggaaatgtttcattttatggccctatataaaattaagtgtttttttcaactttattgaggtatcgttcacatactatacaattcaccctttaaaaatatataattcagggccgggtgcagtggctcatgcctgtaatcccagcactttgggaggctgaggcgggcggatcacaaggtcaggagatcgagaccatcctggctaacacagtgaaaccccgtctctactaaaaatacaaaaataaaaaaaaattagccaggcgtagtggcaggcgcctgtagtcccagctattagggaggctgaggcaggagaatggtgtgaacccgggaggcagagcttgcagtgagccgagatcgtgccattgcactccagcctgggtgacagagtgagactccatctcaaaagaaaaaaaaaaaaagtatataattcaggccgggcatggtggctcacgcctgtaatcccaacactttgggaggccgaggcgggtggactgcctgagctcaggagtttgaaaccagcctgggcaacatggtgaaaccccgtctctactaaaatacaaaaaattagctaggcatggtggcatgcgcctataatctcagctactcggaaggctgaggcatgagaatcacttgaacccgggaggcggaggttgcagtgagccgagatcgcgccactgcactccagcctaggtgacagagtgagactctgtctccaaaaaaaaaagaaaaaaaaaaaaaagggtgtgtaattcggtgatttttagtatattcacaagttgtgtagccattactactatctaatttcagaacattttcatcaccccaaaaagatttctattagcccattaacagtctaagagttattttgccaaaaatatgctcttctaattaatggtatcccaaattatatcatgttaacatattttacccaaagcagaaagttttactggagaatgagaagaaggacagtaacaaagtatactgacttaccttctgctaagacaaagcatgcctctgtgtataaaccactatggaactggtacacaacagttgaggaaaataattctattcttgaggcagtaataaagtcaacatacattttgagtccaacaaggcttctaaataataaatttaaagacttcccatttgaaactgtgaatagaccacagcttagaaagagcttaaaaaattttagttttaaatgtcctcatgtttaattcttggtaatattgacagggtggatcattcttaccatgatataaatttcgtcagtgattcatctagattctccaaataagagaaaattaaagttgttctgtccctgtttaggattatatctctacattcctacaccagcaacatagagaagttacattgagaacccaaataggtaaattttagaaggatatataatcaatttccccaattcacgtaatgcagattttaaaaaatacagacaagtgaaggatatagctttactaaggtctagttggactgttccagtaggatcttccagaaaaaattttccctaaaaaaatgaaaataaataaatccacatttatgtaacaatgaaaaccgttgacaaaaaaattaaactacaagtttgacaacagaatacaatagggagaaagtggattttaaaaatcagctattatttctagtccaggctcttccatttactagtctgataaccccagactaatcacttaactgagattctgactcctcacaggtacaatggagaatgactcctacagataagaaatggcaagagggacatttgatgtctgccataaggagggtctccccaggtaccttctaagacagccaacagcatgtccaagggaccaggacatactctgcagcttgcttgttcagaaacccagtactctccgtttatccagaggtcactacaggcctaatttcaggctatgcaaactgggctcctgcacaagacactctgtcctgatgtcttctcaggaaaccaaacacagatgaaaaagacacttggtgactgagaaaaggtttttgttttttctgggttttttttttttttttttactattacaaaagtttatttaacaaaaagtctaatatgaaaatgtacatgacctaatttttacgtcattgtaaaacaggccctatggagagagaaaatgggtttctctgctgaacagccattattattttatttatttatttatttttgagacaaagtttcgctcttgttgcccaggctacagtgcaatggcaccatctcagctcactacaacctccacctcccgagttcaaggaattcttctgcctcagcctcctgagtagctgggattacaggcatgtgccaccacgcctggctaattttgtatttttagtagagacagggtttctccatgttggtcaggctggtcttgaactcccggcctcaggtgatccgcccacctcagcctcccaaagtggctaggattacaggcgtgagccaccgcgcccagccaacagccattatttatccttgttccaaggcttctgacatgatgatactatttcctcgtattaccactattccaatattgttctgttggtgaggcgagttttcaataaagaatacattcctgtgcccactacaaaaatgttctatgtaaccgacatttcatcaatccaaggccaaaaataaaagtttgatgcttattaagttacctcttttaactgcgttatcattccaagaacaatcgcatctccgattttggttgtactacccaataaggtttctattgttttaagctaaaataaaacaaaataaattttaaagactgtaaatatattctttcaagaaacaaaactttttataaataactatatttggggtatacatttcagcatttatagctactttacagtagaaaatcaaataaaatggaaataaagttgtaaaattaaacttaggatgtttaattttgtcctacaaaaaagctgtaagatcaagtgtatgatgcctaaagaaacaccacatcgactcaggctcttaccaatgactgaatcctcacaccatatcattctgaataatgataagtacatttattttttaaatatagaaaagaatatcaattttattttctttgaacagtaccttttgaaaactagcaagctatttaaaaatatatattccaattttacttagtattttaaaaggctctcattattatttacattctcaatctgatctttttttctaatcagaaagtttaaggtagtaaaaattgggacactattgtaaaaaatcctttccggccaggtgcagtggctcacgcctgtaatcccagcactttgggaggccgaggcaggcggatcacgaggtcagaagatcaagaccatggtgaaatcctgtctctactaaaaatacaaaaaattagccaggcatggtggcaggcgcctgtagtcccagctactcgggaggctgaggcaggagaatggtgtgaacccgggaggcggagcttgcagtaagccgagatcgccttgcattccagcctgggtgacagagcaagactctgtctcaaaaaaaaaacaaaaaaaacaaaaaactttccatctttttctatatgtaatcctaaatatatgtaaatacatacatatataatttataacacacacctatacagtttatttacaaagatgaaatcatagtatatgtactattctgcaacttaactaattgaagttaatattatctgagacatctttccatttttctacatatagatttccttctgtttaaagaatagagatatctatattatacatatgaccatttatttcaccaaactcctattaaaggacatttaagttgttcccagttttctactaataaaaacaatgtttaatatttctgtgcaactttcttggcccactacacagatagaaacttttttttttttttttgagatggggtttcacattgcccaggctggagtgcagtggcactctcatacctcactgcagccttaaactgggctcaagtgatccttccacctcagccccctgagtcaccaagattacaggcactagccactgcatccagctacagataataactgttgaataaagttctacacattctagaaacacaattgctagataaaaggatatataagttttcatatttatagaaattaccaagtggagcttcttttatctttacgttttatctttatgttttcttattacaaataattcatgtttactatagaaaaaaatttaaaatatagacaagaaaaaaataaaaacttatataatcccatcattccataataatcacattaacatttaatactggagttactcttaaaaaatatgaaccaaggactgggcgtggtggttcacgcctgtaatcccagcactttgggaggctgaggcgggcggatcacttgaggtcaggagttcaagaccagcctggccaacatggcaaaaccccatctctactaaaaatacaaaaaaattagttgggcatggtggtgtgcacgtatgtcccagctactcaagaggctgaggcagaattgcttgaacctgggaagcggaggttgcagtgagccaagatcgcactactgaactacagcctgggtgacagagcaagactctgccagaaagaaaggaaaggaaagggaaggaggaagggggaagggggaagggaaggcaaaagaacctagctaagagtagtggtgcacacctattgtccaagctactcaggaggctggggcaggaggatcacttgaggccaggagttcaagaccagcctgggcaacatgacaagaccccatgtctctatcaaaagaaaaaaaaaaaaaagaacctaaaacaacacaagagaagtaaaaataacagtattttttagcacatcatttttgcaattggtaaaaggatattatacaggtagataaatgtaatttaagtagggaatgtgccatcacagatacagaattaagacagtttgaaaagaataattatttagttaagccttaaaattactttgtcaaagaggagaaaagggaaaaggctcctgggctgtgggcatctcagttgccagagaaaacctaatatagaaaacatatagatgatctttggtagggaaatataagtaatgtcaatttctaaaatctaatttatactctaataaaagttttgtttgtttgtttgagaggggtccttacactgtcacccaggctggagtacagtggcatgatctcagctcactgcagcctcaacctcccaagctcaagtaatcctcccacctcagcctctccagtagctgggaccacaggtgcacaacatcacgcctggctaatgttttttattgtttataaagatgaggtcttactatgttggccaggttgtgggacccatttgtgttctcttattcattctataaatgttgtttccttagtaccttaagttttcacttcaaccaatataacacattctagttcaataactgtgtgtggtggtcactgagggatgagttgggcaaggaaccagcatttgagttccttagtgttatggtcactaagggatgagtgagggcaagaaaagaaatgttgaaaagttatcagaaagccagtgtagtatccaaatgagctaggaatctaccttggaggccagagtgtatctggggctagcatcgtatcagggccttctcaaaggaagcagtagcttctgttagagatttgtgggacacaggactctaggaatggactgtatcaaaagtgggcatgcagcccatccagttagctaaacagttaccaatagtttattttcatttaaaattcaatgaattagaattaagcaacaaatattaaacttacacacttataccccctacataactaggataatgttctaacctggaatttgcttccgctttcatcagggtgagaacctatcaccggaggagtaaataattcatgcctgtgggtcctctataaaaaagaaagattcacatgaattcctgaaacagacatttaaatataagattcattaaaatagtgccctgatgaaacactgtccttaaactaatgtcactattacttattctccacaaatttgaaaacccacataatttaacatacaaatatctagtaatgtaagttttaaaatttaagacaaaaaaaatgtaaaaattttaaaggtctattgtgtgtatggcagcagcacattgtaggctgaggatatgaagaacaaccaagtgtcaccctgagagcattggggctagtgaaagagaagtgccaccacacaacaaagttctgtgagggctgactgtaccccaggccaaaggggccactgaacaacagcccagatgataaataagatttgggtagtaagaaacaaaaggagtctgagataagacatttcagggccaggcgcggtggctcacacctgtaatcccagcactttgggaggtcgaggagggcggatcacctgaggtcaggagttcgagaccagcctggccaacatagtgaaaccacgtctctaccaaaaatacaaaaattagctgggtgtggtggcaggtgcctgtaatcccagctactcaggaggctgaggcaggagaattgcttgaatccaggaggcagaggttgcagtgagctgagatcgtgccactgcactccagcctgggcaacaagagcgaaactgtgtctccaaaaaaaaaaaaaaaaaaaaaaaaaaagacatttcaggcagagaaattataagagttagagtatttaggaagctatgcaaagtttaatacagttgaattatgcggtgcacaaggtagaacatgagacaaggccagagattaataagatccatgtggagatacttccctccccaactctcagtccatatagtttaggtaggattgataccccttcccccttctatagataggaattcaaggtctagaaaatgaaagtactccatcctttggccagtgattggttcaaggatgagcaagtgcttcaaggtaggctcaaaagagacagattcaagacttttgctagagctattagaaaagaggaactctctttccaagagttgctaaggctactagtggagatctttgtcactttatagggagaacctatttgaaagtaaaatcaattttttaaaagaggtgggacatggaaagagacagatgcctcctgatattgtgtgagcacctgaatccagccaggcttgaaactggtggacttctagacttcataatacaagctaagccaatatattcctttttcagttttaatctatttgagtttctgtaacctccagctcaaaaagccctgacaatacaaacttcgtatgcccagccaagaagtttgtcctatagacaatgagaaacaaagattttgaagtaggataatgataacatcagattcattttctggaagataattgcaatgaaaatatggatggactgaacttcaacctgtttatttcacagatgaataaacgaggctcagaagggataagtggcacacccaccataacagagtagacttcaaaacatacttaagaaaaaagaaatgtggtgtttactgagcaccttctctgtataaaggacagtgccaaatgtggcacaggagataaacaacgaatccacagtctgatcacagggataagcacctcaaatgcaaggcagggccaagtccagtcagtgacataaaagacgtactactgagttgggcacagtggctcacgcttgtgatcctaacactttgggaggccgaggcgggtggatcacgaggtcaggagatggagaccattctggctaacacagtgaaacccatctctactaaaaatacaaaaaattagccaggcgctttggcacatgcctatagtcccagctactcgggaggctgaggcaggagaatcgcttgaacccaggaggcggaagttgcagtgagccgggattgcgccactgcactcaagcctgggcaacagagtaagactctgcctcagaaaaaaaaaaaaaaaaaaaaagacgtactactgggttcaagcagaaagagattcagctgggcatggtggctcatgcctgtaatcccagcactttgggaggctgaggtgggcagatcacttgaggtcaggagttcgagaccagcctggccaacatggtgaaaccccgtctctactaaaataaaaaagttaactgggtgtggtggtatgtgcctataatcccagctacttgggagtctgaggaagaagaatcacttgaacccaggaggcagaggttacagtgagccaagtttgcaccactgcactctagcctaggcgacagagcaagactctatatcaaaaataaaataaataaaaaagaaaaagactgcatccaactgaagatcaagacaggctccagaaaggaggaatctgagaaaagccttccaaaataggacggtttcaacagtggagataagagggaagagcagtcaacaggataaacaaagtcacagaagtagtgaaagaaacagaaacaataattccatatttcagttttggctccagcccagattatgactacaggaaaagcagagattaggccaattatgtgtgagagaagatcttacatattaaggataatctgcatttaattcaataggcagtgaatttccttgaaagacttctgtacaaaacccacgaggtggtcagagctatactttgggcagattaacctagcaacactatgtcggcaatggaagcagcagaggatgctggttcctcaagatcattcttttcaacctttatttaacctaccgctgaccatctgctcctccttgaagccttcttgtgcttctgccatataacaccatcctcacctggcccccaagttctatcctctcccctctttttttttttttttgagacggagtttcgctcttgttgcccaggctggagtgcaatggcgccatcttggctcaccataacctccgcctcccaggttcaagcgattctcctgcctcagcctcccaagtagctgggattacgagcatgtgccaccatgcctgactacttttgtatttttactagagacagggtttctccatgttggtcaggctggtctcgaaatcccgacctcaggtgatccacccacctcggcctcccaaagtgctgggattacaggcgtgagccactgcgcctagcctccctcttgtctttttatcacttctctttctcccaaggtctcatccttgcagttccattttttactctatgcagatgctcccaaatctctctcttgctaccaactctctttccatagctccagatgtacacttcacttgatactctcctggcaatcttaactcaaatgcttaaaacagaacctgctatcaccttctacaacattctctttttcctgtttaatgtatttttctatattctactctctcagactctaggccttactcatctctgattcttcaccccctcccttctccttcacatccagacagtcaccatgtgttatagtttctgctgcttgagtgtgatgccctcattctacaccccttgccacttccttcatccaggctatcatttatgccaagactaataccacagactcctagaagacttctctcacactccaagtcatccccatatctgctggtggaggaagcactcaaaaaacctggctgcgaccgagtttctctggtattccaaagcacctcacacaaggagaacagtcccaactcccaagggtggcatccaaagtgctcctacaatttggctcccacttgcctttccaaactgatcccacactactcctgattttctcatcatttcctgctcagagtccattttttgctgtacctttcttcacaatcaccaccttttccccatttccacaagattaaggcaatctaggtccatgccaaatgccatcatttccttgaagcctttcctgatttttctattgaatacattgtttgtatctcttttatagcacatataaaattctactttatgtattgcacaaatgtctataacttcatagactgtaagctacttgaaagtggtaaagtatagtaggcaatggttgggctttagagtcaggctggattaaaatcctgtcttactatatacgatctatgggcaaattactaaacttctttaagcctcagtttcctgatccgtaaaatgggaataatagcatttacacattattagtattatgaggattaaatgaggtaaataatgtatgttaagtgctacctggcatatcatgtattaaatagtaactactatttttaccatcatcattgttgttaaggggaaaatagctttttcatctctgtatcttctacacagtctcaatcacagaaatcttaataacagtttattgaatgaccaactttggaccacaaaattccattctttaaatatccctgagatttccctaaactgaaacagtctccttttctctcattttacccagtatcctcccctccgccccctaccaaacttacctggtgcaaaatggtatatcgctcacgaaacatctctgctttatctcttggtgttccaaataaatttggtgcagggtggttggtcattaacagactagaaaaagagaatgcctatttttgactatcataatacacaaaggtgagccaaaagtgaagcaagagactataccttctgaaaaaaaaagtacatttgaaattaatttaaaatcagtggatgacatacttacggaagaaatttttttctttctgaattgtacacaaagcgtggaatatcaaatgctcctatgatattgaaaacgtgctctctgaaaaacatcccacaaaatacagacctgatttactaaaacataagtactctaggtgaacatgataacttgcattataagtatttgtaataacacacttttcacattttctcaggccaggcacacaatttctttttctttttctttttcttttttaagacagagtttcgctattgttctccaggctagagtgcaatggtgggatatcagctcactgcaagctccgcctcctgggttcaagcgattctcctgcctcagcctcccaagtagctgggatcacaggcatgcaccaccacgtccagttaattttgtatttttagtagagatggggtttctccgtgttggtcaggctgatctcaaactcccgacctcaggaaatccactcacctcggcctcccaaagtactgggattacagatgtgagccaccatgcccagcccataatttcttatagtgtcaaaaatacaatgggtgtaaaatgtttagcttgtgcattttcatctcaagggacaagaaagcattgccaaaactctcaagaaaaaaattaatcaagttaatttccagttaagaatttcatctgttgaaaaagaagaattatataaacaatagtcacatcttaaagaaatctctccctatatgtactactcttatgagctacagtatttttttttttttgagacagagtttcactcttgttgcccaggctggagtgcaatggctcgatcgtggctcaccacaacctccgcctccagggttcaagagattctcctgcctcagcctcccgagtaggtgggattacaggcatgcaccaccacgcccagctaattttgtatttttaacaaagacggggtttctttatgttggtcaggctggtcactaactcccaacctcaggtgatccacccacctcagcctcccaaagtgcagggattacaggcatgagccactgcgcccggccatgagctacagtattattaaaggatatgattaagttccaacaattttttattttttttgtttttgttttgttttttgagacagtctcactctgatgcccaggctggggtgtgatcttggctcactgcaacctcttcctcccggcctcaagcgattctcccgcctctcaagtagctgggattacaggcatgtgccaccacacccagctaatttttgtatttttagtagagacagggttttgccatattggccaggctggtctcaaactcctgacctcaagtgatccgcctgcctcagcctcccaaactgctgggattacaggcatgagccaccatgcccaaccccaacaattttaaaaatctaaaatgttttttgtttgttgtttgtctgagatggagtctagttctgtcgcccaggctggagtgcagtggcacgatctcagctcactgcaacctctgcctcctgggttcaagtgattctcctgcctcagcctcccaagtagctgggattacaggcaccctccaccacgcccagctaatttttgtatttttagtagagacgggttttcactgtgttggccaggctggtctcaaactcctgacctcatgagctgcctgccttggcctcccaaagtgctgggattacaggcctgagccaccgcgccctgccaaatctaaaatgttatgcagaagtgtcccaggaaaagttacacaatggaaaaagagctccccctccaattctggccatatctttcagacttatacaatatatatatagtgttagagatggaaaaccaaaaaaaattatttaatttcagatacttttaataatataaccatgtttaaaagaagttaaaaatttccacagcactactgtataaatatcccaacctaaaaatctttcctaaaattacatgtttatctcccaaattgaaaatgatcaaaaaagattcatgctaccctagaggtaacaagtatagagtggctgagaatcactgaacttgaggaaaacctagactccagacactgctccactattttctggtagatcagtctgagtaagttattgaacttctcatgccatctcttcatctatgagaacaagagcctctactgtggtatgatataatgactctctgacaattgaaggtacaaaaatcctttaccattcagtccccactggacctccatgtaggctggctataacatataaacagcctgacagaaatagccgagccaggtcagtgaggagtacgggctggccgacccaggcactgcgcactgaggccagggatgggcctgagccatgcacctcctctgaaactaccctgtgccctgcctttgaggcctgacaggtgtgggagcaggagctgcccaaaagtgggctggggttggaggaagcatcctggtcgttgctatgtgccctgaggctttaaggcacctgaccccacccttgctgaactggcatcaccaggacctgtttactctagatgagaatcatgatccctgggcgcttagtgcattgcctggaagagcccactcatcctggacgagccctttggcagcctcagacagtccttgaggaggatgactgagacatcatgggccatgcactgtgtgcctgctcttagggaaatgtcatcattgacaatagctatttcttcatccagaacctgggggagagtgggttcagccatgtggacctagtggaggggttacaggatggacacttctacgccctgaagcgaatcctgtgtcacgagcagcaggactgggaggaggcccagccaagaagcaaacatgcatcacctcttcaatcaccccaacatcctttacctcacggcttactgtctgagggagtagggtgctaagcatgaggcccagctgctgcttccgttctttaagagagatatactgtggaatggagagaaaggccgaaggacgatggcaacttcctgacttaggatcaaatccttcagctcctgctgggtatctacagcggcttgaggccattcatgccaagggttaggcccacagggacctgaagcccaccactatcttgcttggagacgaggggcagccagttttaatacacttggatgccatgaatcaagcatgcctcacatgaagggctcccaccaggccctgaccctgccggactaggcgacccagcagtgcaccatctcctactgagccctagagctcttccctgagcagtcactgtgtcattgatgaacagactgatgtctggtccctgggctgtgtgatatatgccacaatgtttggggaaggcccttacgaaatggtgttcaagaaacgtgacagtgtggcccttgctgtgcagaaccaactcagcatcccacaaagccccacgcattcttcaggagtgtggcagctcctggcctcaatgatgactgtggacctgcagcagcaccctcacaatgcttgcctcctcagtcagctggaggtactgcagcccccagctcctggccagcacactgcccaaatctgaacaaagcagtggccatattgagaaggtggcgccttgtgccttggaaagaggctcccatcactcactggaatctctacccattctttctttattttattttatttattttatttttttttttttgagagacaagtctcattctgttgtccaggctggagcagagtggcacgatcttggctcactgcaacctccgcctcccgggttcaagcgattctcctgcctcagcttcccaaatagctgggactacaggcatgcaccaccatgcccagctaatttttgtattttttagtagagacggggttttgctgtatgttggccaggctggtctcgaactcctgacctcaggtgatctgcccacctcggcctcccaaagtgctgggattacgggcatgagccactgcgcccagcctgcttttctgctttcttacccccaagagcaacacctggacaaggggctttactgagtgggggtggaataggggttgggaaaaggaaaactgatgcgatatggtacatggctctgtgcaggactgttgagctcatattacgttctgcctccaaatctgggagcaagagaatgtataaacagaagaataaagtgaatgcagattggtgtgggggaaaataagtaaataaataaataacaggtaactttagggtaaacaacgagtaacgtctattttaggataataatcaaacttcagtacaatcattttgaatttctattgatggctttaggaacattcattatactccagtatttattttatgtattttttttgagacagagtctcactctgtcgcccagactagagtgcagtggtatgatctcagctcactgtaaccaccacctcgcaggctcaagcaattctcctgtctcagcctcccaagtagctgggattacaggtgcgccccactaccgcccagctaatttttgtatttttagtagagatgggtttcaccatgttggccaggctggtcttgaactcctgacctcaagtgatccagccaccttggcctcccaaagtgctgggattacaggcataagccactgcatctggtcacactatagtattttaaatgagtttgcaagggtaaaattaaaaatcctcaatttctctattttttttttagcagttataagttctgacagggagaagattataacttctgactaaaataaagataatgactcctttcaatcatctccattgccccaaataggaaagaagtggcaatgttaaaactgtctctcagcccattttccccagtgttttccttccagttaaatgccatcaatttgtatagaagtatcatatcaagaggaaagagggatattcagagaaataaaacccagaagaattactgccatataaattcttaaacctaaaaacatgacatagtggagtcacaaaactgaggtcctaccctcatttgccattcaccatgtgaccaagtaaagttgctgaacttctctggacatggtactttcctaagagcaaagtaaattatacttctgaatattcatttcaattcaactcatttgtagcatacagaataaaaagtcagatcaaccggttgggtaggcagcaaaagttagtaatgaatggtacaagcaacactgtaacctcaaatcccaggaaaaaccagtaaagatgagtcatttaataatgaggtttgcaaagaaagccattatttaaaaagacacacagaaataacaacagtaatcactgtagaaacgttgatcactaataattttccaagacaataattaaaaataagtgctcaataacacctccaaggaggaaaaaagttaactgtacccacatacatagtttcatcaacagactgactgcattcctggactgctgcttccaccacagatcgttcaatcatgtttgatgacactgaaaagagaatttcaaagtcaaaatttaaaaacaaaaaaaaaaatagttctttccacagacagctcttttcccaaaaataatttgcaaatattaatactgagattctcattatacagtttttggagaaaaaaagtgttaggtcagaacaataacaaaagccttatctcaaataccttcattttccacactcaaagttacaataccttaatatacagtcaaatgccttaattttctaaaccctgtttagttataagaacatttctgagctagggtcggtggctcacacctataatcctaacactttgggaggccaaggcaggaggatggctcgagcccaggagtttgagaccagcccagacaacgtggtgaaaccccttctctacaaaaaatataaaacttagctgggggtggtggcacatgcctgtagtcccagatactcaggaggccaagatgggaggatcacctgagcccagggaggtggaggctgcagtgagctgtgatcatgccactggcactccagcctgggccacacagagtgagatactatctcaaaaaaaaaaaaaattctctaagctcccagttttaataaggttacattagtataactttatcatcataactgctcagtttcaatgagcatgatagtaacaatagcagctaccacttattaagcattgagtaaatgtgtggcaccatcctcagtactttatttacaagtattattccactgggtagatgtcctgtaagactgatgttaagatgcccatatcttatagatagggaaaatacaactttaagaggttgaaaattttgcccaaaaactagaagagatagagagcaacaaaaacccaggactgattccagtgggggctcttttaatcactttgatatgttgtcaagcaaaataccatgtgccatcttaaatcaatgtacacagggacaagtatcattttcttttttttttttttgagacggagtctcgctctgtcagctaattttttgtatttttagtagagacggggtttcactgtgttagccaggatggtctcgatctcctgacctcgtgatccgcccgcctcagcctcccaaaatgctgcgattacaggcgtgagacaagtatcagtttctaaatgttcaactgtaaaggaattttttaagcaaaggtatatgtaaaattctgcctttaggaatgaaaatgagatataataaccatttatcctgtatcacggagtatgtttcttcctatataattgaagtgactagcatctatataacattaagagtgaactcggcacttctcagccttttatgctaagataaagtggacagtgagccatacccacttctatcctcagggtgctataaatatcagactttttttccaaggggaagagcatttcttctttccagtcccatgcttgtggtattaagtatttaacaaaaaggtccctgaatccctatggcagtgtggcagtggcaagaggaaacatgctgatacagttttactgacaggttgaatagagaggtgtctcagaaaactccccgaagtatatggctgaaatggactgcaaatcataaaaaactggaacagaggtttagttcatgtattggtggccccattctagcttctttgggcatgtttcaacagatgtgactttccaaaaaagaacatgaagaaagagaggaggggccaggtgtggtggctcacgcccgtaatcccagcactttgggaggccaaggtgggtggattacctgaggtcaggagttcaacaccagcctgaccaatatggtgaaaccctgtctctaccaaaaatataaaaattagcctggtgtggtggcacgcacctgtagtcccagctactcaggaggctgggacagaagaatcgcttgaacccgggaggcagaggctgcagtgaaccaagatggcgccattgcagtgaaccgagatggcgccattgcagtgaaccgagatggcgccattgcactccagcctaggcaacagagtgagactctgtcccgctctcaccaaaaaaaaaaaaaaaaaagggagaggagggaagcagtgtgtagaaagcaaatgccttgaaggagttcccaaacctctaccttcctgggtcaccttatgtttcataactttggtatactcaagaaaaaaatgaccatcttttatagaatgtgcttttcttgaaatccacttattcttttttttttttttttttgagacggaatctcactctgtcacccagtctggagtgcagtggcataatctcagctcactgcaacctctgcctcccgggttcaagcgattctcctgcctcagcctcccaaggagctgggattacaggcgcctgccaccatgcctggctaatttttgtatatttagtagagacagggtttgccatgttgtccaggctgaccttgaactcctgaactcaggcgttcccaccagcctcggcctcccaaagtgctgggattacaggtgttagccaccatgcctggccccacttattcttatcacaagcgttatataattttgtatcaatgtctattttcaccaggtacaatggctcacgcctgtaatcccagcactttgggaggccgaggtgggcgatcacctgaagttggcggttcgagaccagcctggccaacatggtgaaacctcgtctccactaaaaatacaaaaattagccaggcatggtggcgcacacctgtaatcccagctactcgggaggctgaggcaggagaatcatttgaacccaggaggcagaggatgcagtgagccgaaatagcaccactgcattccagcctgggcgacagtgcaagactccttctcagggaaaaaaaaaaaaaaaaaaaaaaaaaagtctattttctacagtttgctttcagtaaaatgccttccaactctgtttagtgtattcattatcagtgcattagtagaattgctttttattgaaaagttactgtctctgccctttaacttagacttacaaaattaagttaaaatgactagccattctattaaaaaaaaaaaatccctgaagaaatcaagaagagatgtcagctctgtttactttactcttctttttttcctcccaaacatttaggagttaatgacttaaataagacatggtaatagccactaggagagacaaagtgaccataaaggaccagatcaaaatcagaagccaagtgcaggaaacatggtggtgacacctccactgggggaaaggaactataaaagggcccttggggatcatcctgaggttccaactaaactaagggtttggatgtcatcaacagttaaaataaaaaaggccgggtgtggtggctcccgcctgtaatcctagcactttgggaggccgaggcaggtggactgcgtgagcccaggagtttgagaccaggctgagcaacacagtgaaaccccatctctactaaaatacaaaaaattagcctgacatggaggtgtgtgcctgtaatcccacctactcgtgaggctgagacaagaaaattgcttgaacccgggaggtgggggttgcagtgagccaagatagcgccattgcactccagcctgggcaacagagcgagactccatcccaaaaaagaaagaaaaaaaaattaaaataaactaaaggtattaccccttgggaagaaatgctaccatgcatacatcttataacactgggacatcttaatagtgaagcctcaacttcaatttaaatctatacatctaactgaagatgcagaactatattaacaatttaggagttatcagaaaatattacttacagggttgcttctcaactgcattaattatcttttccagtttatcttcaagctctaattcactgatagactgaagagcttctgtgaggtacttaatagcttcactaagaaaaggaaaggaaaaatgaggcaggtcattagtaattaaaggctaaaagttttctgccaaaaagcagcaaatactcatcaatctggcactgaaaggaagaaccactaactgctctcttcaagtagcactttatctttcctgtgctttctgaacaaaatcatcctcctatgccttgctaacataaagcctcaaatcacatccttcctctaagaaggcttcctagaccagctctacctgctgcaatctcccctttcttctgaaattgttaaaaatcacatttacatataccttagatctgatatattacattagccttttattacttactaccctacatttaaggcaagagtccatctgtttcaatgtcaagcaccatatcctgaacataagacactcatatatttaatttgataatgcacttgttcaaagtaaattccaataatcactgttttcaattgtaaaataagaaaaaaaataggcttggctgtgcgcggtggctcacgcctgtaatcccagcattttgggaggccgaggcgggcggatcatgaggtcaggagatcaagaccattctggctaacacacgatgaaaccccgtctctactaaaaacacaaaaaatttagccgggcatggtggcgggcgcctgtagtcccagatactcgggagactgaggcaggagaatggcgtgaacccgggaggcagagcttgcagtaagccgagatcgcgccactgcactccagcctgggcgagagagcgagactccgtctcaaaaaaaaaaaaggctttaaaaaactatgacatttgaatataatcatagaagcaacactcattaaaatcacatgaatttgtgttatacgaaaggagaggttggcactccacttgacaaagatggaagaggccctcgggcctgacaatacacatatggtaaggcactgccacctgcttcatggagtctgaccatcattaaaaaaaaaaaaaaaaaaaaaaaatcatggctgggcacgcggtggctcacgcctgtaatcccagcactttgggaggccaagacgggcagatcacgaggtcaggagatcgaaaccatcctggctaccacggtgaaacaccatctctactaaaaatacaaaaacaaaattagccaggcatggtggcgggcgccggtagtcccagctacttgggaggctgaggagggagaacggagtgaacctgagaggcggagcttgcagtgagcggagatcgggccactacactccagcctgggcaacagagaaactccatctcaaaaaaaataaataaataaaataaaatcacattaattccttacctaaatcccaacaatgatcagaatgaacatgattaactagttacatgccactacatgccattctgtatttgtagcacactttatacctcacatcaatattattgctgattacaatattaaacaattagctaattacatgccattctgtatttgtagcacacaatttaacatttcacatattattgttatagccataacactaattgttctatatattgggttgctttattagttgttttgtgtgtaggtgttgcatctctcaaatttattatagataactgagaactgaattatagataactttaaaactgtaacttagaactctgtgccatccttccacagagttctaaatacacttgaaggtggtccataaatatttgaccactgagtccctaaaatcatatacattttggttgcatcttgggacagttcttagcatagaccaaagcctgtaaagccatacagaatcttgcccctgccaaatcccattaagctcataccatgtccctggccttcctggcactctcctgctttagggtctttatatggccatttcctcccactcttctctccacctagtcaggtcctgttctttcttttttttctttctttcttttttgagatggagtctcgctctcttacccaggctgaagtgcagtggcgtaatcttggctcactgcaaccttcacctcccgggttcaagcgattctcttgcctcagcctcctgagtagctggggttacaggtgcacatcaccacgtctggctggttggtttttttttttgtatttttagtagagacagggtttcatcatgttggtcaggccggtctcgaattcctgacctcgtgatccgcccacctcagcctcccaaagtgctgggattacaggcgtgagccactgcgcccagccaagtcctgctcattctttaagtcagcccaaaccacttctgcagtgaagttcttccttgactctagggcagtttatacaccttatcataaactctcatagcccttctttcctggaatccctttcacaattgagattaaatagctgtaaaatagtcatttaatatccatggtagacagacttctaagatggcccctaataatccattactcctggtagttacacctatgtaatcccctgcccttaagtgtgggctggacctagtaacttgtttctaaaaatagaatatagcaaaagggatagaataacttactgtattataattttgaaagtaaaatttaaaagtaaaaaaaatttaaaaataacaagatgtcacctccttgattaggttgcctcagagttactagaagactctctctcttgatgaagccatgttgggggcacacatggcaagggactgaggatagcctccagccaacagcctgccaggcaatcaggaactgaatcctgccaacaactgaatgagcttgaagcgaatgctgtctggacaacatttgagatgatccatcttgactgcaaccttgtgaaaagaccctgaagttgaggacccaactaagccacacctgaattcctaacccacagaaaatttgagataatgtgtactgttttagcctttaaattgtggggtaatttgtcacgcagcaatagaatacattatctgccccctacaaagctcttgctctctattgcacccccttaccccagcacggtgctttgcagctaacagatttaagtatacttatgactgaaataattaatgaacaaaagcttaatattaggtcaaattctaagcgaaaagaaagttaattcatcagttcctcatgctttcaaaatgtcaaggaccaattgaacaaaattcattattttctcccaaggcatctcccaaagcacagttaaaagtcccataaaactcacaaaaccaaccaaaaatctacacacacaaaagcaataaaaactgatacagagaggtatatccaatccagcaggtatttcaatatgtataaaatattgtgttctaggtcaggcgcagtggttcacgcctgtaattccagcattctgggaggccacggcgcgaggactacttgagcccaggagttcaagaccagcctgggcaacatagccagaccccgtctctaaaaaacatacaacaacaaaaaatcagccaggtatggtggcccatgcctgcagtcccagctacttcagcccaggaggttgaggctgcagtaagtcaagttcgcatcactgccctccagcttgggcgagagtgagaccatgactcaaaaaaaaaaaaatacatatatatatatacacacacaccacacacacacacacacacacacacacacacacacacgtacatatagaactctaaaacacggagcagatttaatgagagaaatcttgggaaggttcatatgttctataggtcctcaaaaacacggatatgcccaggaaacctgactttcacataaattggcaactgcagacgtgcaagtgggctttctcgggtctctcatcttatgtctcagcaaccttcccgggagcctgagagctgtccaggtcacaatgttgataaccggctgccatagataggttgcagcttctcgggctcagtttgacatgtgcagaagagcctcggcccgcctagaagaaacattaaactcctcgcatgggtcggggaaaccaaagaaggcacggcagcctcaagatccacctcgcttcttagaacttttttttaatggagtctctctctgtcgccaggatggagtagagtggcacgatatcggctcaccgcaacctcctcctcccgggttcaagcgattctcctgcctcagcctcccaactaactgggactacaagcgcgcgccaccacgcccagctaatttttgtatttttagtagagacggggcttcaccatgttggccaggatggtctcgatctcctgacctcgtgatccgcccgcctcgacctcccaaagtgctgggattacaagcgtgagccaccgcgcccgaccgcttcttagaactctgaaatttaaggtcaagccccctctcggcgcgcggggagccgccgcggtgcgtcccgctgccgcaccaggcagacgggccccagctcttccctctcgcccttcaagctgcccgagcccactcacccacggagcagcaagccccgcaacttgaaggcggagagcgcccggctccgcagccgctccggcgccatatttgcgatttggcgccaccgccgcagctccgccccttcccgggcgcgcccctcccagctccggcctcggccctggcccgcgtggcgctaaaccctgttaagatccctgcttggtctccgctgcctgcgccgcagcaactcagaccttacagttcgcaaccccggaccgagtaggct

SEQ ID NO: 2695 - DNA, 38200 bp, Homo sapiens
  source 1..38200: mol_type = genomic DNA
tcttattaaatatatatttttaaattaaaaaatgcactctaatcttgataaataatgactatataagattaactacattcttacagggtttatgcagaggcattcggtatttgtcgtagtgaaaggatcatatttgtctgcaatgacaagtagatcgggcacaggatacactctcaaagcatagtcatatgcccaatacactgggcagacataaagaggtaggggagtcagatgtccttgggataagatagtctttacaaactacaaaagagcacaaaacaaagcaaacttcagttcatttgcaaaagtgaaaatagctaaacaaataatttcaaattaaatattaattaccaaaaggaaccagaaaatttgagaaactaggaaagctttgactcacagagctttgggagacactaatttaaaagtgaaataaactattctgtattttaggaaaaaaaatctatgagttttcatttaataacatatacatcattatgctgcccaggctggtctcaaactcctggcctcaagcaagccacccaaagtgctgggattacaggcataagccactgcacctggtccataaactttaaatattataaaatgaataataaaaatgctctgtaacatctatttccgtacttctcaaatgggggtgtatgtaacctgtgattgacaactattgtcagggaacctcgaagctacaagataaatactgcacattcttgtgatatggacatactatataaaatatgtaaccaatgggataaataagaacagtttattaaaacaaatatacatatattttcaagtataatttaagagtttaaaaggcaaaacacgaagcttgaaagaaatttcatgcttattctcagcttttctctgtcctctaaaggacatacacttaggtagaaagctgagaaacactgacttcactaacaaaaattaacttactgacaaaagtacgttcaaactattttgaaccataaataaatgtcctaacccaaggacaaattattaagtggcttaataaaattttatataatgcaacatgtaaggcagtttaataaaaaagttgtttcacttacgtgattaggaatagccaaattgctgctaggaaaacggacgcagtttctgcacattttatttactaagtcttcacggaagacagtaatttcctgtgtacagtactgaattctgaaatgaaaacagtagttgaatttgacttctcagaaaaaaatgatattaattttaaaggtaaaatctcttacaatacaaccccattcccacattcactgttcaccacacaaaacttcaaccagagtctgtctattcatctattcatttaacagctatgtattgagctcttaatatatgcctaccccattctagggattagcgaacagaaccaaaagatcccagccctcatacagtttacattctagtagggggtggggctgagaaaataaaaagcgaacataatcatatagtatgttttaagataattaagcataagagaaaaagaaaaagacaggctaagagggacagcatatgtggtaagagagagcctagaaggcgggcatattaataggatgatcagaacaggccgggctcataatttagtgtgacttgagcacaggcttgaagcggaagagggacttagtcaagcagatacccagaggaagcgcactgcaggcaaagggaacagatggagcccaggccctcagactggagctcgcctggcatccttgaggaacagaagggaggctagtgtggctggagtaaatggggaggagaggaaatcagagaggtaacggagccagataacacagggccttgattaccactgcaaggatacggctgtcactaaatcacgaggggtccctttttccaatgagggtccctttttccaggatcgggaaggtggatgggatatgccttatgctttacaggatcactttcacactgcgttaagaatagaatacggagaggagaatggcatgaacccgggaggcggagcttgcagtgagccgagatcgcgccactgcactccagcctgggcaacagagcgagactccgtctcaaaaaaaaaaaaaaaaaaaaaaaaaaaaaaaaaaaaaaaaaaaaaaaagaatagaatacggaggggaaggagtaaaagctggagaccaattaggaggctattgtaataatccaggccgagaagatggcagagcagggctcctcaacctccaggccatggactggtaccagtccatggtctgttaggaactggaccacacagcaggaggtgagcagcaggctgcaagcaagcaaagcttcatctgtatttacagccactccccatcggttgtattacatcctgacctctgcctcctgtcagatcagcaggggcattagattctcacaggagcacgaatcctgttgtgaactgtacacgtgagtgatctaggctgcacactcgttataagaatctaatgtctgatgatctgtcactgtctcccatcatccccagatgggaccgtctggtttcaggaaaacaagcttagggctcctactgattctatattatggtaagttgtataattgttttattatatattataatgtaataataatagaaataaagtgcacaataagtgtaatacgcttgaatcatcccaaaatcacccccaccccccctggcgtctgtctcccataagatcagtccctggtgccaaaaaggttggggaccactgtggtagagggttgtggaggtagaggtatagagagagagcagattctggatataatttgaagttaatgggacttcctgaaaaaacatgtgagagaaaccccaaagtgtttggcctgaacaactggaataatcattgttcagaccatgaaggtgtcatgaactaacatggagaagtctacagaagaggttagggacactcgtggggaggaagatcaggagttcacttaggttgggatggtgataagtaggcaactggatacctgagtctggagtttggaaggtaggttgaagtggaaatataaatgtggaaggtgtcaatacacagatgatacttaaagccagaggacactggagaaggccagcaaaggagtgaatgtaggcagaaaagaggcgaaccaaggctgcctctgatggtattcccacaggaagaacttatgattacaatgagcaatacgaacagtaaataagtaatctttgtattcttcctttgtaacctttcttaaaggatatgtagtaataatatctatttttaaactgctatccattattcaagagtctgaattgactaccaataaattatttaaatatagttaaactattttcaaagttttgagaaacctaaaacaaaaataaattttcttcttatatttattccataacagtcgaaattcagagacacattttaggaatcaagttagtttttttgttttttgttttttttgtttttttgttttttgtttttttgagacagggtcttgctctgtcgcccaggctgcaggctggaatgcagtagtgcattctcagctcacagcaacctctccacctaccaggctcaagtgatcctcccatctcagcctcttcatagaaccacaggcgcgtgccaccaagcccagctaatttttgtactttttgtagagatgggtttcactgtgttgccaaagctggtctcggaactccaagcaacctgcctgcctcggcctcccaaagtgctgagattacagacatgagccaccacacctggctaatttttaaatgaaaggaaaaatgtataacacaaaatactaattcttacctgcaaggattagtagtaaaaactgaaaatggtaccctttgtctgaattcattagtgatgctttcagcaagtggtggcctataaaaacaatttatgtgatatagtttatctttttaagttttacaaaattttctacactgttgcaaaaatctgaacaaaacttaccttggtaagatggaaccaaatccaggatcctctggaccaggtacaaacacaaaacgactactgtagcaaaattcaacacaattcatttaaaaatattattgtaacactatccaatagcttaaaagcaagttattccctttgttttctctttaaaattaaaaaacatttaaatttcatgcattataataaatgaactattaagtctccagaccaacactgtctagtaatgtcatgatagaaaagttctatatctgcactgcccaattgaacacttgaattgtggctagcatagctgatggactgaattttatatttaaatttaattaaacttagatttaaagagacatgtggccagtgactatcatatcggagagtgaagctctagactcttaagagtaatgccacgaagaaattccaagtatggctgaaattacctctatccctttcaatacttttcattataaacctctagtacaatgtgaggataactttatctcttagttcttttaattttctcaactttatctttcttccttagttttgtaataattgctgatataacaaaattcattttttgttttttttttaagtaaaacggtgaaaaaatatatagtgctagagatcattacctttggtgaatatctgggtattcacatattatatctgccaaagtttttagggaatctaaaattttaaaaaggtattgaattaaatttgcatataatgccataaaattatatttgattagatacaatcctgtatattcttaattaaaatattatggataatttcttattactttagtttatatgactatagaaacacttcttattaaatagatcgttaatacctttcaaagcttgaacttgattttttccatatggtgcagatgaaaaattaccacacagaataaagcaggttggaggtgctggtgaataacctaaacaataaaagagtaaatgaacaatacttttctagtctacaaatcaagttaaaaaccctttaaccatgactttctaataataaaaatttattttaattaaaataacattttaataacttattaaaataatactaataacagtagccattcattgagcacttactataggccaggcctgcattggcttaattactcctcagaacatccataaaatctgagacttaggttaagtaacctgcccagggtaataggcttgcacttaaacccagtttgtttttgtttttgtttagagatggggtctcactatgttgtccagctggtcttgaacttcaggactaattcttacttatcatgactataaacacacacacacacacacacacacacacacacaggtttttttcttaatgtaaaaatttaagtctttaaaatgaaatctaatttaaattatctcattgctaactctgtttttttttaaatagaatactcaaaaagataaatagaatactcaaaaagttttaaaacatgaacccttaaaagagttcaagaaagaagaaaaaaaataagacctaccagcaaacattatgcgaagtttttccaatacttccacctggtccaaccaaacatcagataaaaacacaaacatagcatctttattctcctcttctagctgttttagttttgcagaagtcttcacagatgtattagaaggacctccaaaaaaattaatatttccatagtatgccctagataattataacataattatcttctatataccactagagatatttttctaatagttgtatacatttagcttctttgtatctaatgaagttattttccagtgtaaaaaggtactctttgtaacactttaaaagtacaaaggttatctaaatattctaaaacaagataagcaatatggaagcagtaaataaaataataggctatatctgtgtcttaaaactgactaaacggccgggcacggtggctcacgcctgtaatcccagtactttgggaggccgaggcgggcggatcacgaggtcaggagatcgagaccatcctggctaacacagtgaaaccccatctctactaacaatacaaaaaattagccgggcgacgtggcgggcgcctgtagtcccagctactctggaggatgagacaggagaatggcgtgaaccccggggggcggagcctgcagtgagccgagattgcgccactgcactccaacctgggcgacagtgagactcttgtctcaaaaaaaaaaaaaaaaaactgactaaagcaaacattaaaataataatttcctatgtcactgaaagtagaagaaatgagtacaccatttgaacaatatctcatagaaacctcaaaatatgtgctaaccatctgcccaagtaattctacttctggaatggctaatcctaaggaattaaagatatatacaaagactagcctatatccaagaactgtgaaaaaattattcaacggttccttcaaagcttggttttattcaatgctcaccaagcaagggtcagtaggaaagtgggtaatctacacactcccagcctccaccactcttgcccactctacactgacatcctgcagttcccagcttaaatgcaaataccccataggcctcctctgaggatcccaaaagaggttagattttcccattatacactctcataggaacctgtacttctcctttgcagatcttatcaaatttgtaatcaggccagggtggctcacacctataatcccagcactttgggaggccgaggtggggggattgcttgaggtcaggagttcaaaaccagcctgaccaacatggtgaaatccaccccatctctattaaaaatgtgaaaattagccgggcatggcagcaggcacctataattccagctactcgggaggctgaggcaggagaatcgcttgaacctaggagatggaggttgtagtaagccgagatcatgccactgcactccagcttgggcaacaaagcaagattttgcctcaaaaaaaaaaaaaaaaattgtagtcagccaattgtaattgggcgattgtttcatgtctgtctccccacctagtggcaatacagtatgtgctcaaaacatatttcctgaatgtcacgaatcatgctataaaacaatatttcacagtaatagaaaatgttgatagcatattattagatgaaaaacacaggttacaaagcaaggtacagtatgtatccatttataatgccaaaaaaagggaatagatatagacctgtgcattcatgcataaaaagaaactctccagatatacacatacatatcttgttatagttgattccttttttttttttttcttttttttgacggagtctcatgctgtctcccaggctggagtgcagtgctgcagcggtgcgatctcagctcactgcaaccttcatctcccgggttcaagcaattctcctgcctcagcctcctgagtagctgggattacaggcacatgccaccgcatccagccaattttgtatttttagtagagatggggtttcaccatgttggctaggctggtcttgaactcctgacctcaaatgattcaccctcctcgcccttccgaagtgctgggattacaggcatgagccaccacgcccagccagttgattcttgttattagtgatattatgttctataaaatctccacaaacaatgaattggcaaacactgaaccattgctccttgggaaaatttgtacttatatatacatggattgattatagtcttaagtcctaaaaccaatttatcctggtagattctatttttacaaatgagaaaagttggttcagaaatgttaagtgacttatctgaggttgctccaaaaacaggtgccagaggtgagattcaaatgccccctccccacacaaaactggccccagggccagagcttcttgcactaccctgtactgctccctgcagtctctgtcctctggtcatctttttttttttttcttttgagacagagtctcgctctgtcccccaggctggagtgcaatggcatgatctcggctcactgcaagctctgcctcccgggttcatgccattctcctgccccagcctcccaagtagctgggactacaggcacctgccaccacgcccggctaattttttgtagttttagtaaagacagggtttcatcgtgttagccaggatggtctcgatctcctgacctcgtgatccgcccgcctaggcttcccaaagtactgggattacaggcctgagccaccgcgcccggcccctctggtcatctcttaatgaggctgaaacaagaaggcagtatggcctgttcgacttcagctgggaacatgcatgccaggtgactcaaaattttttgctgttctgctaagcataaatgaccactaaagcacctttagtattgactttaggaggtacaaaaacattttagcacaaatctgtaaattaatgaggatctactacatatggactgtcatgcacggcataaaaacgttttggcaatgacggactgcatatatgagtggtttcacagaatgataatggaactgaaaagctcttattgcctactgacatcttagctgtcacaatgtcctagtgccacacattactgtgtctgtagagacactggtgtatacaacctactgagctgccagttgtaggaaagtacagcacatataataatgtacaatatgtaacacttgataacaataataaatgactatgttactagtttatgtatttactgtacttttaatcattattttagagtgtagtccttctacttttttttttaactgtaaaacagcctcaggcaggtccttcaggaggtccttcaagaagaacgcattgttactacagatggcagctccatgaattattgcccctgaagactttccagtggacaagatgtggagatgaaaaacagtgatactgatgattctgtgtataggcctaggttaatacacttgttttagtttttaacaaaaaagatttttagaaaatataaagatggaaaaaagtggctgggcacagtggctcatgcctgtaatcacagtactttgggaggctgaggtgggaggattgcttgaggccaggagttcgagaccagcctgagcaacatagtgaagacccccaccaatccctacacaattttttttttttaattagcagtcttagctacttgggaagctgaggcaggaggaacacttatgtccaggaatttgaggttgcagtgagctataatcatatcactgcattccagcctgaagaagagagtacagttgtatcagtaaatcaattaatcaataaaagaaaaaagctcacaaaatcaggatacaaagaaacaatttttgtgcagctgtagaatgtgtttgtgttttaagctgtttattacaaaaagagtcaaaaatttaaaattttttaaaggttataaagaatgttatagtaactaaagttaattaattttattaaaaaatttttatttcaagacagggtcttcctttgtcactctggctgaagtatagtggcacaatgataattcacagcagcctttaactcctgggctcaagcaatgctgccacttcagcttgccaagtagctaggactacaggtacacactgccacacccagctaattttgttgttgttgttgttggtagagatgaggttttgttatgttgtctagactggtctcaaactcctggccttaagcaacactcccttcagcctcccaaagtgctaggattgattataggtgtgagccactgtgcccaggctaggttaatttcttactgaagaaagaaaactctttttaaacaaatttagtgtagcctaagtatacagtgttaatagcctacagtagtgtacagtaatgtcctaggccttcaaattcactcactactcactcactgactcactcagagcaacttccagccctgcaagttccattcatgataagtgttccatacaggtgtaccaattttatattttataccatatttttactttatcttttctgtatctagagagacaaatacttatcattgtgttacagttgcctatagtattcaatacagcaacgtgtcacacaggtttgtagcacagaagcaacaggctgtaccatacagccttggtgtacagtgggctatatcatctaggtttgtataagtacactgtgatgtttgcacagtgacataatcacctaacaacacatttctcaggatgtatccccgttgttatgcaatacacaactgtatatacatatataaagtaatgttaacagtttttttctgtttagtaaaattacaggtgattttcctttccttttgtgtgccttcatatattttctaatttttttttttgcaatcatgaactacattattaataagaaaaaacttttctttttttaaagactcaactacttttccaatgcagcatactggcttgagtcggaaaccttgggatcaaagcacatctctaacaataaaaagtttgggccaggcacagtggctcacacctataatcccagcctccctctgggaggccgaggccagtggatcacctgaggtcgggagttcaagaccagcctgaccaacatagcgaaaccctgtctctactaaaaatacaaaattagctgagtgtggtggcacatgcctgtaatcccagctacttgggaggctaaggcaggagaatcacttgaaaccgggaagtagaggttgtggtgagccaagatggtgccattgcactccagcctgggcaacaagagcaaaactccgtcttaaaaaaagtttgtgaccatggacaaattacccaacccttcttttttggggggtagggggacaaagtctcagtgtgtcacccagggtggagtgcagtggcaggatctcagctcactgcaacctccgcctccaaagttcaagcgattctctcacccaagtagctgggactacaaccgcatgccaccacacctggctaatttttgtatttttaatagagacagggtttcaccatgttgcccaggctagttctgaactccaaagctcaagcgatccacccacctcagcctcccaaatcgacacttcttaacctaactcttcaaatgcaaaaaaaaactaaactgatatctactgcacagggttactagaaggaatacaagtgataatgtacagaaagcccacagggcacagtgcttagtacggtgtgagcccttagatatggtaactgatattgttattgttcccaccaagtggaccaactggcattttcaaaggtacagtaataattttatagttgctagaggaatgcagtaagtagacataattgtatgatgatttcagttaagcatatacccaaacataaatcagagcatcacagaaacacctattaagctaaatattgagaaattaaacttcagaaaagccttactcacatcttccgtttaaaaaaaaattatttgcattaactacacaatggtagggagggtattgagtcagtgtaaatctctttaggataggaccatgctgtagacctatttgcacttatttgtaaaacagtattttacacataaaacatactcactaaaatattagttgttgaattgattgactaccaccagatttagccccctgaattttatattttgaaggcattttagagaaaatttataatcctaacaagaataaaatgatcattttattttaatgtactttattacacctcataccaatcctttggtttactaagcatatactaagcagttggatttagagaaaatggtataatttaagtggaaaattatttgaaacattataataatgatctcttggctaaagagaaacaaatggtaaactcacagccagccaactcaactatacctctcattccaaagtagtaattttgaagcttgtacaaaacaaaaataccatgacaatggcaattttgctctaaatatattccaaaggaaacttaccatattggaaaaaagccacaaactgcaccaaaagcactcaaatagaggtgagcttggcttgattagggcttgtgttctccttagcaagatcagcacctttccctcagttacttcaacagcaagagtagatgctctgcacaggccgccctgccagtaaactcccagccaggaaatgttgcctttgcaccttgaatttatacaggcatactaaaactaaaatccttgttgttgttgttgagacggagtctcgctctgttgccaggctggagtacagtggtgcgatctcggctcactgcaacctctgcctcctggtaaaactaaaatcttaatctttatgcttccttttgaaatcatcaccattatacagaatctcatggttagaaggcaactactttaattcccccagaggtggcaaactcaaatgcttacaggctccaggaagataacactaaatagcaaagcagcagtccactgacactaactagggcacacatacatgccctgcccaaagtgggcaaccactgcagtttagtttttgctgtgtgagaattcaggctctgtattgccagatcctcctgttaagagaactctgaaacctaggcctttatgagaaatcttctagtttttatacactggaaactaactcgaaatgtttttaaacacctcaaagtggggagaagaaaagaaaggtctataaactactttcaacccatgggacaccaagtacaatttttatactatcattcaggttctgcccaaataattcaagtgacagggagctcagctcctctaagagaaggccattttggaatagctctaatattatgatgctttcacttatattaaggagctataagctacctcacataactttcattcattggaatataaaaatgagaattttatattaacatggaattatattcttctaagtgttatcctagttgtcttatctcacttcaacttctcatcaaccccagagataaaacagactggaaatctttcccagttaaagccgaagtacaaagacggtattgcaactaattgttggccaatctgctagttttcacattacatacaaaacccagtcttctaattctcattttccattgctttttccattttgacacaaagcctgacaccttttagtaactgagatatgacgtactatcttacattcactcctgccagtattaccaaattcccatagagtataaaccaaacattttaatacctagtagtactagagggctcagtgggtggaaatccaaaggcattgacatgaaacacttgatcttcaaaccaacctgaaaaaaagtaacgtcactttcatttgtctaatcctctatgtttgaaaggacaaaattatgttacaacaaagcaataatgccaggctagtctcatgccctgtgaactaattacagaggttgccaacctcaatgaaccacagtgaacaactttagatccacagagagtctcaacttataaaattcattaaatagaaatagattcagaacttttcacttttcagtttggcagtacgtgttgatacagattaggaaatgtttcattttatggccctatataaaattaagtgtttttttcaactttattgaggtatcgttcacatactatacaattcaccctttaaaaatatataattcagggccgggtgcagtggctcatgcctgtaatcccagcactttgggaggctgaggcgggcggatcacaaggtcaggagatcgagaccatcctggctaacacagtgaaaccccgtctctactaaaaatacaaaaataaaaaaaaattagccaggcgtagtggcaggcgcctgtagtcccagctattagggaggctgaggcaggagaatggtgtgaacccgggaggcagagcttgcagtgagccgagatcgtgccattgcactccagcctgggtgacagagtgagactccatctcaaaagaaaaaaaaaaaaagtatataattcaggccgggcatggtggctcacgcctgtaatcccaacactttgggaggccgaggcgggtggactgcctgagctcaggagtttgaaaccagcctgggcaacatggtgaaaccccgtctctactaaaatacaaaaaattagctaggcatggtggcatgcgcctataatctcagctactcggaaggctgaggcatgagaatcacttgaacccgggaggcggaggttgcagtgagccgagatcgcgccactgcactccagcctaggtgacagagtgagactctgtctccaaaaaaaaaagaaaaaaaaaaaaaagggtgtgtaattcggtgatttttagtatattcacaagttgtgtagccattactactatctaatttcagaacattttcatcaccccaaaaagatttctattagcccattaacagtctaagagttattttgccaaaaatatgctcttctaattaatggtatcccaaattatatcatgttaacatattttacccaaagcagaaagttttactggagaatgagaagaaggacagtaacaaagtatactgacttaccttctgctaagacaaagcatgcctctgtgtataaaccactatggaactggtacacaacagttgaggaaaataattctattcttgaggcagtaataaagtcaacatacattttgagtccaacaaggcttctaaataataaatttaaagacttcccatttgaaactgtgaatagaccacagcttagaaagagcttaaaaaattttagttttaaatgtcctcatgtttaattcttggtaatattgacagggtggatcattcttaccatgatataaatttcgtcagtgattcatctagattctccaaataagagaaaattaaagttgttctgtccctgtttaggattatatctctacattcctacaccagcaacatagagaagttacattgagaacccaaataggtaaattttagaaggatatataatcaatttccccaattcacgtaatgcagattttaaaaaatacagacaagtgaaggatatagctttactaaggtctagttggactgttccagtaggatcttccagaaaaaattttccctaaaaaaatgaaaataaataaatccacatttatgtaacaatgaaaaccgttgacaaaaaaattaaactacaagtttgacaacagaatacaatagggagaaagtggattttaaaaatcagctattatttctagtccaggctcttccatttactagtctgataaccccagactaatcacttaactgagattctgactcctcacaggtacaatggagaatgactcctacagataagaaatggcaagagggacatttgatgtctgccataaggagggtctccccaggtaccttctaagacagccaacagcatgtccaagggaccaggacatactctgcagcttgcttgttcagaaacccagtactctccgtttatccagaggtcactacaggcctaatttcaggctatgcaaactgggctcctgcacaagacactctgtcctgatgtcttctcaggaaaccaaacacagatgaaaaagacacttggtgactgagaaaaggtttttgttttttctgggttttttttttttttttttactattacaaaagtttatttaacaaaaagtctaatatgaaaatgtacatgacctaatttttacgtcattgtaaaacaggccctatggagagagaaaatgggtttctctgctgaacagccattattattttatttatttatttatttttgagacaaagtttcgctcttgttgcccaggctacagtgcaatggcaccatctcagctcactacaacctccacctcccgagttcaaggaattcttctgcctcagcctcctgagtagctgggattacaggcatgtgccaccacgcctggctaattttgtatttttagtagagacagggtttctccatgttggtcaggctggtcttgaactcccggcctcaggtgatccgcccacctcagcctcccaaagtggctaggattacaggcgtgagccaccgcgcccagccaacagccattatttatccttgttccaaggcttctgacatgatgatactatttcctcgtattaccactattccaatattgttctgttggtgaggcgagttttcaataaagaatacattcctgtgcccactacaaaaatgttctatgtaaccgacatttcatcaatccaaggccaaaaataaaagtttgatgcttattaagttacctcttttaactgcgttatcattccaagaacaatcgcatctccgattttggttgtactacccaataaggtttctattgttttaagctaaaataaaacaaaataaattttaaagactgtaaatatattctttcaagaaacaaaactttttataaataactatatttggggtatacatttcagcatttatagctactttacagtagaaaatcaaataaaatggaaataaagttgtaaaattaaacttaggatgtttaattttgtcctacaaaaaagctgtaagatcaagtgtatgatgcctaaagaaacaccacatcgactcaggctcttaccaatgactgaatcctcacaccatatcattctgaataatgataagtacatttattttttaaatatagaaaagaatatcaattttattttctttgaacagtaccttttgaaaactagcaagctatttaaaaatatatattccaattttacttagtattttaaaaggctctcattattatttacattctcaatctgatctttttttctaatcagaaagtttaaggtagtaaaaattgggacactattgtaaaaaatcctttccggccaggtgcagtggctcacgcctgtaatcccagcactttgggaggccgaggcaggcggatcacgaggtcagaagatcaagaccatggtgaaatcctgtctctactaaaaatacaaaaaattagccaggcatggtggcaggcgcctgtagtcccagctactcgggaggctgaggcaggagaatggtgtgaacccgggaggcggagcttgcagtaagccgagatcgccttgcattccagcctgggtgacagagcaagactctgtctcaaaaaaaaaacaaaaaaaacaaaaaactttccatctttttctatatgtaatcctaaatatatgtaaatacatacatatataatttataacacacacctatacagtttatttacaaagatgaaatcatagtatatgtactattctgcaacttaactaattgaagttaatattatctgagacatctttccatttttctacatatagatttccttctgtttaaagaatagagatatctatattatacatatgaccatttatttcaccaaactcctattaaaggacatttaagttgttcccagttttctactaataaaaacaatgtttaatatttctgtgcaactttcttggcccactacacagatagaaacttttttttttttttttgagatggggtttcacattgcccaggctggagtgcagtggcactctcatacctcactgcagccttaaactgggctcaagtgatccttccacctcagccccctgagtcaccaagattacaggcactagccactgcatccagctacagataataactgttgaataaagttctacacattctagaaacacaattgctagataaaaggatatataagttttcatatttatagaaattaccaagtggagcttcttttatctttacgttttatctttatgttttcttattacaaataattcatgtttactatagaaaaaaatttaaaatatagacaagaaaaaaataaaaacttatataatcccatcattccataataatcacattaacatttaatactggagttactcttaaaaaatatgaaccaaggactgggcgtggtggttcacgcctgtaatcccagcactttgggaggctgaggcgggcggatcacttgaggtcaggagttcaagaccagcctggccaacatggcaaaaccccatctctactaaaaatacaaaaaaattagttgggcatggtggtgtgcacgtatgtcccagctactcaagaggctgaggcagaattgcttgaacctgggaagcggaggttgcagtgagccaagatcgcactactgaactacagcctgggtgacagagcaagactctgccagaaagaaaggaaaggaaagggaaggaggaagggggaagggggaagggaaggcaaaagaacctagctaagagtagtggtgcacacctattgtccaagctactcaggaggctggggcaggaggatcacttgaggccaggagttcaagaccagcctgggcaacatgacaagaccccatgtctctatcaaaagaaaaaaaaaaaaaagaacctaaaacaacacaagagaagtaaaaataacagtattttttagcacatcatttttgcaattggtaaaaggatattatacaggtagataaatgtaatttaagtagggaatgtgccatcacagatacagaattaagacagtttgaaaagaataattatttagttaagccttaaaattactttgtcaaagaggagaaaagggaaaaggctcctgggctgtgggcatctcagttgccagagaaaacctaatatagaaaacatatagatgatctttggtagggaaatataagtaatgtcaatttctaaaatctaatttatactctaataaaagttttgtttgtttgtttgagaggggtccttacactgtcacccaggctggagtacagtggcatgatctcagctcactgcagcctcaacctcccaagctcaagtaatcctcccacctcagcctctccagtagctgggaccacaggtgcacaacatcacgcctggctaatgttttttattgtttataaagatgaggtcttactatgttggccaggttgtgggacccatttgtgttctcttattcattctataaatgttgtttccttagtaccttaagttttcacttcaaccaatataacacattctagttcaataactgtgtgtggtggtcactgagggatgagttgggcaaggaaccagcatttgagttccttagtgttatggtcactaagggatgagtgagggcaagaaaagaaatgttgaaaagttatcagaaagccagtgtagtatccaaatgagctaggaatctaccttggaggccagagtgtatctggggctagcatcgtatcagggccttctcaaaggaagcagtagcttctgttagagatttgtgggacacaggactctaggaatggactgtatcaaaagtgggcatgcagcccatccagttagctaaacagttaccaatagtttattttcatttaaaattcaatgaattagaattaagcaacaaatattaaacttacacacttataccccctacataactaggataatgttctaacctggaatttgcttccgctttcatcagggtgagaacctatcaccggaggagtaaataattcatgcctgtgggtcctctataaaaaagaaagattcacatgaattcctgaaacagacatttaaatataagattcattaaaatagtgccctgatgaaacactgtccttaaactaatgtcactattacttattctccacaaatttgaaaacccacataatttaacatacaaatatctagtaatgtaagttttaaaatttaagacaaaaaaaatgtaaaaattttaaaggtctattgtgtgtatggcagcagcacattgtaggctgaggatatgaagaacaaccaagtgtcaccctgagagcattggggctagtgaaagagaagtgccaccacacaacaaagttctgtgagggctgactgtaccccaggccaaaggggccactgaacaacagcccagatgataaataagatttgggtagtaagaaacaaaaggagtctgagataagacatttcagggccaggcgcggtggctcacacctgtaatcccagcactttgggaggtcgaggagggcggatcacctgaggtcaggagttcgagaccagcctggccaacatagtgaaaccacgtctctaccaaaaatacaaaaattagctgggtgtggtggcaggtgcctgtaatcccagctactcaggaggctgaggcaggagaattgcttgaatccaggaggcagaggttgcagtgagctgagatcgtgccactgcactccagcctgggcaacaagagcgaaactgtgtctccaaaaaaaaaaaaaaaaaaaaaaaaaaagacatttcaggcagagaaattataagagttagagtatttaggaagctatgcaaagtttaatacagttgaattatgcggtgcacaaggtagaacatgagacaaggccagagattaataagatccatgtggagatacttccctccccaactctcagtccatatagtttaggtaggattgataccccttcccccttctatagataggaattcaaggtctagaaaatgaaagtactccatcctttggccagtgattggttcaaggatgagcaagtgcttcaaggtaggctcaaaagagacagattcaagacttttgctagagctattagaaaagaggaactctctttccaagagttgctaaggctactagtggagatctttgtcactttatagggagaacctatttgaaagtaaaatcaattttttaaaagaggtgggacatggaaagagacagatgcctcctgatattgtgtgagcacctgaatccagccaggcttgaaactggtggacttctagacttcataatacaagctaagccaatatattcctttttcagttttaatctatttgagtttctgtaacctccagctcaaaaagccctgacaatacaaacttcgtatgcccagccaagaagtttgtcctatagacaatgagaaacaaagattttgaagtaggataatgataacatcagattcattttctggaagataattgcaatgaaaatatggatggactgaacttcaacctgtttatttcacagatgaataaacgaggctcagaagggataagtggcacacccaccataacagagtagacttcaaaacatacttaagaaaaaagaaatgtggtgtttactgagcaccttctctgtataaaggacagtgccaaatgtggcacaggagataaacaacgaatccacagtctgatcacagggataagcacctcaaatgcaaggcagggccaagtccagtcagtgacataaaagacgtactactgagttgggcacagtggctcacgcttgtgatcctaacactttgggaggccgaggcgggtggatcacgaggtcaggagatggagaccattctggctaacacagtgaaacccatctctactaaaaatacaaaaaattagccaggcgctttggcacatgcctatagtcccagctactcgggaggctgaggcaggagaatcgcttgaacccaggaggcggaagttgcagtgagccgggattgcgccactgcactcaagcctgggcaacagagtaagactctgcctcagaaaaaaaaaaaaaaaaaaaaagacgtactactgggttcaagcagaaagagattcagctgggcatggtggctcatgcctgtaatcccagcactttgggaggctgaggtgggcagatcacttgaggtcaggagttcgagaccagcctggccaacatggtgaaaccccgtctctactaaaataaaaaagttaactgggtgtggtggtatgtgcctataatcccagctacttgggagtctgaggaagaagaatcacttgaacccaggaggcagaggttacagtgagccaagtttgcaccactgcactctagcctaggcgacagagcaagactctatatcaaaaataaaataaataaaaaagaaaaagactgcatccaactgaagatcaagacaggctccagaaaggaggaatctgagaaaagccttccaaaataggacggtttcaacagtggagataagagggaagagcagtcaacaggataaacaaagtcacagaagtagtgaaagaaacagaaacaataattccatatttcagttttggctccagcccagattatgactacaggaaaagcagagattaggccaattatgtgtgagagaagatcttacatattaaggataatctgcatttaattcaataggcagtgaatttccttgaaagacttctgtacaaaacccacgaggtggtcagagctatactttgggcagattaacctagcaacactatgtcggcaatggaagcagcagaggatgctggttcctcaagatcattcttttcaacctttatttaacctaccgctgaccatctgctcctccttgaagccttcttgtgcttctgccatataacaccatcctcacctggcccccaagttctatcctctcccctctttttttttttttttgagacggagtttcgctcttgttgcccaggctggagtgcaatggcgccatcttggctcaccataacctccgcctcccaggttcaagcgattctcctgcctcagcctcccaagtagctgggattacgagcatgtgccaccatgcctgactacttttgtatttttactagagacagggtttctccatgttggtcaggctggtctcgaaatcccgacctcaggtgatccacccacctcggcctcccaaagtgctgggattacaggcgtgagccactgcgcctagcctccctcttgtctttttatcacttctctttctcccaaggtctcatccttgcagttccattttttactctatgcagatgctcccaaatctctctcttgctaccaactctctttccatagctccagatgtacacttcacttgatactctcctggcaatcttaactcaaatgcttaaaacagaacctgctatcaccttctacaacattctctttttcctgtttaatgtatttttctatattctactctctcagactctaggccttactcatctctgattcttcaccccctcccttctccttcacatccagacagtcaccatgtgttatagtttctgctgcttgagtgtgatgccctcattctacaccccttgccacttccttcatccaggctatcatttatgccaagactaataccacagactcctagaagacttctctcacactccaagtcatccccatatctgctggtggaggaagcactcaaaaaacctggctgcgaccgagtttctctggtattccaaagcacctcacacaaggagaacagtcccaactcccaagggtggcatccaaagtgctcctacaatttggctcccacttgcctttccaaactgatcccacactactcctgattttctcatcatttcctgctcagagtccattttttgctgtacctttcttcacaatcaccaccttttccccatttccacaagattaaggcaatctaggtccatgccaaatgccatcatttccttgaagcctttcctgatttttctattgaatacattgtttgtatctcttttatagcacatataaaattctactttatgtattgcacaaatgtctataacttcatagactgtaagctacttgaaagtggtaaagtatagtaggcaatggttgggctttagagtcaggctggattaaaatcctgtcttactatatacgatctatgggcaaattactaaacttctttaagcctcagtttcctgatccgtaaaatgggaataatagcatttacacattattagtattatgaggattaaatgaggtaaataatgtatgttaagtgctacctggcatatcatgtattaaatagtaactactatttttaccatcatcattgttgttaaggggaaaatagctttttcatctctgtatcttctacacagtctcaatcacagaaatcttaataacagtttattgaatgaccaactttggaccacaaaattccattctttaaatatccctgagatttccctaaactgaaacagtctccttttctctcattttacccagtatcctcccctccgccccctaccaaacttacctggtgcaaaatggtatatcgctcacgaaacatctctgctttatctcttggtgttccaaataaatttggtgcagggtggttggtcattaacagactagaaaaagagaatgcctatttttgactatcataatacacaaaggtgagccaaaagtgaagcaagagactataccttctgaaaaaaaaagtacatttgaaattaatttaaaatcagtggatgacatacttacggaagaaatttttttctttctgaattgtacacaaagcgtggaatatcaaatgctcctatgatattgaaaacgtgctctctgaaaaacatcccacaaaatacagacctgatttactaaaacataagtactctaggtgaacatgataacttgcattataagtatttgtaataacacacttttcacattttctcaggccaggcacacaatttctttttctttttctttttcttttttaagacagagtttcgctattgttctccaggctagagtgcaatggtgggatatcagctcactgcaagctccgcctcctgggttcaagcgattctcctgcctcagcctcccaagtagctgggatcacaggcatgcaccaccacgtccagttaattttgtatttttagtagagatggggtttctccgtgttggtcaggctgatctcaaactcccgacctcaggaaatccactcacctcggcctcccaaagtactgggattacagatgtgagccaccatgcccagcccataatttcttatagtgtcaaaaatacaatgggtgtaaaatgtttagcttgtgcattttcatctcaagggacaagaaagcattgccaaaactctcaagaaaaaaattaatcaagttaatttccagttaagaatttcatctgttgaaaaagaagaattatataaacaatagtcacatcttaaagaaatctctccctatatgtactactcttatgagctacagtatttttttttttttgagacagagtttcactcttgttgcccaggctggagtgcaatggctcgatcgtggctcaccacaacctccgcctccagggttcaagagattctcctgcctcagcctcccgagtaggtgggattacaggcatgcaccaccacgcccagctaattttgtatttttaacaaagacggggtttctttatgttggtcaggctggtcactaactcccaacctcaggtgatccacccacctcagcctcccaaagtgcagggattacaggcatgagccactgcgcccggccatgagctacagtattattaaaggatatgattaagttccaacaattttttattttttttgtttttgttttgttttttgagacagtctcactctgatgcccaggctggggtgtgatcttggctcactgcaacctcttcctcccggcctcaagcgattctcccgcctctcaagtagctgggattacaggcatgtgccaccacacccagctaatttttgtatttttagtagagacagggttttgccatattggccaggctggtctcaaactcctgacctcaagtgatccgcctgcctcagcctcccaaactgctgggattacaggcatgagccaccatgcccaaccccaacaattttaaaaatctaaaatgttttttgtttgttgtttgtctgagatggagtctagttctgtcgcccaggctggagtgcagtggcacgatctcagctcactgcaacctctgcctcctgggttcaagtgattctcctgcctcagcctcccaagtagctgggattacaggcaccctccaccacgcccagctaatttttgtatttttagtagagacgggttttcactgtgttggccaggctggtctcaaactcctgacctcatgagctgcctgccttggcctcccaaagtgctgggattacaggcctgagccaccgcgccctgccaaatctaaaatgttatgcagaagtgtcccaggaaaagttacacaatggaaaaagagctccccctccaattctggccatatctttcagacttatacaatatatatatagtgttagagatggaaaaccaaaaaaaattatttaatttcagatacttttaataatataaccatgtttaaaagaagttaaaaatttccacagcactactgtataaatatcccaacctaaaaatctttcctaaaattacatgtttatctcccaaattgaaaatgatcaaaaaagattcatgctaccctagaggtaacaagtatagagtggctgagaatcactgaacttgaggaaaacctagactccagacactgctccactattttctggtagatcagtctgagtaagttattgaacttctcatgccatctcttcatctatgagaacaagagcctctactgtggtatgatataatgactctctgacaattgaaggtacaaaaatcctttaccattcagtccccactggacctccatgtaggctggctataacatataaacagcctgacagaaatagccgagccaggtcagtgaggagtacgggctggccgacccaggcactgcgcactgaggccagggatgggcctgagccatgcacctcctctgaaactaccctgtgccctgcctttgaggcctgacaggtgtgggagcaggagctgcccaaaagtgggctggggttggaggaagcatcctggtcgttgctatgtgccctgaggctttaaggcacctgaccccacccttgctgaactggcatcaccaggacctgtttactctagatgagaatcatgatccctgggcgcttagtgcattgcctggaagagcccactcatcctggacgagccctttggcagcctcagacagtccttgaggaggatgactgagacatcatgggccatgcactgtgtgcctgctcttagggaaatgtcatcattgacaatagctatttcttcatccagaacctgggggagagtgggttcagccatgtggacctagtggaggggttacaggatggacacttctacgccctgaagcgaatcctgtgtcacgagcagcaggactgggaggaggcccagccaagaagcaaacatgcatcacctcttcaatcaccccaacatcctttacctcacggcttactgtctgagggagtagggtgctaagcatgaggcccagctgctgcttccgttctttaagagagatatactgtggaatggagagaaaggccgaaggacgatggcaacttcctgacttaggatcaaatccttcagctcctgctgggtatctacagcggcttgaggccattcatgccaagggttaggcccacagggacctgaagcccaccactatcttgcttggagacgaggggcagccagttttaatacacttggatgccatgaatcaagcatgcctcacatgaagggctcccaccaggccctgaccctgccggactaggcgacccagcagtgcaccatctcctactgagccctagagctcttccctgagcagtcactgtgtcattgatgaacagactgatgtctggtccctgggctgtgtgatatatgccacaatgtttggggaaggcccttacgaaatggtgttcaagaaacgtgacagtgtggcccttgctgtgcagaaccaactcagcatcccacaaagccccacgcattcttcaggagtgtggcagctcctggcctcaatgatgactgtggacctgcagcagcaccctcacaatgcttgcctcctcagtcagctggaggtactgcagcccccagctcctggccagcacactgcccaaatctgaacaaagcagtggccatattgagaaggtggcgccttgtgccttggaaagaggctcccatcactcactggaatctctacccattctttctttattttattttatttattttatttttttttttttgagagacaagtctcattctgttgtccaggctggagcagagtggcacgatcttggctcactgcaacctccgcctcccgggttcaagcgattctcctgcctcagcttcccaaatagctgggactacaggcatgcaccaccatgcccagctaatttttgtattttttagtagagacggggttttgctgtatgttggccaggctggtctcgaactcctgacctcaggtgatctgcccacctcggcctcccaaagtgctgggattacgggcatgagccactgcgcccagcctgcttttctgctttcttacccccaagagcaacacctggacaaggggctttactgagtgggggtggaataggggttgggaaaaggaaaactgatgcgatatggtacatggctctgtgcaggactgttgagctcatattacgttctgcctccaaatctgggagcaagagaatgtataaacagaagaataaagtgaatgcagattggtgtgggggaaaataagtaaataaataaataacaggtaactttagggtaaacaacgagtaacgtctattttaggataataatcaaacttcagtacaatcattttgaatttctattgatggctttaggaacattcattatactccagtatttattttatgtattttttttgagacagagtctcactctgtcgcccagactagagtgcagtggtatgatctcagctcactgtaaccaccacctcgcaggctcaagcaattctcctgtctcagcctcccaagtagctgggattacaggtgcgccccactaccgcccagctaatttttgtatttttagtagagatgggtttcaccatgttggccaggctggtcttgaactcctgacctcaagtgatccagccaccttggcctcccaaagtgctgggattacaggcataagccactgcatctggtcacactatagtattttaaatgagtttgcaagggtaaaattaaaaatcctcaatttctctattttttttttagcagttataagttctgacagggagaagattataacttctgactaaaataaagataatgactcctttcaatcatctccattgccccaaataggaaagaagtggcaatgttaaaactgtctctcagcccattttccccagtgttttccttccagttaaatgccatcaatttgtatagaagtatcatatcaagaggaaagagggatattcagagaaataaaacccagaagaattactgccatataaattcttaaacctaaaaacatgacatagtggagtcacaaaactgaggtcctaccctcatttgccattcaccatgtgaccaagtaaagttgctgaacttctctggacatggtactttcctaagagcaaagtaaattatacttctgaatattcatttcaattcaactcatttgtagcatacagaataaaaagtcagatcaaccggttgggtaggcagcaaaagttagtaatgaatggtacaagcaacactgtaacctcaaatcccaggaaaaaccagtaaagatgagtcatttaataatgaggtttgcaaagaaagccattatttaaaaagacacacagaaataacaacagtaatcactgtagaaacgttgatcactaataattttccaagacaataattaaaaataagtgctcaataacacctccaaggaggaaaaaagttaactgtacccacatacatagtttcatcaacagactgactgcattcctggactgctgcttccaccacagatcgttcaatcatgtttgatgacactgaaaagagaatttcaaagtcaaaatttaaaaacaaaaaaaaaaatagttctttccacagacagctcttttcccaaaaataatttgcaaatattaatactgagattctcattatacagtttttggagaaaaaaagtgttaggtcagaacaataacaaaagccttatctcaaataccttcattttccacactcaaagttacaataccttaatatacagtcaaatgccttaattttctaaaccctgtttagttataagaacatttctgagctagggtcggtggctcacacctataatcctaacactttgggaggccaaggcaggaggatggctcgagcccaggagtttgagaccagcccagacaacgtggtgaaaccccttctctacaaaaaatataaaacttagctgggggtggtggcacatgcctgtagtcccagatactcaggaggccaagatgggaggatcacctgagcccagggaggtggaggctgcagtgagctgtgatcatgccactggcactccagcctgggccacacagagtgagatactatctcaaaaaaaaaaaaaattctctaagctcccagttttaataaggttacattagtataactttatcatcataactgctcagtttcaatgagcatgatagtaacaatagcagctaccacttattaagcattgagtaaatgtgtggcaccatcctcagtactttatttacaagtattattccactgggtagatgtcctgtaagactgatgttaagatgcccatatcttatagatagggaaaatacaactttaagaggttgaaaattttgcccaaaaactagaagagatagagagcaacaaaaacccaggactgattccagtgggggctcttttaatcactttgatatgttgtcaagcaaaataccatgtgccatcttaaatcaatgtacacagggacaagtatcattttcttttttttttttttgagacggagtctcgctctgtcagctaattttttgtatttttagtagagacggggtttcactgtgttagccaggatggtctcgatctcctgacctcgtgatccgcccgcctcagcctcccaaaatgctgcgattacaggcgtgagacaagtatcagtttctaaatgttcaactgtaaaggaattttttaagcaaaggtatatgtaaaattctgcctttaggaatgaaaatgagatataataaccatttatcctgtatcacggagtatgtttcttcctatataattgaagtgactagcatctatataacattaagagtgaactcggcacttctcagccttttatgctaagataaagtggacagtgagccatacccacttctatcctcagggtgctataaatatcagactttttttccaaggggaagagcatttcttctttccagtcccatgcttgtggtattaagtatttaacaaaaaggtccctgaatccctatggcagtgtggcagtggcaagaggaaacatgctgatacagttttactgacaggttgaatagagaggtgtctcagaaaactccccgaagtatatggctgaaatggactgcaaatcataaaaaactggaacagaggtttagttcatgtattggtggccccattctagcttctttgggcatgtttcaacagatgtgactttccaaaaaagaacatgaagaaagagaggaggggccaggtgtggtggctcacgcccgtaatcccagcactttgggaggccaaggtgggtggattacctgaggtcaggagttcaacaccagcctgaccaatatggtgaaaccctgtctctaccaaaaatataaaaattagcctggtgtggtggcacgcacctgtagtcccagctactcaggaggctgggacagaagaatcgcttgaacccgggaggcagaggctgcagtgaaccaagatggcgccattgcagtgaaccgagatggcgccattgcagtgaaccgagatggcgccattgcactccagcctaggcaacagagtgagactctgtcccgctctcaccaaaaaaaaaaaaaaaaaagggagaggagggaagcagtgtgtagaaagcaaatgccttgaaggagttcccaaacctctaccttcctgggtcaccttatgtttcataactttggtatactcaagaaaaaaatgaccatcttttatagaatgtgcttttcttgaaatccacttattcttttttttttttttttttgagacggaatctcactctgtcacccagtctggagtgcagtggcataatctcagctcactgcaacctctgcctcccgggttcaagcgattctcctgcctcagcctcccaaggagctgggattacaggcgcctgccaccatgcctggctaatttttgtatatttagtagagacagggtttgccatgttgtccaggctgaccttgaactcctgaactcaggcgttcccaccagcctcggcctcccaaagtgctgggattacaggtgttagccaccatgcctggccccacttattcttatcacaagcgttatataattttgtatcaatgtctattttcaccaggtacaatggctcacgcctgtaatcccagcactttgggaggccgaggtgggcgatcacctgaagttggcggttcgagaccagcctggccaacatggtgaaacctcgtctccactaaaaatacaaaaattagccaggcatggtggcgcacacctgtaatcccagctactcgggaggctgaggcaggagaatcatttgaacccaggaggcagaggatgcagtgagccgaaatagcaccactgcattccagcctgggcgacagtgcaagactccttctcagggaaaaaaaaaaaaaaaaaaaaaaaaaagtctattttctacagtttgctttcagtaaaatgccttccaactctgtttagtgtattcattatcagtgcattagtagaattgctttttattgaaaagttactgtctctgccctttaacttagacttacaaaattaagttaaaatgactagccattctattaaaaaaaaaaaatccctgaagaaatcaagaagagatgtcagctctgtttactttactcttctttttttcctcccaaacatttaggagttaatgacttaaataagacatggtaatagccactaggagagacaaagtgaccataaaggaccagatcaaaatcagaagccaagtgcaggaaacatggtggtgacacctccactgggggaaaggaactataaaagggcccttggggatcatcctgaggttccaactaaactaagggtttggatgtcatcaacagttaaaataaaaaaggccgggtgtggtggctcccgcctgtaatcctagcactttgggaggccgaggcaggtggactgcgtgagcccaggagtttgagaccaggctgagcaacacagtgaaaccccatctctactaaaatacaaaaaattagcctgacatggaggtgtgtgcctgtaatcccacctactcgtgaggctgagacaagaaaattgcttgaacccgggaggtgggggttgcagtgagccaagatagcgccattgcactccagcctgggcaacagagcgagactccatcccaaaaaagaaagaaaaaaaaattaaaataaactaaaggtattaccccttgggaagaaatgctaccatgcatacatcttataacactgggacatcttaatagtgaagcctcaacttcaatttaaatctatacatctaactgaagatgcagaactatattaacaatttaggagttatcagaaaatattacttacagggttgcttctcaactgcattaattatcttttccagtttatcttcaagctctaattcactgatagactgaagagcttctgtgaggtacttaatagcttcactaagaaaaggaaaggaaaaatgaggcaggtcattagtaattaaaggctaaaagttttctgccaaaaagcagcaaatactcatcaatctggcactgaaaggaagaaccactaactgctctcttcaagtagcactttatctttcctgtgctttctgaacaaaatcatcctcctatgccttgctaacataaagcctcaaatcacatccttcctctaagaaggcttcctagaccagctctacctgctgcaatctcccctttcttctgaaattgttaaaaatcacatttacatataccttagatctgatatattacattagccttttattacttactaccctacatttaaggcaagagtccatctgtttcaatgtcaagcaccatatcctgaacataagacactcatatatttaatttgataatgcacttgttcaaagtaaattccaataatcactgttttcaattgtaaaataagaaaaaaaataggcttggctgtgcgcggtggctcacgcctgtaatcccagcattttgggaggccgaggcgggcggatcatgaggtcaggagatcaagaccattctggctaacacacgatgaaaccccgtctctactaaaaacacaaaaaatttagccgggcatggtggcgggcgcctgtagtcccagatactcgggagactgaggcaggagaatggcgtgaacccgggaggcagagcttgcagtaagccgagatcgcgccactgcactccagcctgggcgagagagcgagactccgtctcaaaaaaaaaaaaggctttaaaaaactatgacatttgaatataatcatagaagcaacactcattaaaatcacatgaatttgtgttatacgaaaggagaggttggcactccacttgacaaagatggaagaggccctcgggcctgacaatacacatatggtaaggcactgccacctgcttcatggagtctgaccatcattaaaaaaaaaaaaaaaaaaaaaaaatcatggctgggcacgcggtggctcacgcctgtaatcccagcactttgggaggccaagacgggcagatcacgaggtcaggagatcgaaaccatcctggctaccacggtgaaacaccatctctactaaaaatacaaaaacaaaattagccaggcatggtggcgggcgccggtagtcccagctacttgggaggctgaggagggagaacggagtgaacctgagaggcggagcttgcagtgagcggagatcgggccactacactccagcctgggcaacagagaaactccatctcaaaaaaaataaataaataaaataaaatcacattaattccttacctaaatcccaacaatgatcagaatgaacatgattaactagttacatgccactacatgccattctgtatttgtagcacactttatacctcacatcaatattattgctgattacaatattaaacaattagctaattacatgccattctgtatttgtagcacacaatttaacatttcacatattattgttatagccataacactaattgttctatatattgggttgctttattagttgttttgtgtgtaggtgttgcatctctcaaatttattatagataactgagaactgaattatagataactttaaaactgtaacttagaactctgtgccatccttccacagagttctaaatacacttgaaggtggtccataaatatttgaccactgagtccctaaaatcatatacattttggttgcatcttgggacagttcttagcatagaccaaagcctgtaaagccatacagaatcttgcccctgccaaatcccattaagctcataccatgtccctggccttcctggcactctcctgctttagggtctttatatggccatttcctcccactcttctctccacctagtcaggtcctgttctttcttttttttctttctttcttttttgagatggagtctcgctctcttacccaggctgaagtgcagtggcgtaatcttggctcactgcaaccttcacctcccgggttcaagcgattctcttgcctcagcctcctgagtagctggggttacaggtgcacatcaccacgtctggctggttggtttttttttttgtatttttagtagagacagggtttcatcatgttggtcaggccggtctcgaattcctgacctcgtgatccgcccacctcagcctcccaaagtgctgggattacaggcgtgagccactgcgcccagccaagtcctgctcattctttaagtcagcccaaaccacttctgcagtgaagttcttccttgactctagggcagtttatacaccttatcataaactctcatagcccttctttcctggaatccctttcacaattgagattaaatagctgtaaaatagtcatttaatatccatggtagacagacttctaagatggcccctaataatccattactcctggtagttacacctatgtaatcccctgcccttaagtgtgggctggacctagtaacttgtttctaaaaatagaatatagcaaaagggatagaataacttactgtattataattttgaaagtaaaatttaaaagtaaaaaaaatttaaaaataacaagatgtcacctccttgattaggttgcctcagagttactagaagactctctctcttgatgaagccatgttgggggcacacatggcaagggactgaggatagcctccagccaacagcctgccaggcaatcaggaactgaatcctgccaacaactgaatgagcttgaagcgaatgctgtctggacaacatttgagatgatccatcttgactgcaaccttgtgaaaagaccctgaagttgaggacccaactaagccacacctgaattcctaacccacagaaaatttgagataatgtgtactgttttagcctttaaattgtggggtaatttgtcacgcagcaatagaatacattatctgccccctacaaagctcttgctctctattgcacccccttaccccagcacggtgctttgcagctaacagatttaagtatacttatgactgaaataattaatgaacaaaagcttaatattaggtcaaattctaagcgaaaagaaagttaattcatcagttcctcatgctttcaaaatgtcaaggaccaattgaacaaaattcattattttctcccaaggcatctcccaaagcacagttaaaagtcccataaaactcacaaaaccaaccaaaaatctacacacacaaaagcaataaaaactgatacagagaggtatatccaatccagcaggtatttcaatatgtataaaatattgtgttctaggtcaggcgcagtggttcacgcctgtaattccagcattctgggaggccacggcgcgaggactacttgagcccaggagttcaagaccagcctgggcaacatagccagaccccgtctctaaaaaacatacaacaacaaaaaatcagccaggtatggtggcccatgcctgcagtcccagctacttcagcccaggaggttgaggctgcagtaagtcaagttcgcatcactgccctccagcttgggcgagagtgagaccatgactcaaaaaaaaaaaaatacatatatatatatacacacacaccacacacacacacacacacacacacacacacacacacgtacatatagaactctaaaacacggagcagatttaatgagagaaatcttgggaaggttcatatgttctataggtcctcaaaaacacggatatgcccaggaaacctgactttcacataaattggcaactgcagacgtgcaagtgggctttctcgggtctctcatcttatgtctcagcaaccttcccgggagcctgagagctgtccaggtcacaatgttgataaccggctgccatagataggttgcagcttctcgggctcagtttgacatgtgcagaagagcctcggcccgcctagaagaaacattaaactcctcgcatgggtcggggaaaccaaagaaggcacggcagcctcaagatccacctcgcttcttagaacttttttttaatggagtctctctctgtcgccaggatggagtagagtggcacgatatcggctcaccgcaacctcctcctcccgggttcaagcgattctcctgcctcagcctcccaactaactgggactacaagcgcgcgccaccacgcccagctaatttttgtatttttagtagagacggggcttcaccatgttggccaggatggtctcgatctcctgacctcgtgatccgcccgcctcgacctcccaaagtgctgggattacaagcgtgagccaccgcgcccgaccgcttcttagaactctgaaatttaaggtcaagccccctctcggcgcgcggggagccgccgcggtgcgtcccgctgccgcaccaggcagacgggccccagctcttccctctcgcccttcaagctgcccgagcccactcacccacggagcagcaagccccgcaacttgaaggcggagagcgcccggctccgcagccgctccggcgccatatttgcgatttggcgccaccgccgcagctccgccccttcccgggcgcgcccctcccagctccggcctcggccctggcccgcgtggcgctaaaccctgttaagatccctgcttggtctccgctgcctgcgccgcagcaactcagaccttacagttcgcaaccccggaccgagtaggct

SEQ ID NO: 2696 - DNA, 44829 bp, Homo sapiens; identical to SEQ ID NO: 2694
  source 1..44829: mol_type = genomic DNA

SEQ ID NO: 2697 - DNA, 49841 bp, Homo sapiens
  source 1..49841: mol_type = genomic DNA
gctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccgggtaagtgcggcgctcgggccgacggcgggctggcgggcggtgcgggcctgcgcggcggcggcggcgggcaggcctggggcctgtaaacaagccgggcgtctgcccgggcgctcccgggaggagacgcgacaactccaccccctggccggcctcctcccccgagccgggcggcggacggcgaggggttaacgctcggcgagggcggtggcggggaggcgggggcggggtgttagttgcggtggcgcggggagggggcgcgaccctctggccgtccgcggccgagatgggtgtttgtggcggcgaagcaggcgacggccgcaggccggcctggccggagagcggcctgcagaacttttcccgagcggggagggggcgtccccgcgcccccacccgctcgggcgcgccgccccggctgtcctgggcttcagcccctgggagggaggcggggagacttcctttgaaccgggcttagcctcgaaaaacctaattctgtagaaattgcttaaggttttacagggggcagggctgagagactccttcagaactcaagtcagtgagtgatgcctctagttcattcattattaaggcatcgaacaaatccattgaagtaaattccgatttcttatccttttaactacgtaaatcgggtaaaacttcttgatgttagagcttggttgaggtatggttctgttctgcttgtagattttaaataaacttggagccttttcttgaaagacagctggctgtggagagccttctaccaactgcagttttagatacgttttgaaaatttcatcacctgaggtatttttcttctctcctgaaacaccacatggtacaaatccacaaaagtcatgcttcagttgtccaagccatgggatctgtgtgctagccccacctccccgcaagtttcctgctcattggaataatgagctgaatgtgttttaagaagtggttggaagagtatgagagataggtatcattttctcaaaggaaatgattttgacattattgagagaaattagacattttaacaattgttttgtaaaacagtcttttcaaacttgcacgttggggttttaaacacaaccactttacatgtgttgcgctccgaaaagtggagggatttgttgaaacactactctgctgagacttagggttccagagcacttgggaatttagcatagcttggtccccaactctctttgaaacactttacttttatacttttatcttgctacatattgggccttttccaaagattgtatttctgtaactccttattttacaaatgagaaaattgaaaataaggagattctctattcttagatgctgcttttactgacttaatgctttctttaccaataaataatttgaagcacaaagtaacatttcctagtgttatagttttgttcttgttatgtgtaacttatatgtatctgattaaactttcagtcatgtaaggatgattacttttaacctggaagtttacagcagtaccacattattgaaactataatgaacttcctgcacatggcagttgcctaagacattttaatttgatatcataaaacatttttagatcggtgaagtaattatattatgggaaaggtgtattaagactgataatgtttgaagttaactacctcaattatatttgagaaataatagtcatcaaattgctttttatttggcttgtatctttttatgtattttgtgtacatattgtatctttttacatgaggggctgaggtatatgacctgttgaagggaacagtgcagtaggagacaaggattgtttagtcatggctgtgctccaaaatatctgtgtccatggacaagtcctttaaccttttgagtttcagcttccaaatcagtaaagccagttgggcagattatattatcacatgtactgtccagttactacatttaaaaatttttttttatcaatattgtgtgtctagtcaacataccgttgccaaataaatgcctgttatgtgtcaggcacttagatgtttcagtgttctaaggctggatttctttctcggttctgttttatttaacaaattctaagttggtgatggttctttagaaaagctgttcttgtgttcttgtaagctattgatttttcttttgggattgggatgtgtagggaaactcttgagaggaaggaggatggagatttcatgggagacaaagggtggttgagactacaggtttgaacaagcacaggacccttggtagtctgatgtgaaggacattataaaaacacattatgaaggttttttctgtcacttcaagctgggtcttgttaaacctttgaaaattctctaatacctcatttgtttttgaaagaaatctatagcaacatcattttgtcatgtggtaaatattgctgagcagtcactaaatacctatagtcttttagtttgttcagattacatctaggccatttgtttactctaatagctaatagaatgtacagctgattttggtttaactgtgcgtgcatatttgtaatttttaaccaagaagtggcatatgtccacaaggaacttgttatctctgaaatactcacccatgagagctggattaattttttaagatgtaaatctatgctcatgtagaaataatataacaaggtgatattttgatgatcctctcaaatgattatctaactcttgcctgggcacctgactctgagtcagtatactcttgaatactttccatccttaatcaaatcaggagaaagagatggccatgtaagaaaattggccacggcagggttttataagagttaagcaagaagataaaacaacacatggccctgtgaaatatataaaccttggagaagaggagaaggtatagtgaggcaactgggtaaaagttgtgtcttcctctaagtaattttatgtcacaatatgtcctgtcttccatctcaaataacaaattttaaaattaagttgtgtttgttattttgctattagccaagatatataaattaactgacctgggattattagccatttgtatatgaaataaacttgggttaacctatatcaaaatcaaaagattgattatattctttacccttcactctttcaaatgtcttatgttctccatattacgtaacaattttatacttcattctgagtctccagaatatattctttgatgattttgacctttgaatgtcctggctatccatgtactacctagataatctcgttaccaggcttttcttttgctgaggcaggtcagagctagagaaagtaagcaattgagagaggcaagtttctgtatacctgtatctaaaatgtaatagactttataatttttgtaaggaactgaggaaaggtacaggcttttaatgtgtatcagtaaactagactcttatacagtttttataatattagagatgttttaagcttccttgagtaaatatgtgataaaggggggatcttgagtttttataattcttaatatgtttatttggaatccattgaccaagtgtatgtagtatccatatttaagatctggattaaaagtgattagtttctgtggctgatacgatttagaattaagatcttttgagactaaactacttctagatacagaagaacgtcatgaaagccgtactttcttggccatttatttgtgttaggctttaattttttgccataaccctctaaaatatgtgatgttatcttcattttataaataaggaaatacagggtcagagaacctaaataacgtgccaggatcagatctgggtagatataaaagtatttttcaagatattactgagtggatttttcccaattagatgaacctccttattaccaggaaccaaaatttcaaaagctaaacattaacacttacgattcatagattcctagagttaagcaagtccatgttagtttatgtaaagtcttccaatgcaagactaatgttttcttctaaaacattcagaaaagatttaagaaattaagttcattttctcattcccaaagtttcagaagttaacaaagctaaacattttatgtcttcaagtaccattgtttaggttaaggaatggaatccatgttaattctcaagtggttgatatccttaatgaaggatctagggaaatgtttctgaacagatgtaatcagtagagccacattgaagggccccgtggtggacatggtgataaaactaacctttgaaagaaaggacagtttgagtccctgttctcctatttcgtagccaggtgttcctgggtaagctacttgatttcttaaacctgtttttttttatgtcaagtggaaatacttttgtcgtaaggttatcttgaagatttaatgaaataattatataaagcatttgagatcttttctaccatgaagaaagtgccaaataaatggtagctgttattattgagtatatgaaatcttgagatacttaggggtatagagacttgcttagtatgagagggttgtctttcagtatagcttttgcagtgtgcctggaagccaaactagagattgagtagagaatttagaagacattgtaaactctgtgagtttagagagcttgcatttgaatagactaaaagttatagaagaaagagaaagttgagtatgagtagctttatttggctctgcaaagctggcaagatgtcaagggtttggagttaatgattaggtgggagtagatggttaaattgcggataaagagtaacagtaataaagcaaaggtgaatgttcaggctagaatgatcagtcagtaaggaaggacaagggttggtattttgaagaggagttacagtttatggttagaaatgagcaggaagatatcattgctacaggaaaggatgcaaaagagtaaggaaactaaatcattctgattaactcagttattaccattttttaaaaatggagtctttataaaaggcgttaaggctttatatgtgagttctaggttaagtctgaaaaattgtcttggaatagtgtgggtcttactactgcagacccaaaccaagatattagcattccaactggtctctttcctgctagcatcttgtactgcatctcctccctgattctataaaccatcaaaattctttctaaactatggtttttcattatatcatttctctcagtatacttcagtgactcccatttacctctggaataaagttcagaattcttggtttggcttttgacactttccatgattggacctcaagacattagtctgttataaccaaactagtacacttgctatctctggaacacgctcttttctctccatggatctttgctcatgctagtgtgcagtctggaatttgtgtctttccttctccagctttggttttctcttttagcaaagctcatttctaatatttcttcttccacaaagtcatctctgacccccagagtgtttaatctctcctttctctgtacttaaagcaatgtctgtgtattatttctatcatatgttttttttttttttgttttgttttgtttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatcatatgttttacctttagatatttgtgtctaaattataattgcattcagttaattctaaagggaaaaataaatttttactttacacaaaggctagcggctagcacagtgctttatggatagtagacattcagatatttggtaagtattaagcaaaatctacctggagtgaaagtgattgttgtaggaggaggtagtagaagtagttacaagctttatcgtagcagacgtttctgactctcttcctgaatgttattttttctgaacctggatatttaagtgtgaagattatacaaatctgaagtgtggcagtgttcttatattgatgtagaagactaggttgactgatcctggacctacaagcttcattttaacttcctacattttggctttgagggttaacaggacatttataatcacatatctcttttcagagtattttacatttgcaaatattatcatgaactttgtgtccttttaaccagagaggaattgtggaatcacaggaattagatgatgtgttaaagaagagagataactatcagctgatttaatttgaacccaacaagtatctaataatatgcatactctgtgttcaaataaacctctaagctagactttcaagcttatcaaaatgctagactattttcagtgtttagaaaataccagccaggtgtggtggcttatgcctgtaatcccagcactttgggaggctgaggcaggtgaatcacaaggtcaggagatggagaccatcctggccaacatggtgaaactttgtctctactaaaatacaaaaaattagccaggcgtggtggcacgggcatggtggccacccgcctgtagtcccagctacccaggaggctgagcaggggaattgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaatgagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggtttcattgctactgcggaaagtaagtctcttggccattgtgatgggtcaaaatctttgtacatgaagggtatgactgttgttccattgtatccagagagtgaatcttgtgattgagttgggatttgaggtggcagtgtatactaagtttgaaaagtatattatcatatgttagctccctttagaaattttccccaagaagagctattacattttttaatattaaaaaagcataagatatggccataatacaattagttccacaagccatacacacttttttcttatggcttaaaattttattcatgtttactactttgcaacccactgatataaattatttcacagatcctttattcaaatgaaattctcagtgagtctgagaagatagtcttaaacacaagctagctgagtttacaatagagattatactataaatggtaacttcaatgtttattgaaaataaattccttaaaaacaggtcttgtttcattcatttaaagagattatcaatatatgactgttaaatttttatagtctccctgttcattttctgatgaacacatgacagaaaattgaatgtgagctggaaatacagcagactatgagaaagcatgggtcatgtataatcactttaaatttaggctggtgttttgtattcatctataatatgaccacctcagggagggatgtaagtaaacattctttttttagttatactttaggtggcttaattattttaaagaatatgttattcaagaattgtctattgtactgttttaaagaataagaatataattcattaccaactttgaatgtcttggattcttagtactacctttttctttatcatgactagtaggatcacatcataatttggtactgtgtgtataaagatgaagtgtgcttacctttattaccaaaattcagaaatgaaaatgtgaatgataaaagataagggatggctatatatttttttgtttttgtttttccaaacagaatctcataacttaccaggctttagaaaaacatctttgcagtatgccatcatacctcagaatgttaagtagataggaaataaaattttcactttttgtaaagcagtagggtattatcctttctgacagcctgtaagactgttttggttgccaaggggccaatcttagaagtggcagtttttgttttgtgaccaacccacagcttaccctttgttagtccatatctgtcatcttcattttctctttctgcgtaaatgcttcttgatacagtaagcaggtgtttcaactagtcagccatctagtgtgatcttttctggtttgctacagtcagtaaaataagtagctctataagtgtaaatagtattacttgttttatgtagtaaaactccaagattaagttagagatatttttggctagactacattgaatgcattgacaatggatttcccagctcccagaaattcgtttgtgtctgaattactttatacttggcttattgtgtagagaaaactttagaaaaagttcatccatccatgaatgttgaatgaatgagcagattaataaataaatagctcagggaaagaaaatgtgtgggcttttagtcataactatgttttttctcttttgttcccttccttatgtgccatttttcaataatgggagtgtgtatctaatgatgttgataaactttttaaagtcattgatgaacagtaatctgaaaatcaagttttgattaagccgtagatttcttttagggtccaatattttctttttagaaatccactatgatatttttgtagggataaaagacaaccatgtattctatagatggaaaatggtaggatacagtttgttggccggccaacttctctgaaaatactttttcctgcatagaagataatcagtgttgacaagggagaagccaaggtataatggctgttattcatctgtctcatgtattcgtcaagtgtcatgtgttaaatatgaacaaaaaagacataatctctttcctcctggatcttaaaatctaaagtgagagataattcaccagataaatgctgcgataagggaaatagaggattctatgagcttatgactaaggatagatctgtttcctcagatgtggaactaagaagtggcagtagttgagaagttcattttgggccatgcgatttgaggtgtggctattcaagtataggaggtaggtggttacacattttttaagctattaaatagaactttcacttgaaaaggtttttttctctctttcctcagcatctatctccctacatacacaaaaaaattgcatgtcacaattcatgaactcagtgagtgactctattttgaaaaatgttagattatatcaactgaagtctgttagaggcaaatgcttttggtcatttttttcagcagggacatttcatatgtgtaaaatatttagaatccccatgtatttatatataaatgaatcttttaccatcttaaatgtttaataagttatatttttcctttctttcaacttaagtatacaaggttatcagcaaacatttgtagatgctctatgtgaggtgttttgtttattagttttaaggaagagaaaaaaggatggattggatcaggaagtcagttattgttttctgggttagtttgagtccaaatcctcaaatatgcggcgatttataagtagcaaactaggaatttaatccacttcagttttggataacttggataagacactttctgtctatagatctgtctatagataacttggataagacaagttatccaaaactgataaatctgaattagttaacagatgaggcaaattgagattgtaaatgctaaaagattattagaaaactttataaactaaatagttctatgccatgtctttttagtattttgcttgtactataattgtagtgaaaataggtcagtatctaatttttatagtcactagagctctccaactaaatttagcttagatgtttttctagcaattatatacttacaaagtttacttttaaaaattgtgtaatacatgcctttatagaaatttaagaaaacgacttatggattatgtacttcagatcacagcacaactagaagatgttgatacattacataaaaaatcaggaaacctatgaagaacatcaaaagtggcaaggtgtgttcacttgcactttgtgagattgaaactgctgccattatctgtgcaaactatggtttgagtacttttaatttagcaaagactaattattttttaaaaattttggggtaaaaaaaatggtctttagcgtagaagagctttacccgacttactttagttggttcaattggttgattttggtttgctttttgaaattttgtattgtcttaatttggggcacattgaactcaataacagttcagttgcattataattcatttgggtaaagtttattgttggaggagggtaagtaaatatttaactgaaaaagtgaagtaaatatttatttaaggctataagttgaaatatttgtcagctgagaaattttcaggtaacttttttaacctttgaaaaaaatttactatagcatgagtattttttatactgctatgtataatccatagtcacgttttttaacctttttatataaaatactgatacagaaaaccatacaatcatagtaatcttttaaaattgctttataattcacatagcgtaacattcacccatttaaagtttacagttcagtagtctttagtatattcagacttatgcaacgattaacacaatttaattttagaacattttcatcacctccaaaagataccctgtactcattagcagtcactccccattcaccagtctcccagcccttatcaaccattaatccattttctgtctatagatttgtctagtttaggtattttatataaatggaatacaggtaactttttattagtgatttttcacttacatgtgtcttgcatgtctcatgagatagctatgaataagttagccttcttttacaacttaaataacaattcttgtctgaccgggaaaaagtattaagttattgagagactgcatcccaatttaaaccaagaaccagactccttactagtattataactcaaaagaatgtgtaccattagcccttacctctggtggtgcttttcactgtgaattgttcagcagcctctcaacttcccgaaaataccacttaagtcttaaactcagacttgcatgagtttactgagatatgtttacctttgcagctggcttgcctagagtctaccttcttactaccctactaagtccagaatgaggaagaattaaaagcaagaaaggagatacagaagaagagattgctcaggctgaggaggggcaaagtgataagagcaggattagaaagagacattaaaaattcaaggatactgagtttgttggcatcagaataaatcttggaggctgttttaagagggaataaaacctagagggaaggaataaaaggcaaagatgttataaaacataggtaaaatatttaaaatattttgtcctgaattttgaattttaggcatatgtcagtgaagcacaaaggatagcccccttttttgatgagctttagtatccttaagatattttctttctagaaccttgtgtaggaattttacagctgaccataatcatgtgttctctttggtttgttccaacatctttggattggaaccagtacagagtaggaaacccatatcaccttgggattatttttcagataaatcttccagaggattaaatggcaccatccccgtcaggtccaagtaggaggggaagaatcctattttgggtgctgtcagattcagtgggctgtttagttcactttttatccagaaaatggagctaaatgagaaattgcagcttccaaagaaaatcataccttgattttatagatcaaagcctttctgattagatcagaattgttcctgagattttaggggcattcagttaaagtgccccaagaagagtgataaatcacatataggtgtaaagtcaataaagtcctatagtaagcagactggaatttagggggaggggaatacacactgttagactgttggtacctatatttgactactaggatgattatatattttaaattctgtattcagtttcttatcagaaatactgcctacaatatcttatacttaattttttaaggaacaggtgataaagataggttatattttcttcagaataattgatattcattatttaatagataaaatgtgttatctgaatgtttatagtagtagaaaccaagtttacaaaatgtctatatataatttgtttttaataaccaaggattctttctttacaaaagatttcctctatataaatcttcctgttttatagatgatctgtattataggagaaatgagtatttgttgatttaactggctaatctacaggactgagcattattagaggagtatttaaacatagaagtctgtgaaaatatttttagtgctgagggaaattggagggactttctagaaccgcaaactaatagaaaaccaggcatagtggctcaagcctgtaatcccagcattttgggaagccgaggcgggaggattgctgaagccctggagtttgagaccagccagggcaacacagtgataccttgtctctacaaaaaaatttttaaaattagctggacgtggtggcacatctatactcccagctacttgggaggctgagacgagaggatcacctgagcccaggagctccacgctatagtttgagttgtgatcgtgccattgcactatagcctgggtgacagagcaacaccctacctcaaacaaacaaacaacaaaaaaacccttctacctctgaacatgtggggatttaaagattgctatgatttaaatataaatcatgaatatagaaaatatgagaacagaagagtatttgttaaacaagactaagctgtgctgcataaagtaaggcactatcattgtgctggtattttctgattctcttagtgcaataaatgttaaactttactactaccttagccatgttgcagggaattgacatgaatagttcctgggttttggctgggtgcggtggctcacgcctgtaatcctagcactttgggaggcttaggtgggcagatcaggagttcaagaccagcccggccaacatggcgaaaccctatctctaataaaaaacttaaaaattagccgaacgtggtggtgcacgcctgtagtcccatctactcaggaggccgaggcaggagaattgcttgaacctgggaggtggaggttgcagtaagccaagatggcaccactgctcctagcctgggtgacagagggagactccgtctcaaaaaaaaaagttcctgggcttcaagggcactctaatgtgcacatcttaaattcttagagcctacttctatggacgatttatgttactgttgatggagaatttgattttcttttttatcttcccctttcccttggcctttgtaggttttttgaagtgaacatacttttatgtatttacttatttattgagcagttcccaaatggcaactttattattttatttcttcaactcagttgtctagtttacttcatttgtatctaatctatttaactcatcctttgagtttttaatatcaacattttaaattttatttttttagcttcaaaggtgtgcatatgcttgttacatggatatagcatgtataatggtggaggttgggcttctagtgtacccatcacccaaatactgaaggttggacccaataggtagtttttcaaccctcaccctctcccacccaattgtttttatttctgaaagtaatatttctttcttggtctgcctgataatttttttatagtttcttatttttcgttagttttcaaaaaataccttgttgggcattttgtccatagatgtactatcttatgtttgctaattccaatatcggaagtccttaggaagttgtacttaaggtagtttgtttctttctgtatttggtgattttttttatgagctaatatttgattaaaccgaatatttctccatcctctgtatagttgcctacaatgtaatttctacttttttttttttagcataaaagagtttcattttcctttttatactcaataacttgtttaattagccagtatttttaccagtttctttacttattgttccttgcatcttctctgagtccacttttcttcttgctgaagtacatcctttagtaatccttttagtaagaggctggcttgtaaatgtccttagtttttgtgtgaaagtatattttatgcattactttgtttttcagctagatagggaattcttggttgataggtttcctcccatcagcaacctcagtatattatttcattgtcttgtgaaacttggcaaacttggatctctgagaagttcgatctctgcctaattgttatgcttctgtatgtaattttttttttctggtagttttttaaaagatttcttttctttattctgtcaccactacttactgtgtgaccttgggcaagttcaaaatggatataaaattgtatctgtgtcatagggttgtaatgaggattaagttttaaagcacttagaacagagccttgcatattataactgtgacatgttaatatttgttttattttgccatacttgatattctaaacacatttctatgatatgcttaagtatgttgttttatccatagctcctctttgaaatacattgttgatgggaagattcatatctttctttgtttctagaaaattccttagccttcatatctttgaatattcattttccaatattccttcttagtctctgtattatgttctaggtggttcctcagtatcattttctaatttactaattcacactttgactttgtccagctagagtttatgtggcctcagttccagtgaattttttttaaatattcaggctgtctctctaatagccacctattctggtttgatttctgcctatttttaatttttcttcctttaatgactattgtggcttccttttaacatttgaaattattttcagattgtcattttttcttctagaatgaattacagttgttgattttattggctgtccatcttagtttagttttctttgtgtgttttgagtttgcttttgcagtctcctattgactggaagtttttgttgtgttttctttttcactcttcttatccagtgtttttacatgcacctacatctctgtctaaaaccacatctttatattggaggcttgattcccttgattcttggtaacatcaggatcaggcttctctttccaagaataagacacaaactaagatctatatttcttctcactggacacataatttcatctaaaccgtagccccatgcaatggttagtagtagctttttctggctcctttcattggttggaagagcctctccaccctaggtattggtttcaagcagtgagcctgagttctatcccagccatgcatgggtacctttttagtccctgttactatccctacaggatgtggacttttggccatctctgttacttgagcccagaaggctcacagttttagcttcaaaaactgctttgtatttaaagagttcagtggcttggtcttttttaatattttgtttgtatagttaataaatatttaacatacattaaaatgtttggaacagatacatttcaaaagtgaatatacaaatccatttggttggaagttagtccattttgtgttgctatcacagaatatcacagactgggtaatttattaataatagaagtttatatagctcttggttctgagggtggtaagtctaagattgaggggctgcgtctggtgagggccttcttgccagatggaaggcaggaatgcaagagagcacaagtgcaaacaagggcaagacggggccagactcgattttaccaggaactcactcctaagataagggcattactcaattcatgagggcagagccttcatcacccagttactttttatggactcactggttattactgtcacaatgacaattcaatttcaacatgagttttggaggtgacattcaaatcatagcagaagtcaatgtttaaaatcaatgtatatcctacatacccttcagaaagatactagttgactctcctacttatgagaggtatatttttttattcctttgccaatattgggtgtaataattttttaatctttgagaaggtaatgtataaaaaacaaatttgtgtttaatagctagcaggattggtcattgctccatatatttattacccatttatattcttttatttatttaattgcctgttcacattcattgcccatttcttttcctttaaggtgttcatttttattgtcttttaaaatagctgtttgtatattgtagtaatgttaacttttgtgtatatattgcagatgcttaaaagacgtttgcttttcaggttaatgagctttattttatagtgtaggagtttcttttctctggagtcactttttcttattcctttggaatcagtcttttcttgtcatccttagaaagtcctttcctaccataagattacagaaatatttgcatacatctactggtattgttttattattaatacttcagacttcaatctttaatctcttggtatttattttaaggtgtgatgttgaagggattcagctacccaccactggagggcaggagtggaaaagatcagctttcaggcacccattattgaatctctctgttcccagagagctctttctggattctcagttctattccactgataaatttattcctgcattagtattgcctcttaaatactataatttggaatcaagtttaaatatcaggtattgcagattctcatgattttaagaatgttttggctattcacatttattcatatatattttgaaatgatttaatcaaggtctgggaacaaaaaggtccagttgtgattatattgaatttatagattaaataaagggaggataaccatcttcacaattttgaatcttcctatccaagaaaaagaagtgtgtgttattctgaagccctcttcttaaaaaggttctatttcttgttatttatttagatatacttttatttctgttttaactttctaagtgattactgttaatcattttcatatatggttttctatagtcaaataatcttattgagtatttttttccctatcatttcaggttttgagtttgccatcatgtcattaactgcaaatagttgatctccttataattttatgcctctttttgttagccttggcttatctcaataaccattatttctacacattgctgagttacagggataagagttggtgtccttgttcttttttctttcctgggaattgttctagtactgagatttcctctttggcttgaagtaagtattatattaaggaataaattttatcaaatccctttcagaatatgatgagatgatcatatggattgtttttaacttttaaaaagatgacttacattagtcagctgcctaatgttggctcattgttacgttcctaaaatgatccctatttggtgatttgtaatatatattttactgactttttggcatctgtattaataagtatgtttggactatagttttatttttttagtgctgtctttgtcaaattttatagaaggattatgataggtttgtaaaaagaattggaaatttttttcctgtaatctatagataacttaggtaatttgagagttacatgtttccttagggcttgaaggatcttgttttgaaatagtcttgcctgatgcacttttatttttaatagcttattttgagaacaatccaaatttaaaatttgcaaaaataatacagtgaacttccatatttatttaaatggccaattgttaacatttttccacattagttttacagacttttttccctgtgtatgtgcatatatgtattcatattctcttggcatgcacacacacattttgttattttttagttttgctgaaccatttaagactcagtatggacatcatgaacctttactcttaaatatttaaatgtgtgtcccctaagaacaaggactatcactttctcttacataaccatagttcaattatcaaatttaggaaatttaacattcatacaatactattatctaatatacaatccatagtcagattttatcagttgtcccagtaatgtcctttataacaatcttcccctccccattccttcaccctttgccttcatccaagccagtccataatcacatattacagtttgttgtgacctccttggtctcctttaacctggagtggttctttagtctttttgcattttgtttttcatgagctctgaagttttttgagggatagttctttaataactttctcatattgttccaggtttctggtcttcactctagcactaattgaaaaaaaaaaaatttgttttccgagaactgttactttcctccatattttcaaatttattaacagagaattgtacagagtgatttattttacaacaataaaattctatttgtgaggtgagtatagcctgtttggcttctaattttaaataatttttttagttagactatttagtggcttacctattttatttttttcacatataacatgtactataattttacgtaatatattccttcagcttttattttattttgtatgtgtgtgtggttcatttttctttttaggttgaatatttagtatactgattttctttagtatactggtttttttaactaagtgtgaatttttttttttctattttcaacacactattgctggcttaaaggtgaggtttcttaataaggtttggtcacatctcagaatttgataggagatttttctcattattgtttctaaatattctataattgtagaaatatgtaaactcaatgcaaaaaactggtgtaggagcttactttttaagcaatttccacgtttgaggttttcttctttctttacacattatcaatatctactattaatgtataattcagatgtgtcatttcattatttcattttcttttttttttttttggtctgtggggtaggatgggggagtgtgttagaaatctataagcttttctttccaacatataatccaataattatttgatttttcaattaatgttttaagtgtgtttgaacagaatatatagtcttgaaattttggaccacatcttttaccaatttaaaacatggctcttattctgtttattgctttattccttgtgatttactttgtctgaaattgaaattgcaattcttggtatcttttttgcctagtgtatttcgaccacaacaaagtacttttatactgacatctttatttttgagtttcttggttttgattagtctcttgattgcatgaatctatctttaaatagtttattttttcagaaatgaaacatggataacactactttagtgctggcatatttgatcatgtcttcttcatgtcttcttattgcgtttacatataaatgacaaccttgctggtcgtagtattcttggaataaaacctctttatcctcaacgtttataggcattacttcgttgcctatcatctgatgttgcaaagaagtctgggaccagcctgatttcttttttctttttcttttttggcatgtttattttattttttttatttgagacagtcttgctctgtcacccaggctggagtgcaatggtgcgatctaggctcactgcagcctccgcctcctgggttcaagtgattctcctacctcaacctcccgagtagctgggattacaggcgtgcgttattatgcccggctaatttttatatttttagtagagatggggttttgtcatgttggccaggctgatctcaaactcctgacctcaggtgatcctcctgccttggcctcccaaagtgctgggattataggcgtgagccatcgtgcccagccgatggcatgtttattttgtctgaattgtattcttaaaatttgtaatcttcaaattatgcttcggtattggtcagtttctactaaatgtatctagtacttgataaacgccattcaatcaccaagttcagtctttagtttatgatttatttcttctgcctttgaaatttaatttttcttccattatttggttttcttatttacaatgtgctaattgagctgttggatctgcattgtttgtatcttttctcaagtctacttgtttttgtttctttatgcttacttgcatactggatgatttttgtcctgttcgtttttaccccttgcagattgtttgctgtagtgtcttcattcctcattattgcttttcatgacatttaaaatattgcaatgatattttttctctgaaatatctttttttaaaagctctgttgatactttttatattctggtttcttttcatccctgtttcacaaattaggttttttaaaattttcttatatgtaagttgtcacctagttttctaaggtaaatcttttagactgtgacatcatgttcttgagtacttttttagttacttttttatttcagaatttttgtatgggttctataaatttttttctgcttttttacttaaagggtggcagttttctctgttgtttgcccaaaaataactagctactccttgcctgttctgtcattatactaggataccattacctctttcccccttggaatttaacaggctgaattatattaaattattttagttatcatatttcattatttttgagagaaatgatagggattttgtcctattaacctgttacaggtaagaaactttgtctttcttgatttttctcgatgcttgttgaaattactgattattttagttatcatatttcattatttttgagagaaatgatagggattttgtcctattaacctgttacaggtaagaaactttgtctttcttgatttgtctcttgatgcttgttgaaattactgcacattttcatctttacaagtttggcagattttctttcccaacagaagaacttgactattgggcattctgctaatttccatggctgctataacaaattatcacgaacttggtggcttaaaacaatacagatttattctcacagttctggaggccacaagttcaatatcattttcacggggacaaaatcacggtgtcaccaagaatgtgctcactcccgaggctttaaggaggaatctgtttcttgctttttttcaccttccagtggctgtcagcctcatcacttgcctggtagccacatcactcgaatctttaagaccagcgtcttcaaatctgtgtctgctctgtcttcacatcaccttctctgtgtgtgtcagatcttcccctgactctctattctaaggacatgtgggttcacttagaggtctctggataatccaggatcctctctccatctcaagattcttaatcacatctgcaaagacctttttttccaaataaggtaacatttataggattaggactggtatctttgggagtcattattcagcctactaggtatcattttgttttgctactttagagtgaggcagacatattagtcaaaaattggattagagtaaagcctcatagattgtgctgtttgttagaatcacagatactgtcctctttaccgaatgatgcaaactctgatgccatggtggaaaagtatatgaattgaattggatgtggtcaataaggattgctagggactcgagaatgcatgttgttctagggagaggaaatacgtgaaggtcaaattcaggttatcaggttatcagtttgtaacctagtttgtagctgcttttttcttttcatttcttacaagctggtcttgctgtagtaaaataattttgtgtgtctcttataatcttgatattgagaataagaggttttttttttaatgggaattccatccacatgattttaaagtattactttactaatgatatttacctaggtattcctagaactttagtcttctcatgtaacattttatacatttctcagaacaaggtaattgacaaataatcaaggttgcttatttattgatgaggaaagttagacattaagccaaaggacttgtccagtatcgcatattggatagacctataatttttaactttaatcttgtggtgacaggtatttccatttttttttttttttgatgtttcatatgtgctttgatgttgatgtgtcatgtgacatgaagtgtctccctattgttggataattgggcaagtctaagttctttttactttatattcctgattttgtttttctagatgtgttatttttacagattcaggttacttctttttttaaatcatgttattagagttaaactaatgaaaaatcatatagagatgaacttggttttgaaatataatgagtagatacttgcttggctggaattttttctcacaagttttttataaagatggtatgagtgtatactttgtatccaggaatgtgtgtacactagggggagtgttggggggatgagggtggaagacattttaagacacacaggaggctggtgtggtggctcatgcctgtaatttcagcactttgagaggccaaggcaggggaatcacttgaggtcaggagtttgagaccagcgtagccaacatgatgaatccccatctctactaaaaataacaaaaaattaactgggcgtggtggcacatgcctgtaatcccaggtacttgggaggctgaggcacagaatcacttgaagccgggagccaagatcatgccgccacatcccagcctgggcgacagagtgagactctgtctcaaaaaaaaaaaaaaaaaaaaaaaaagacacagaagaccctaagtgtacactcagatgctctttatatccatatccattatcagtttggtgatacgttattctagtttcatgaacctttactcttagaacttggtttattctctaatatcttttggattcagttttgcagttgagatggctaatatcaatttgatactctttccttttatgattgctcatgtttttgtctagaaccttgcattatagtatttttttttcttttccttgcatttctatagttgtgaacaactaggagtgggtttttagcaattaattcagtgagcttgttaattttgaaaaggcttcaactgaggaacactttcttctcatttctttgatgatagcttctctgtttctccttcagaaagtcttgttttttatatgcatatttactttttgggtgcactctccttgttaatgagttatttgcatctgattttgagtttattcagcaaatatttattaatgatttactgtatactctgtgcttggggagttgacctagggaactcaaaggaggctcctttgaagaattgatgcttgagctgagatctcaggaatgagtaggaattatctaagacatgagagaacagctgttaaggtagggaaagtagcatttgtttatatatttggaggaaggaagtatgatgagtactaggtactgtaagaaaacccttgtggttggagtagagaatgtaggagaagggacagtatgaagtgagatgcggctagagaaggtacgtaggggcttgacttcccagggccttcatgtgagccatattaagcagttatttatccacctcctacccccagcagtggaaagccattgagaaacttttagtacagaagtgatatggtgaaatttgtattttgaaagatttacttaggctgcagtttggagaatgaattagagggatgccaggatccacgtgaagagactaaagacgctagtattctgcagtgagaatgatggtaacttgagaccagggcattggtagaaaaaagtggacagatttgagaatgcttaggaagcatataacccatgggatttgatgatggactgatgggagatgaggtagagagaggtatcaaagatatccttagtttctgtttctttttctgagttggggtcttgctatattgcctaggctggtcttgaactcctggattcaagcaatcttaccgccccagcctccaagcagttgggactacaagtatgcaacaccgcacccagtgaatgttcttggtttgtattcaccttggtgggtgatggtgccattcactggtaaaagctgcagatatgtgagggtgctcagggaggcagcatagaatgggaaaagggcctacatgtaacccttgaggaatgccaatgtttaatggcttgggagatgaaaatgagcctgcaaaggagacgacggaaaagcttaggggtaggaagaaagctgggagtgtgtgtgtagcatcttgaaaggccaatgggaagagtgtttctggagggagtgttatagttgaatgcttctgtgagcagtcaattagaggagggctaaaaatgtcccttagattaagtgacttggaggaacttgatttagtaaaatggccagacagccttttggagcatcaacattttttttaagaagtttaactgtaaagagaagagaggcacatgggtagctcgaggggaataagtcacatgaaaagttatttttaatgggtaacatgggtgacacttgtggctttaaaagtcacactccaactgagaaatgttgataaaaaggagaaaaaggaaaatagtgtaacattcctgaaaaaactgtcatttaagactcctttgaaacatgggcaccaaagctagtctagtagaggatttattatcagtgagaggacagagtcctattacagcagaaaagtaggaggggagggttatgaaagaattcattgaaatggttcactcatttattgatcttttttttctgtagtatccaatctgccattcattgtctctattgcaattttcagttcagtaaattgcttctcatttccatgaaactattttcagagtacctcttttttaattgacagtctgcaattgttttattcattcaatgtcatttcatatcttggttagtttctaattttgagctaatgaatactgagtctccctcttttcaacttctgaattaaaaaaaaagtcatcttatttttctctgttcatttttacactttatttagcctaagtatctgaaattggctttgctagaaattacaattagttcactgttgttttctttcagtcccagacaaaaaagaaaaattttagatttctttcttttctcttcttccttttttttttttttaaggtcatttatctttggcagttttagagatttagaaaagaaaatatatagacttgtaggcagaagaagatatggcactgagggaagttttagttttgttctgtgacagtcttccttatcttgtatgttgtctttaaaaagcctacacatttagattttcattacctcatttgcaaggatacaggatagcacatgtaggagaattggagtgtaagtccagaaacctaagtcttattcttagccttactgatgaaccagctttgtaaccttgggcaagttattctgtttctctgcaccttctcatttgtaaaataggtttacacaaatcatttctgcattttggctctgattcattatgcaagttatcaaaatcaaatttgtaactataaatgagtaatattttattatttttatttttttagagacagagtcttactctattgcccaggctggagtgcagtggcaccattataggtcactgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagattagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatctttgaggacaaagcccgtacatatgtaagcattagtgagcaatgtagaatataaagatttggtagcagtagagagtttacgctctacatcccactgcaagtaatttgaatattgccatattatccactgtgacctgtgctgtttgttaacgttccttttccccaccttccccgaggagcttgtagtctctcactatatatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcaatgttcttttgttatatgagtaagaataactctggtatttgctaagagaatataattttctccacattgtatgtatctatgtcctttgtttataaagcctggggggcgttccctattaggttaagtgtccctacgtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggattaaaccaaatgaccgggttcaagactctactatgagttcacctttgcttaataaaaggcaagactgaacattaattaatgacttcttggcccagccttagaatttttcagtttagggattagtttggtttttaaaaggtacaaaatgttcatgaaattttctgattatatcaaatattaattcagtcttgttttttgtcatagtactttgttttgaaaagttcagatcaactgataatactagtgctgtgatgagactcagcttgtactcaagaacagatttatgactaggtgagaactaaaatttctctcagaaactaactaaaaactttcatggacaaattgaatccccttgggatttactatttatggatatacgccaatttaattattggactaaataaaatactctttattagtccacttatggaagatgactgtgtaaacatagtatttgcaagtaagtactttttggtattatatttatataatcagctcttgtatccatgtagcttatagttggctgcttcaccaggactctacaaattgctcagaacccaaggaggtaagatttttatattgcctgttttcagtatgtaaaagtccagccacaaaactattaatttacccttgactatatttttacagttgctgtggagctgaacctaaaattttgttagatggttacttggtttgttacatttttatatactaatttatatactataataatatactgtatatattttttaaagtctggggtttgtttttagaaagtatattctatcttcaaagaattatttggtagtttcatgtgtgtatctggaaaataactactgtacttctttataaaagtgagagtgaggtccctgctagttgaggctggaatctagacgtggctgtttatgtaggagttagtaattaaacagtgcctgtttgctgactgcctcatttttgccaggctctgtatgggtgccttgcaaggcattgcctcatttaaaccttgcagcagcattcagaggaaagtattaatatgcccactgtacagatgaggaagttgaggaatgctttattagtaggtgtgaagtgtcttaagcataatacctccctcctcaaccttgctccctcatcctagttaagggaattgagacacagagataaggcaatttgctattgaccttcagcagatgacttaacctcaccgtggcttagtttcttcatgagtaaaacagggtacctatcttttaggattggtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataaggaggaaagccaggctcctaatctgtctaagatagaagtgaatcttagttaagttttaagataatcctatgtgcttttaaaagatttcatggtttgcggtttgcttttctttggctcccagtttctttttttttttttttgacttcttagtacaggtaacttttgaaggaattcagcttaccttagatgaaccaaaggaaagctaaaagccgagataatttagaaaaactaaagcagagattatgttcctaaattccctctttctgcttcaaagtccaggaaacaccacctgcagatacagttgtatcccattgttagaccctttcctgaagccatcctcttttctttgtcttcccagagagaaactagtcattcgacaaagattgaacttcttctgtgtgttaggctgtgctccaagtgctgggaagacaccagtgaataaaacaaaaagtccctgctctcatggagtttacagccactattctaaagtttgtctgtattctgcctgtccttgtttttatacttttagcaaatatgtgtatagaattgttttgcagccttgttcagcatattgtcttcttttgttttttaggaatatctgtttatgtaattagatctgtttttgataaattgtattctgttatttatccttcctaccttctaatgagcagttaggttatttccaacattgactattatggttctccaaaaagatcattgaatatgtcaccttggatggatggatgggagagtttcttcaagacagcatgtttcagactttttgttgtgaccacagtaagaattatgtgcacctcagcttagtaaatacaaatatacacttgggacaaaaacttcaagaaacagtatttacttacttttatcacctgggatgcactctattttgttctgttttgttttcttgagacgttgtttcgctcttgctgcccgggctagagtgcaatggcatgatcttggctcactgcaacctccacctcccaggttcaaacaattctcctgcctcagcctcctgagtagttgggattacaggcgccagccaccacacccggctaattttttgtattaatagagacagggtttcaccatgttggccagtctggtctcgaactcctgacctcaattaatccacccacctcagcctcccaaagtgctgagattacaggcgtgagccactgcgctcggcctattttatctttttcaaatgcagtttacacacaacccagctgattgggttgtgtgtaacccatactgattaaactgatttatcacccgtgttcattatttttaaaacgttgttttgagatctataattagaagtggaattgctgagtagttgcttaagtgtatcttcaacttcttcaactagctgttgccagttgcaattcagagtggttgaaccaatttaaactcctatcggcactctaggggagttcctgtttctccacattctgaccaactcttgatattgccagatggatgagaaatggcatttgttttaaatgtgccttcccctatttactaatgaagtgtttaaagtgtcttttaaaatatatcacatagaagtttaatttaatggtaatcagagctggcggcaaggaggaaatattattgtgattgactgcctcctctggcagaaaaaatggtgtaaaaattatataataatatctatattatattgagtatttataatttgctagacactatactttgtgcactgtatacattattttatttaatcgtcataagaatcttgtaaggttagtgccttcttatatacttttttttttgagacggagtctcgctctatcgcccaggctggagtgcagtgatgtgatctcagcttggctcagtgcaacctctgcctccaggttcaagccattcttctgcctcagcctcccaagtagccgggattacgggcatgcgccaccatgcctggctaatttttgtatttttagtagagacggggtttcaccatattggccaggctggtctagaactcctgacctcatgatccacccacctcggcctcctaaagtgctgggattacaggcgtgagccaccacacctggctgccttcttatatgcttatacaggaacagatggagaaagagattcggaaaggttcagtagtcacactattactaagtagtagagccagaatttaaacccacattggtctaatttcataacttattttctttagtacttcatgctattggtgaattcgtagaggaaggaagtttgtcattactattcttttctgttggtttgtctcttaaatgtgtttaattttttgagtttcactcacgtctctttttttctttccttttctcaaggtagtggagtctttcctctgtaaaacttcaccttgttgtttctagtctaggatagtggtcttgtaacctaggatagtggtcttggttactgcaattttggttgattatttcttgttggcccttaatgtgcccccatcttctgccttaggcattccatctaatcttttccagcagtttgcaaccttactgtgcctcagaatcacatatgaaaatttaaaaatcatagatacctaggttccaaccctaccctggaaattctgatttggaaatatttatttttcaaaaagtccacagataattctgttgcacagccatggtagagacccattttcttaggggttaatgatgctttagagtcacgcagacttgaatcagagccctgattcctttaaacttattagttgagtgatcttggccaagttctttaatcttggctaaggttcttcatctataaattggagataatattattatctaccttagagagttgttgaagagattaaatgaagtaatgcttgtaaaacacttaccagagggacttagaatacttcttaaacattgcctgctaataaggtgtcattattacgttatcctttatccaatcaaaatactcacctttgcagtgtgtatcaacttgatgtcagaaaaataatctgataaatatcaccataagggatggatgatagctagttttcattacttacctttcgttagttgaactgtactaggaggcagaggagtaggcagatggttttatcacgccaatcagccagtcttttctgcctatgtatcagtttggacctataaggaaaatgaaggggaaaacaaatgtttttctttccttcctaggaggattttcttcttgccctttttctcccagtttcctctctgagctgagtatcattagcatcatcaataccctagtttcagagctgcgtagtgatttacctagatacttttctccaccattattccctactacctaactcctcttcacctccattaaatctctgttcatcatgctatccttcttttggattgcctttagttcagttgtgacttacttgattacttgaacccaggtgtctacatttctaagctattgttcaagtaagggccaaggtaaattctaaccagctgtctctttgccttgtgtgggcccattctagaccagcgggtgttaacttttgagtattggaaaaggattagattagctgagccttcaggcttgtcagcagggctgtcactagaccctttgatcttctttatatacctaatggtcatagagtataataataatggtacatgttattactatatgattaatagattactagtagtaattttgttatatatgtatacagtacacttcgttatgtatatatataattgcttgcaacttgaaatttgaggctacaacatttacagtaatttaataacttaactgactttatcaaaaactgaaaaacctcatggaaaaggtagaatgtaaggtagacttaaaaggataggtatacttttttctataaataggatgaggcaagagtttccagttaaggaaactgacatgagcaaaggcttgaaggagcatgcaaatttggagcattgtgagtagattattttttagtttttcagagttcatgcagtgggaataaaactagggagtttggaatcaagcttgaaaattcctgaatgttcaaccaagatatatttgagttagtagattttttgggtatgtcatgaattcgtttggcttttcttaattgatatacatacaacttagtcctgagcttacacatgttcattgtatcattaaacatttagcctggttggtttaagttgatggccactgccaggtctcctttctgccttctcccctttatcccaatgctttagtttttttctgcctttttgtctgttgtgatctgtgcttcatcaggctttcccccagttcctccttgttaatctccagattccaagtcagcaacacaatgaatgtctgcttatcgcgagttgtgaattcccgcatatctctttcacttattaaaaagattgtttggtacatattttgtttataagacagttattgactttcctgtttctcttcctttgcagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaaggtttaatggtctgtagcacttgaaagaggaatgtagtgatcattagacgtgatgtaatagaaatagccttgtacatggagtcagaagaacttgctctgagactgtgtatggttttaggtaagctatttaaactctaatcagtttttttcatcataaaaaggataagacattattatcttgtctcatggcgttgtcaggaggatcaaatgggataatatacacaggtgagctagctcagcccctttattttacagatgaggaagctgaagccagagaaggttctacaaacttaagagtcagacagacctgagaccaaggcttacctctattagttttgtactctacattcctgaacgaattgttcaacctctctcagctttaaaatggagataatagtatcttataagactgttgccgggcgcggtggctcacgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatatatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatgtttttttaaacaaatgttgactttttaaaattcttctgagggtatatatttgatactcaaatatttaattatagcatttgaatacttagatgtctttaaaaatgaatgtagttcctaaaagttgtcagtttttaaaattaatacaagttaaaagctggtttataaaccttaggtagttttacctcttatttcatatttctacttatgaagcgaatgtattagccccacaatttataatttattttaaaggtaattttatcaggtacatataactacaggtcaaatcctattgtaaacaatgccactaaaattttctgtcatgttgtatggaaggagtgtgtgtacacatgtatatttgtattaggtatcacttcaaattaagtcaccagtaaatgtttagaaatagtattgttttatagaattataaaaaattattattacagtgagattaacctgtaatgtttctctcctgtcttttggagtattggttatactgtattctctctatactgttcgggggagggggagtcattgcacacacacacgcacgcatgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaatctgagatccttgctttttgttcagatttaagactgtttttttttttaaggcaaaaaataatagatggtaaaaatttggcctttattctaaaaggacagtttgaaccatttaaagaaatattatgggtagccatgtctttaaaaattttgaggcctgatcaaaggacgaatctttatacacattgttattttcaaaggtatttacaaattgagaagcagaatgatgatttcttgccccactaatgacaaataaaataccatttcttaccataaacattgaaaaacaaactgaacaaaacttgaccatataacttacaaatacttttgacttgaatttgcatgtggagtatgtgtgctaaaactgcaagtgaagactttttatacttagaggaatagttgtagagttctttgtaaggttctttgttcataattttttatattttgtgatgtgaataatagtatgcatctgcatgacaacactgcagatcatattgctgtgcccttttaataactggatattttaaaattattttaaatgcagttgtatggtttatcaaatggttctctttttaaacattttataaggaaatttagaccttttctattcaaggctttgttgaagtaatcagtgaaggaaatggtattatatatctatacagtatattgtttaaaggtactttagagaagaattaaactgagacagtgatgttcaagtacataatctgtgcatgctatttaagtatcattttgcaaatataaatatatacataaaaataattgagttagtatataatctataaattcccctataattaagggttgttattttcaaatcttgaaattgtttattttttaaaattccacgcagtgtattatatagggcaaagttcaggaaacatgtttccagtctaaagagaggagtgatgtaagaagaaactagttgacatcttaagaaagggtattctcacttgtgcacacatatccttgattatataatatgctgatttaacatgaaatattttttcacattttaattttgatttgaagttaatcttatatgtcattttgtgcattttttgtcataaatcttcaaaggtcaacctgattttttttttttttaaatgataccagattagaaaaatctcagatgtggtaaatgccatctttaaaaagctaggttatctttgtttcggttttcttttcaattaaatttggataacacttacaaaaaaagtacttctgattcccagaaatcataaagaagcagggggaaggcgtccccgacttagtccatgtgatgcgcacattagcgagtgagaacatccccagcctcccaccagggggtgaattggcaagcaagtaagttacattctgtacactcttatgctttatgtcagtgtatgaaaatgttaggtattcattgataaaatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaagcttggttggcattgatttcctcatagagcataaacgagataatatactgaaagaactttttaaactaaattacatagcactacataaaaatttacaaaattctaagtgtcgttgttagtagtagtataatttgatttggtcaatccctgagtaacttaacaccctgaaaattccccttcctcatatggaccatgtttctatgcctgattttcccagtatttttggttgttgattgctggttagttggttttaggtgtcagggaagaagatagaatatatttcttgtcttttccctttccactttagttcatagaattggactactttgtgttaaatattaagcttacacctttacataataaagtggaaaattcaagcaattccaagggttaaaacatttttacctcaaatatccatataattgacttacaaacataaaacttgcaaatacctttagcttgaatttggatatagagtaaatgtgctaaaactacaagtgaagacttcttgtacttacagtgaagatatattattgactaattttctcgattctctactgtgttttgcaagtgtgaccatgttctttgtaatcactaaatagtgattgtaaaagctcctgtttgaagcttttattttttggaaactttttttttccatatgactttctatgaaacgatctataaaattgcttcaagtcaattttggaagtagggagactataacttataaatatactacagatttttaataaagtgttactcaaaactaattcctagacttgtcatggaaatgtcttatttgacatttcagttttaatagaacttttgaaaagggcattaagaaaagtagaagcttaaatataaagtataatctgagacttcaaaactacgatgcaactcaactagcttatgttagtattatatcttaagaatggcattgccattgatgactcataaccatttaaaccaattcaaatggaagtagactatatagactttttttttaatctgtaatttttagccttctattaactgggttggtagagtgttataacacattttagagtagactcacctctgctttaacataggagcccaaatatcttaaaagtgaggctcactattgacagcaagaaatagaactaaaataatatctgagtataagattatcttagaaattttaataaacacctggctatgagttactaagcaatgttttgctttctgaagaattaattttctgcatttttttacacttaggaggaatgttattgaagccgtttacaatagactgaatccttacaaaaatgacgacactgtaagtagcattttagctccctctgctttcccttcccctccactctaaatgcatatccttcctacctgtttttgcagagctgttcactgtacccattctcttacacacacccctgattgattgctctgaactctgcttgctctgatctctgcctgcaccacagttctagtgattgaggacataatcatggtgagtggccacctctctcaaaaaagaagaaagtccttttgaattattctagattttttaagtctttacaaacaatcaacttcagaaggtttgcctccactacatggttttttttttttttttttcccgaagttgggactatctctactcagaatattgtcttattctgagttttgtaagcagctgcagcagaacttcggaatgtctgtctcaactaaatagttcttatggttggaaatacctttgtcaggaatcctgaagtatatacttcacttaaatattagagaattgtttgcataaatagacattagaatgccatactctccagttaagtgttctgttgcaattctgttgtatgatgtttatagaaaagtgataacttaaagatcatgtgggcacagctctgaaatattttatgtattgcattatgaagcttcctcacatattgagttcttaatcttttctgatgcattaaaggtttataaaagtggtattctaaaactgtattggatttcattaaaaaattctttttagtagatttattgattgagtaatacatttggacagcctcatcataaaaccgcatttcaaatattttccaaaacaaaacaaaggattaacaattctttgaacagattaaacattgctatttcatatgtacacatatatacttatatactttaaaaaacatttatattctaaaagtcatctttacagaacattatctttctccattatccagaaagtatggtgtattttggcaccgctaaattttaacgttgttccttattttgcttccttttacaaaggactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgttggcctttacaaataactttcaaagcttaaggaattgtagatataaaaataacctaatttaatttaggcttaaattcctctgattaagcatgtgaaagtaagttttaaaatctgtcgcattgaaaagattactgttccgtgcccttctgtatttttgtctctttaggttgaatattgtatttatcaccatgtaatcattcagtaggcagattcccactagaaaactgttgaaatgtaagactaaaatacaacattgaatacaaaatcaaaattttgtgtataaaaaccagtatagtccattttgttatatttgttttttccctaacttggaaatatacatatttgtatatatagccttaaaattaatgtaaagttaggggagtagtggggaaagtaatgtgaaatgtctcagatttaagtagttaaataccagcaaaatcttttcattatccctcttattttgtgaggtgattaaatgtaacttaattgtatttaatttatatcttattccagcatgaatgaggaaaaactgaagtactatttatatttagaaattcatatcagttgaaattacagaaccaattccatacttacaataaatacttaatgtctaaatctgtggtagagtgcgaagtatgataatgttctaagttatggctttgcaagcatctaaatgtgcatttaatgaataccagtgcttctagtatagactaattaccagacatactggtactgaaagctaaatccctattataacaaaccagttccttaatattttaagtagactgacaactttagttccagaaattgcaaaactttgaactggactgtgtaatcttttgagatgcaaaacttaagtcacaagtagagtatgtgatggaaagctgtatttcaaaccataacagcatatttagagccttttttttttgagtctttaaacaagagaaaattaaaatattcctgtcaaaattattagtattgaaattaggcttggacacgagagagaaccgtatttgagtgatgtgagaagactaaatcttttccacatgagtcagcactgccatactaataatttttttactataaaaatacaggaaggaagtatacattataacagcagactgtgtgtgttcctgattcctggaggtaatagtggggggaaaccaaccatactttttaaaggcacttttgcacctctattgtgcacttcattcttgtaccacttaaattcttcacccccatcccctttttttgtgctaattagcatctcagggcaatgcctcaaaaatgtttgatgtgttctgttctttggagggaaaaagttcttatgtgatgataatatagtactcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagacaatagaagcagttctcaatattagcatatactttaaaaaatcaaagtgataacttaattcagctttggaagtatctcaaacatatttttactttatagtgcattaacttgcttctagagtacttaatgcaactgctctagccacttaattttttatactaatctcaacattaagaaatttggattaagtaataaattagttatgtaattcaagtaatctgaattacagcagtacttttagtgatcattcataggactatatattaacccagctaataactcagtttttttacaaaatgtttcgagtattattggtaaaacactgttctaggctaagcacattgggactgtaaagaaatgagtagatccttggcttcaagtttacatctggacaatttataatctagtgtatgttagtattataactggatcactcatcaaaaaatatatatatatatctattgcccacctgctatctaccaggtacttagctgatcaaggcaggcccctgccctaaagaccttgtttatacttcctttactcacctgaaaactgttctccagtttattttcttctctctaaagttaaagagtaattcagaagaaaattttgcttagcataagaataaaattggactgaagaggcttaagcccattcagtatccttgattgcatttatccaacggcctttattcttcctgctgacagcagtaactcagaggaataggtagtagatttctgaaaattatccagccatggaaatgtaggtggggtttgagtttaaggcatttaaaaatgtaaatatctctagctaaatttatcttaagtagaactctgtgtttttgtaacacactgccagtgttaatatcaaattttagccaaattattactatgtgttttaatattttaaaataatttcactgcccatctttactggacaaactcatttggagttcaacttgtgatttctgaaagaactgatgaaattgggtactgctttttttctccatttttcgttttgttttaattttgaatttcatggtatatacttttagttcaaactcagctgtttgtacagtattgtattaggatttggtattagaaaagatgtgtaaatatcttagtatataattgtttctcatttgaggtttttcttctaagggaccttaaagagttttatatacttttgctcacagaaactgctggtgagattaccattttttgagtatctagtcttctagtttttcttttaggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataat

SEQ ID NO: 2698 - DNA, 39307 bp, Homo sapiens
  source 1..39307: mol_type = genomic DNA
gctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccgggtaagtgcggcgctcgggccgacggcgggctggcgggcggtgcgggcctgcgcggcggcggcggcgggcaggcctggggcctgtaaacaagccgggcgtctgcccgggcgctcccgggaggagacgcgacaactccaccccctggccggcctcctcccccgagccgggcggcggacggcgaggggttaacgctcggcgagggcggtggcggggaggcgggggcggggtgttagttgcggtggcgcggggagggggcgcgaccctctggccgtccgcggccgagatgggtgtttgtggcggcgaagcaggcgacggccgcaggccggcctggccggagagcggcctgcagaacttttcccgagcggggagggggcgtccccgcgcccccacccgctcgggcgcgccgccccggctgtcctgggcttcagcccctgggagggaggcggggagacttcctttgaaccgggcttagcctcgaaaaacctaattctgtagaaattgcttaaggttttacagggggcagggctgagagactccttcagaactcaagtcagtgagtgatgcctctagttcattcattattaaggcatcgaacaaatccattgaagtaaattccgatttcttatccttttaactacgtaaatcgggtaaaacttcttgatgttagagcttggttgaggtatggttctgttctgcttgtagattttaaataaacttggagccttttcttgaaagacagctggctgtggagagccttctaccaactgcagttttagatacgttttgaaaatttcatcacctgaggtatttttcttctctcctgaaacaccacatggtacaaatccacaaaagtcatgcttcagttgtccaagccatgggatctgtgtgctagccccacctccccgcaagtttcctgctcattggaataatgagctgaatgtgttttaagaagtggttggaagagtatgagagataggtatcattttctcaaaggaaatgattttgacattattgagagaaattagacattttaacaattgttttgtaaaacagtcttttcaaacttgcacgttggggttttaaacacaaccactttacatgtgttgcgctccgaaaagtggagggatttgttgaaacactactctgctgagacttagggttccagagcacttgggaatttagcatagcttggtccccaactctctttgaaacactttacttttatacttttatcttgctacatattgggccttttccaaagattgtatttctgtaactccttattttacaaatgagaaaattgaaaataaggagattctctattcttagatgctgcttttactgacttaatgctttctttaccaataaataatttgaagcacaaagtaacatttcctagtgttatagttttgttcttgttatgtgtaacttatatgtatctgattaaactttcagtcatgtaaggatgattacttttaacctggaagtttacagcagtaccacattattgaaactataatgaacttcctgcacatggcagttgcctaagacattttaatttgatatcataaaacatttttagatcggtgaagtaattatattatgggaaaggtgtattaagactgataatgtttgaagttaactacctcaattatatttgagaaataatagtcatcaaattgctttttatttggcttgtatctttttatgtattttgtgtacatattgtatctttttacatgaggggctgaggtatatgacctgttgaagggaacagtgcagtaggagacaaggattgtttagtcatggctgtgctccaaaatatctgtgtccatggacaagtcctttaaccttttgagtttcagcttccaaatcagtaaagccagttgggcagattatattatcacatgtactgtccagttactacatttaaaaatttttttttatcaatattgtgtgtctagtcaacataccgttgccaaataaatgcctgttatgtgtcaggcacttagatgtttcagtgttctaaggctggatttctttctcggttctgttttatttaacaaattctaagttggtgatggttctttagaaaagctgttcttgtgttcttgtaagctattgatttttcttttgggattgggatgtgtagggaaactcttgagaggaaggaggatggagatttcatgggagacaaagggtggttgagactacaggtttgaacaagcacaggacccttggtagtctgatgtgaaggacattataaaaacacattatgaaggttttttctgtcacttcaagctgggtcttgttaaacctttgaaaattctctaatacctcatttgtttttgaaagaaatctatagcaacatcattttgtcatgtggtaaatattgctgagcagtcactaaatacctatagtcttttagtttgttcagattacatctaggccatttgtttactctaatagctaatagaatgtacagctgattttggtttaactgtgcgtgcatatttgtaatttttaaccaagaagtggcatatgtccacaaggaacttgttatctctgaaatactcacccatgagagctggattaattttttaagatgtaaatctatgctcatgtagaaataatataacaaggtgatattttgatgatcctctcaaatgattatctaactcttgcctgggcacctgactctgagtcagtatactcttgaatactttccatccttaatcaaatcaggagaaagagatggccatgtaagaaaattggccacggcagggttttataagagttaagcaagaagataaaacaacacatggccctgtgaaatatataaaccttggagaagaggagaaggtatagtgaggcaactgggtaaaagttgtgtcttcctctaagtaattttatgtcacaatatgtcctgtcttccatctcaaataacaaattttaaaattaagttgtgtttgttattttgctattagccaagatatataaattaactgacctgggattattagccatttgtatatgaaataaacttgggttaacctatatcaaaatcaaaagattgattatattctttacccttcactctttcaaatgtcttatgttctccatattacgtaacaattttatacttcattctgagtctccagaatatattctttgatgattttgacctttgaatgtcctggctatccatgtactacctagataatctcgttaccaggcttttcttttgctgaggcaggtcagagctagagaaagtaagcaattgagagaggcaagtttctgtatacctgtatctaaaatgtaatagactttataatttttgtaaggaactgaggaaaggtacaggcttttaatgtgtatcagtaaactagactcttatacagtttttataatattagagatgttttaagcttccttgagtaaatatgtgataaaggggggatcttgagtttttataattcttaatatgtttatttggaatccattgaccaagtgtatgtagtatccatatttaagatctggattaaaagtgattagtttctgtggctgatacgatttagaattaagatcttttgagactaaactacttctagatacagaagaacgtcatgaaagccgtactttcttggccatttatttgtgttaggctttaattttttgccataaccctctaaaatatgtgatgttatcttcattttataaataaggaaatacagggtcagagaacctaaataacgtgccaggatcagatctgggtagatataaaagtatttttcaagatattactgagtggatttttcccaattagatgaacctccttattaccaggaaccaaaatttcaaaagctaaacattaacacttacgattcatagattcctagagttaagcaagtccatgttagtttatgtaaagtcttccaatgcaagactaatgttttcttctaaaacattcagaaaagatttaagaaattaagttcattttctcattcccaaagtttcagaagttaacaaagctaaacattttatgtcttcaagtaccattgtttaggttaaggaatggaatccatgttaattctcaagtggttgatatccttaatgaaggatctagggaaatgtttctgaacagatgtaatcagtagagccacattgaagggccccgtggtggacatggtgataaaactaacctttgaaagaaaggacagtttgagtccctgttctcctatttcgtagccaggtgttcctgggtaagctacttgatttcttaaacctgtttttttttatgtcaagtggaaatacttttgtcgtaaggttatcttgaagatttaatgaaataattatataaagcatttgagatcttttctaccatgaagaaagtgccaaataaatggtagctgttattattgagtatatgaaatcttgagatacttaggggtatagagacttgcttagtatgagagggttgtctttcagtatagcttttgcagtgtgcctggaagccaaactagagattgagtagagaatttagaagacattgtaaactctgtgagtttagagagcttgcatttgaatagactaaaagttatagaagaaagagaaagttgagtatgagtagctttatttggctctgcaaagctggcaagatgtcaagggtttggagttaatgattaggtgggagtagatggttaaattgcggataaagagtaacagtaataaagcaaaggtgaatgttcaggctagaatgatcagtcagtaaggaaggacaagggttggtattttgaagaggagttacagtttatggttagaaatgagcaggaagatatcattgctacaggaaaggatgcaaaagagtaaggaaactaaatcattctgattaactcagttattaccattttttaaaaatggagtctttataaaaggcgttaaggctttatatgtgagttctaggttaagtctgaaaaattgtcttggaatagtgtgggtcttactactgcagacccaaaccaagatattagcattccaactggtctctttcctgctagcatcttgtactgcatctcctccctgattctataaaccatcaaaattctttctaaactatggtttttcattatatcatttctctcagtatacttcagtgactcccatttacctctggaataaagttcagaattcttggtttggcttttgacactttccatgattggacctcaagacattagtctgttataaccaaactagtacacttgctatctctggaacacgctcttttctctccatggatctttgctcatgctagtgtgcagtctggaatttgtgtctttccttctccagctttggttttctcttttagcaaagctcatttctaatatttcttcttccacaaagtcatctctgacccccagagtgtttaatctctcctttctctgtacttaaagcaatgtctgtgtattatttctatcatatgttttttttttttttgttttgttttgtttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatcatatgttttacctttagatatttgtgtctaaattataattgcattcagttaattctaaagggaaaaataaatttttactttacacaaaggctagcggctagcacagtgctttatggatagtagacattcagatatttggtaagtattaagcaaaatctacctggagtgaaagtgattgttgtaggaggaggtagtagaagtagttacaagctttatcgtagcagacgtttctgactctcttcctgaatgttattttttctgaacctggatatttaagtgtgaagattatacaaatctgaagtgtggcagtgttcttatattgatgtagaagactaggttgactgatcctggacctacaagcttcattttaacttcctacattttggctttgagggttaacaggacatttataatcacatatctcttttcagagtattttacatttgcaaatattatcatgaactttgtgtccttttaaccagagaggaattgtggaatcacaggaattagatgatgtgttaaagaagagagataactatcagctgatttaatttgaacccaacaagtatctaataatatgcatactctgtgttcaaataaacctctaagctagactttcaagcttatcaaaatgctagactattttcagtgtttagaaaataccagccaggtgtggtggcttatgcctgtaatcccagcactttgggaggctgaggcaggtgaatcacaaggtcaggagatggagaccatcctggccaacatggtgaaactttgtctctactaaaatacaaaaaattagccaggcgtggtggcacgggcatggtggccacccgcctgtagtcccagctacccaggaggctgagcaggggaattgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaatgagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggtttcattgctactgcggaaagtaagtctcttggccattgtgatgggtcaaaatctttgtacatgaagggtatgactgttgttccattgtatccagagagtgaatcttgtgattgagttgggatttgaggtggcagtgtatactaagtttgaaaagtatattatcatatgttagctccctttagaaattttccccaagaagagctattacattttttaatattaaaaaagcataagatatggccataatacaattagttccacaagccatacacacttttttcttatggcttaaaattttattcatgtttactactttgcaacccactgatataaattatttcacagatcctttattcaaatgaaattctcagtgagtctgagaagatagtcttaaacacaagctagctgagtttacaatagagattatactataaatggtaacttcaatgtttattgaaaataaattccttaaaaacaggtcttgtttcattcatttaaagagattatcaatatatgactgttaaatttttatagtctccctgttcattttctgatgaacacatgacagaaaattgaatgtgagctggaaatacagcagactatgagaaagcatgggtcatgtataatcactttaaatttaggctggtgttttgtattcatctataatatgaccacctcagggagggatgtaagtaaacattctttttttagttatactttaggtggcttaattattttaaagaatatgttattcaagaattgtctattgtactgttttaaagaataagaatataattcattaccaactttgaatgtcttggattcttagtactacctttttctttatcatgactagtaggatcacatcataatttggtactgtgtgtataaagatgaagtgtgcttacctttattaccaaaattcagaaatgaaaatgtgaatgataaaagataagggatggctatatatttttttgtttttgtttttccaaacagaatctcataacttaccaggctttagaaaaacatctttgcagtatgccatcatacctcagaatgttaagtagataggaaataaaattttcactttttgtaaagcagtagggtattatcctttctgacagcctgtaagactgttttggttgccaaggggccaatcttagaagtggcagtttttgttttgtgaccaacccacagcttaccctttgttagtccatatctgtcatcttcattttctctttctgcgtaaatgcttcttgatacagtaagcaggtgtttcaactagtcagccatctagtgtgatcttttctggtttgctacagtcagtaaaataagtagctctataagtgtaaatagtattacttgttttatgtagtaaaactccaagattaagttagagatatttttggctagactacattgaatgcattgacaatggatttcccagctcccagaaattcgtttgtgtctgaattactttatacttggcttattgtgtagagaaaactttagaaaaagttcatccatccatgaatgttgaatgaatgagcagattaataaataaatagctcagggaaagaaaatgtgtgggcttttagtcataactatgttttttctcttttgttcccttccttatgtgccatttttcaataatgggagtgtgtatctaatgatgttgataaactttttaaagtcattgatgaacagtaatctgaaaatcaagttttgattaagccgtagatttcttttagggtccaatattttctttttagaaatccactatgatatttttgtagggataaaagacaaccatgtattctatagatggaaaatggtaggatacagtttgttggccggccaacttctctgaaaatactttttcctgcatagaagataatcagtgttgacaagggagaagccaaggtataatggctgttattcatctgtctcatgtattcgtcaagtgtcatgtgttaaatatgaacaaaaaagacataatctctttcctcctggatcttaaaatctaaagtgagagataattcaccagataaatgctgcgataagggaaatagaggattctatgagcttatgactaaggatagatctgtttcctcagatgtggaactaagaagtggcagtagttgagaagttcattttgggccatgcgatttgaggtgtggctattcaagtataggaggtaggtggttacacattttttaagctattaaatagaactttcacttgaaaaggtttttttctctctttcctcagcatctatctccctacatacacaaaaaaattgcatgtcacaattcatgaactcagtgagtgactctattttgaaaaatgttagattatatcaactgaagtctgttagaggcaaatgcttttggtcatttttttcagcagggacatttcatatgtgtaaaatatttagaatccccatgtatttatatataaatgaatcttttaccatcttaaatgtttaataagttatatttttcctttctttcaacttaagtatacaaggttatcagcaaacatttgtagatgctctatgtgaggtgttttgtttattagttttaaggaagagaaaaaaggatggattggatcaggaagtcagttattgttttctgggttagtttgagtccaaatcctcaaatatgcggcgatttataagtagcaaactaggaatttaatccacttcagttttggataacttggataagacactttctgtctatagatctgtctatagataacttggataagacaagttatccaaaactgataaatctgaattagttaacagatgaggcaaattgagattgtaaatgctaaaagattattagaaaactttataaactaaatagttctatgccatgtctttttagtattttgcttgtactataattgtagtgaaaataggtcagtatctaatttttatagtcactagagctctccaactaaatttagcttagatgtttttctagcaattatatacttacaaagtttacttttaaaaattgtgtaatacatgcctttatagaaatttaagaaaacgacttatggattatgtacttcagatcacagcacaactagaagatgttgatacattacataaaaaatcaggaaacctatgaagaacatcaaaagtggcaaggtgtgttcacttgcactttgtgagattgaaactgctgccattatctgtgcaaactatggtttgagtacttttaatttagcaaagactaattattttttaaaaattttggggtaaaaaaaatggtctttagcgtagaagagctttacccgacttactttagttggttcaattggttgattttggtttgctttttgaaattttgtattgtcttaatttggggcacattgaactcaataacagttcagttgcattataattcatttgggtaaagtttattgttggaggagggtaagtaaatatttaactgaaaaagtgaagtaaatatttatttaaggctataagttgaaatatttgtcagctgagaaattttcaggtaacttttttaacctttgaaaaaaatttactatagcatgagtattttttatactgctatgtataatccatagtcacgttttttaacctttttatataaaatactgatacagaaaaccatacaatcatagtaatcttttaaaattgctttataattcacatagcgtaacattcacccatttaaagtttacagttcagtagtctttagtatattcagacttatgcaacgattaacacaatttaattttagaacattttcatcacctccaaaagataccctgtactcattagcagtcactccccattcaccagtctcccagcccttatcaaccattaatccattttctgtctatagatttgtctagtttaggtattttatataaatggaatacaggtaactttttattagtgatttttcacttacatgtgtcttgcatgtctcatgagatagctatgaataagttagccttcttttacaacttaaataacaattcttgtctgaccgggaaaaagtattaagttattgagagactgcatcccaatttaaaccaagaaccagactccttactagtattataactcaaaagaatgtgtaccattagcccttacctctggtggtgcttttcactgtgaattgttcagcagcctctcaacttcccgaaaataccacttaagtcttaaactcagacttgcatgagtttactgagatatgtttacctttgcagctggcttgcctagagtctaccttcttactaccctactaagtccagaatgaggaagaattaaaagcaagaaaggagatacagaagaagagattgctcaggctgaggaggggcaaagtgataagagcaggattagaaagagacattaaaaattcaaggatactgagtttgttggcatcagaataaatcttggaggctgttttaagagggaataaaacctagagggaaggaataaaaggcaaagatgttataaaacataggtaaaatatttaaaatattttgtcctgaattttgaattttaggcatatgtcagtgaagcacaaaggatagcccccttttttgatgagctttagtatccttaagatattttctttctagaaccttgtgtaggaattttacagctgaccataatcatgtgttctctttggtttgttccaacatctttggattggaaccagtacagagtaggaaacccatatcaccttgggattatttttcagataaatcttccagaggattaaatggcaccatccccgtcaggtccaagtaggaggggaagaatcctattttgggtgctgtcagattcagtgggctgtttagttcactttttatccagaaaatggagctaaatgagaaattgcagcttccaaagaaaatcataccttgattttatagatcaaagcctttctgattagatcagaattgttcctgagattttaggggcattcagttaaagtgccccaagaagagtgataaatcacatataggtgtaaagtcaataaagtcctatagtaagcagactggaatttagggggaggggaatacacactgttagactgttggtacctatatttgactactaggatgattatatattttaaattctgtattcagtttcttatcagaaatactgcctacaatatcttatacttaattttttaaggaacaggtgataaagataggttatattttcttcagaataattgatattcattatttaatagataaaatgtgttatctgaatgtttatagtagtagaaaccaagtttacaaaatgtctatatataatttgtttttaataaccaaggattctttctttacaaaagatttcctctatataaatcttcctgttttatagatgatctgtattataggagaaatgagtatttgttgatttaactggctaatctacaggactgagcattattagaggagtatttaaacatagaagtctgtgaaaatatttttagtgctgagggaaattggagggactttctagaaccgcaaactaatagaaaaccaggcatagtggctcaagcctgtaatcccagcattttgggaagccgaggcgggaggattgctgaagccctggagtttgagaccagccagggcaacacagtgataccttgtctctacaaaaaaatttttaaaattagctggacgtggtggcacatctatactcccagctacttgggaggctgagacgagaggatcacctgagcccaggagctccacgctatagtttgagttgtgatcgtgccattgcactatagcctgggtgacagagcaacaccctacctcaaacaaacaaacaacaaaaaaacccttctacctctgaacatgtggggatttaaagattgctatgatttaaatataaatcatgaatatagaaaatatgagaacagaagagtatttgttaaacaagactaagctgtgctgcataaagtaaggcactatcattgtgctggtattttctgattctcttagtgcaataaatgttaaactttactactaccttagccatgttgcagggaattgacatgaatagttcctgggttttggctgggtgcggtggctcacgcctgtaatcctagcactttgggaggcttaggtgggcagatcaggagttcaagaccagcccggccaacatggcgaaaccctatctctaataaaaaacttaaaaattagccgaacgtggtggtgcacgcctgtagtcccatctactcaggaggccgaggcaggagaattgcttgaacctgggaggtggaggttgcagtaagccaagatggcaccactgctcctagcctgggtgacagagggagactccgtctcaaaaaaaaaagttcctgggcttcaagggcactctaatgtgcacatcttaaattcttagagcctacttctatggacgatttatgttactgttgatggagaatttgattttcttttttatcttcccctttcccttggcctttgtaggttttttgaagtgaacatacttttatgtatttacttatttattgagcagttcccaaatggcaactttattattttatttcttcaactcagttgtctagtttacttcatttgtatctaatctatttaactcatcctttgagtttttaatatcaacattttaaattttatttttttagcttcaaaggtgtgcatatgcttgttacatggatatagcatgtataatggtggaggttgggcttctagtgtacccatcacccaaatactgaaggttggacccaataggtagtttttcaaccctcaccctctcccacccaattgtttttatttctgaaagtaatatttctttcttggtctgcctgataatttttttatagtttcttatttttcgttagttttcaaaaaataccttgttgggcattttgtccatagatgtactatcttatgtttgctaattccaatatcggaagtccttaggaagttgtacttaaggtagtttgtttctttctgtatttggtgattttttttatgagctaatatttgattaaaccgaatatttctccatcctctgtatagttgcctacaatgtaatttctacttttttttttttagcataaaagagtttcattttcctttttatactcaataacttgtttaattagccagtatttttaccagtttctttacttattgttccttgcatcttctctgagtccacttttcttcttgctgaagtacatcctttagtaatccttttagtaagaggctggcttgtaaatgtccttagtttttgtgtgaaagtatattttatgcattactttgtttttcagctagatagggaattcttggttgataggtttcctcccatcagcaacctcagtatattatttcattgtcttgtgaaacttggcaaacttggatctctgagaagttcgatctctgcctaattgttatgcttctgtatgtaattttttttttctggtagttttttaaaagatttcttttctttattctgtcaccactacttactgtgtgaccttgggcaagttcaaaatggatataaaattgtatctgtgtcatagggttgtaatgaggattaagttttaaagcacttagaacagagccttgcatattataactgtgacatgttaatatttgttttattttgccatacttgatattctaaacacatttctatgatatgcttaagtatgttgttttatccatagctcctctttgaaatacattgttgatgggaagattcatatctttctttgtttctagaaaattccttagccttcatatctttgaatattcattttccaatattccttcttagtctctgtattatgttctaggtggttcctcagtatcattttctaatttactaattcacactttgactttgtccagctagagtttatgtggcctcagttccagtgaattttttttaaatattcaggctgtctctctaatagccacctattctggtttgatttctgcctatttttaatttttcttcctttaatgactattgtggcttccttttaacatttgaaattattttcagattgtcattttttcttctagaatgaattacagttgttgattttattggctgtccatcttagtttagttttctttgtgtgttttgagtttgcttttgcagtctcctattgactggaagtttttgttgtgttttctttttcactcttcttatccagtgtttttacatgcacctacatctctgtctaaaaccacatctttatattggaggcttgattcccttgattcttggtaacatcaggatcaggcttctctttccaagaataagacacaaactaagatctatatttcttctcactggacacataatttcatctaaaccgtagccccatgcaatggttagtagtagctttttctggctcctttcattggttggaagagcctctccaccctaggtattggtttcaagcagtgagcctgagttctatcccagccatgcatgggtacctttttagtccctgttactatccctacaggatgtggacttttggccatctctgttacttgagcccagaaggctcacagttttagcttcaaaaactgctttgtatttaaagagttcagtggcttggtcttttttaatattttgtttgtatagttaataaatatttaacatacattaaaatgtttggaacagatacatttcaaaagtgaatatacaaatccatttggttggaagttagtccattttgtgttgctatcacagaatatcacagactgggtaatttattaataatagaagtttatatagctcttggttctgagggtggtaagtctaagattgaggggctgcgtctggtgagggccttcttgccagatggaaggcaggaatgcaagagagcacaagtgcaaacaagggcaagacggggccagactcgattttaccaggaactcactcctaagataagggcattactcaattcatgagggcagagccttcatcacccagttactttttatggactcactggttattactgtcacaatgacaattcaatttcaacatgagttttggaggtgacattcaaatcatagcagaagtcaatgtttaaaatcaatgtatatcctacatacccttcagaaagatactagttgactctcctacttatgagaggtatatttttttattcctttgccaatattgggtgtaataattttttaatctttgagaaggtaatgtataaaaaacaaatttgtgtttaatagctagcaggattggtcattgctccatatatttattacccatttatattcttttatttatttaattgcctgttcacattcattgcccatttcttttcctttaaggtgttcatttttattgtcttttaaaatagctgtttgtatattgtagtaatgttaacttttgtgtatatattgcagatgcttaaaagacgtttgcttttcaggttaatgagctttattttatagtgtaggagtttcttttctctggagtcactttttcttattcctttggaatcagtcttttcttgtcatccttagaaagtcctttcctaccataagattacagaaatatttgcatacatctactggtattgttttattattaatacttcagacttcaatctttaatctcttggtatttattttaaggtgtgatgttgaagggattcagctacccaccactggagggcaggagtggaaaagatcagctttcaggcacccattattgaatctctctgttcccagagagctctttctggattctcagttctattccactgataaatttattcctgcattagtattgcctcttaaatactataatttggaatcaagtttaaatatcaggtattgcagattctcatgattttaagaatgttttggctattcacatttattcatatatattttgaaatgatttaatcaaggtctgggaacaaaaaggtccagttgtgattatattgaatttatagattaaataaagggaggataaccatcttcacaattttgaatcttcctatccaagaaaaagaagtgtgtgttattctgaagccctcttcttaaaaaggttctatttcttgttatttatttagatatacttttatttctgttttaactttctaagtgattactgttaatcattttcatatatggttttctatagtcaaataatcttattgagtatttttttccctatcatttcaggttttgagtttgccatcatgtcattaactgcaaatagttgatctccttataattttatgcctctttttgttagccttggcttatctcaataaccattatttctacacattgctgagttacagggataagagttggtgtccttgttcttttttctttcctgggaattgttctagtactgagatttcctctttggcttgaagtaagtattatattaaggaataaattttatcaaatccctttcagaatatgatgagatgatcatatggattgtttttaacttttaaaaagatgacttacattagtcagctgcctaatgttggctcattgttacgttcctaaaatgatccctatttggtgatttgtaatatatattttactgactttttggcatctgtattaataagtatgtttggactatagttttatttttttagtgctgtctttgtcaaattttatagaaggattatgataggtttgtaaaaagaattggaaatttttttcctgtaatctatagataacttaggtaatttgagagttacatgtttccttagggcttgaaggatcttgttttgaaatagtcttgcctgatgcacttttatttttaatagcttattttgagaacaatccaaatttaaaatttgcaaaaataatacagtgaacttccatatttatttaaatggccaattgttaacatttttccacattagttttacagacttttttccctgtgtatgtgcatatatgtattcatattctcttggcatgcacacacacattttgttattttttagttttgctgaaccatttaagactcagtatggacatcatgaacctttactcttaaatatttaaatgtgtgtcccctaagaacaaggactatcactttctcttacataaccatagttcaattatcaaatttaggaaatttaacattcatacaatactattatctaatatacaatccatagtcagattttatcagttgtcccagtaatgtcctttataacaatcttcccctccccattccttcaccctttgccttcatccaagccagtccataatcacatattacagtttgttgtgacctccttggtctcctttaacctggagtggttctttagtctttttgcattttgtttttcatgagctctgaagttttttgagggatagttctttaataactttctcatattgttccaggtttctggtcttcactctagcactaattgaaaaaaaaaaaatttgttttccgagaactgttactttcctccatattttcaaatttattaacagagaattgtacagagtgatttattttacaacaataaaattctatttgtgaggtgagtatagcctgtttggcttctaattttaaataatttttttagttagactatttagtggcttacctattttatttttttcacatataacatgtactataattttacgtaatatattccttcagcttttattttattttgtatgtgtgtgtggttcatttttctttttaggttgaatatttagtatactgattttctttagtatactggtttttttaactaagtgtgaatttttttttttctattttcaacacactattgctggcttaaaggtgaggtttcttaataaggtttggtcacatctcagaatttgataggagatttttctcattattgtttctaaatattctataattgtagaaatatgtaaactcaatgcaaaaaactggtgtaggagcttactttttaagcaatttccacgtttgaggttttcttctttctttacacattatcaatatctactattaatgtataattcagatgtgtcatttcattatttcattttcttttttttttttttggtctgtggggtaggatgggggagtgtgttagaaatctataagcttttctttccaacatataatccaataattatttgatttttcaattaatgttttaagtgtgtttgaacagaatatatagtcttgaaattttggaccacatcttttaccaatttaaaacatggctcttattctgtttattgctttattccttgtgatttactttgtctgaaattgaaattgcaattcttggtatcttttttgcctagtgtatttcgaccacaacaaagtacttttatactgacatctttatttttgagtttcttggttttgattagtctcttgattgcatgaatctatctttaaatagtttattttttcagaaatgaaacatggataacactactttagtgctggcatatttgatcatgtcttcttcatgtcttcttattgcgtttacatataaatgacaaccttgctggtcgtagtattcttggaataaaacctctttatcctcaacgtttataggcattacttcgttgcctatcatctgatgttgcaaagaagtctgggaccagcctgatttcttttttctttttcttttttggcatgtttattttattttttttatttgagacagtcttgctctgtcacccaggctggagtgcaatggtgcgatctaggctcactgcagcctccgcctcctgggttcaagtgattctcctacctcaacctcccgagtagctgggattacaggcgtgcgttattatgcccggctaatttttatatttttagtagagatggggttttgtcatgttggccaggctgatctcaaactcctgacctcaggtgatcctcctgccttggcctcccaaagtgctgggattataggcgtgagccatcgtgcccagccgatggcatgtttattttgtctgaattgtattcttaaaatttgtaatcttcaaattatgcttcggtattggtcagtttctactaaatgtatctagtacttgataaacgccattcaatcaccaagttcagtctttagtttatgatttatttcttctgcctttgaaatttaatttttcttccattatttggttttcttatttacaatgtgctaattgagctgttggatctgcattgtttgtatcttttctcaagtctacttgtttttgtttctttatgcttacttgcatactggatgatttttgtcctgttcgtttttaccccttgcagattgtttgctgtagtgtcttcattcctcattattgcttttcatgacatttaaaatattgcaatgatattttttctctgaaatatctttttttaaaagctctgttgatactttttatattctggtttcttttcatccctgtttcacaaattaggttttttaaaattttcttatatgtaagttgtcacctagttttctaaggtaaatcttttagactgtgacatcatgttcttgagtacttttttagttacttttttatttcagaatttttgtatgggttctataaatttttttctgcttttttacttaaagggtggcagttttctctgttgtttgcccaaaaataactagctactccttgcctgttctgtcattatactaggataccattacctctttcccccttggaatttaacaggctgaattatattaaattattttagttatcatatttcattatttttgagagaaatgatagggattttgtcctattaacctgttacaggtaagaaactttgtctttcttgatttttctcgatgcttgttgaaattactgattattttagttatcatatttcattatttttgagagaaatgatagggattttgtcctattaacctgttacaggtaagaaactttgtctttcttgatttgtctcttgatgcttgttgaaattactgcacattttcatctttacaagtttggcagattttctttcccaacagaagaacttgactattgggcattctgctaatttccatggctgctataacaaattatcacgaacttggtggcttaaaacaatacagatttattctcacagttctggaggccacaagttcaatatcattttcacggggacaaaatcacggtgtcaccaagaatgtgctcactcccgaggctttaaggaggaatctgtttcttgctttttttcaccttccagtggctgtcagcctcatcacttgcctggtagccacatcactcgaatctttaagaccagcgtcttcaaatctgtgtctgctctgtcttcacatcaccttctctgtgtgtgtcagatcttcccctgactctctattctaaggacatgtgggttcacttagaggtctctggataatccaggatcctctctccatctcaagattcttaatcacatctgcaaagacctttttttccaaataaggtaacatttataggattaggactggtatctttgggagtcattattcagcctactaggtatcattttgttttgctactttagagtgaggcagacatattagtcaaaaattggattagagtaaagcctcatagattgtgctgtttgttagaatcacagatactgtcctctttaccgaatgatgcaaactctgatgccatggtggaaaagtatatgaattgaattggatgtggtcaataaggattgctagggactcgagaatgcatgttgttctagggagaggaaatacgtgaaggtcaaattcaggttatcaggttatcagtttgtaacctagtttgtagctgcttttttcttttcatttcttacaagctggtcttgctgtagtaaaataattttgtgtgtctcttataatcttgatattgagaataagaggttttttttttaatgggaattccatccacatgattttaaagtattactttactaatgatatttacctaggtattcctagaactttagtcttctcatgtaacattttatacatttctcagaacaaggtaattgacaaataatcaaggttgcttatttattgatgaggaaagttagacattaagccaaaggacttgtccagtatcgcatattggatagacctataatttttaactttaatcttgtggtgacaggtatttccatttttttttttttttgatgtttcatatgtgctttgatgttgatgtgtcatgtgacatgaagtgtctccctattgttggataattgggcaagtctaagttctttttactttatattcctgattttgtttttctagatgtgttatttttacagattcaggttacttctttttttaaatcatgttattagagttaaactaatgaaaaatcatatagagatgaacttggttttgaaatataatgagtagatacttgcttggctggaattttttctcacaagttttttataaagatggtatgagtgtatactttgtatccaggaatgtgtgtacactagggggagtgttggggggatgagggtggaagacattttaagacacacaggaggctggtgtggtggctcatgcctgtaatttcagcactttgagaggccaaggcaggggaatcacttgaggtcaggagtttgagaccagcgtagccaacatgatgaatccccatctctactaaaaataacaaaaaattaactgggcgtggtggcacatgcctgtaatcccaggtacttgggaggctgaggcacagaatcacttgaagccgggagccaagatcatgccgccacatcccagcctgggcgacagagtgagactctgtctcaaaaaaaaaaaaaaaaaaaaaaaaagacacagaagaccctaagtgtacactcagatgctctttatatccatatccattatcagtttggtgatacgttattctagtttcatgaacctttactcttagaacttggtttattctctaatatcttttggattcagttttgcagttgagatggctaatatcaatttgatactctttccttttatgattgctcatgtttttgtctagaaccttgcattatagtatttttttttcttttccttgcatttctatagttgtgaacaactaggagtgggtttttagcaattaattcagtgagcttgttaattttgaaaaggcttcaactgaggaacactttcttctcatttctttgatgatagcttctctgtttctccttcagaaagtcttgttttttatatgcatatttactttttgggtgcactctccttgttaatgagttatttgcatctgattttgagtttattcagcaaatatttattaatgatttactgtatactctgtgcttggggagttgacctagggaactcaaaggaggctcctttgaagaattgatgcttgagctgagatctcaggaatgagtaggaattatctaagacatgagagaacagctgttaaggtagggaaagtagcatttgtttatatatttggaggaaggaagtatgatgagtactaggtactgtaagaaaacccttgtggttggagtagagaatgtaggagaagggacagtatgaagtgagatgcggctagagaaggtacgtaggggcttgacttcccagggccttcatgtgagccatattaagcagttatttatccacctcctacccccagcagtggaaagccattgagaaacttttagtacagaagtgatatggtgaaatttgtattttgaaagatttacttaggctgcagtttggagaatgaattagagggatgccaggatccacgtgaagagactaaagacgctagtattctgcagtgagaatgatggtaacttgagaccagggcattggtagaaaaaagtggacagatttgagaatgcttaggaagcatataacccatgggatttgatgatggactgatgggagatgaggtagagagaggtatcaaagatatccttagtttctgtttctttttctgagttggggtcttgctatattgcctaggctggtcttgaactcctggattcaagcaatcttaccgccccagcctccaagcagttgggactacaagtatgcaacaccgcacccagtgaatgttcttggtttgtattcaccttggtgggtgatggtgccattcactggtaaaagctgcagatatgtgagggtgctcagggaggcagcatagaatgggaaaagggcctacatgtaacccttgaggaatgccaatgtttaatggcttgggagatgaaaatgagcctgcaaaggagacgacggaaaagcttaggggtaggaagaaagctgggagtgtgtgtgtagcatcttgaaaggccaatgggaagagtgtttctggagggagtgttatagttgaatgcttctgtgagcagtcaattagaggagggctaaaaatgtcccttagattaagtgacttggaggaacttgatttagtaaaatggccagacagccttttggagcatcaacattttttttaagaagtttaactgtaaagagaagagaggcacatgggtagctcgaggggaataagtcacatgaaaagttatttttaatgggtaacatgggtgacacttgtggctttaaaagtcacactccaactgagaaatgttgataaaaaggagaaaaaggaaaatagtgtaacattcctgaaaaaactgtcatttaagactcctttgaaacatgggcaccaaagctagtctagtagaggatttattatcagtgagaggacagagtcctattacagcagaaaagtaggaggggagggttatgaaagaattcattgaaatggttcactcatttattgatcttttttttctgtagtatccaatctgccattcattgtctctattgcaattttcagttcagtaaattgcttctcatttccatgaaactattttcagagtacctcttttttaattgacagtctgcaattgttttattcattcaatgtcatttcatatcttggttagtttctaattttgagctaatgaatactgagtctccctcttttcaacttctgaattaaaaaaaaagtcatcttatttttctctgttcatttttacactttatttagcctaagtatctgaaattggctttgctagaaattacaattagttcactgttgttttctttcagtcccagacaaaaaagaaaaattttagatttctttcttttctcttcttccttttttttttttttaaggtcatttatctttggcagttttagagatttagaaaagaaaatatatagacttgtaggcagaagaagatatggcactgagggaagttttagttttgttctgtgacagtcttccttatcttgtatgttgtctttaaaaagcctacacatttagattttcattacctcatttgcaaggatacaggatagcacatgtaggagaattggagtgtaagtccagaaacctaagtcttattcttagccttactgatgaaccagctttgtaaccttgggcaagttattctgtttctctgcaccttctcatttgtaaaataggtttacacaaatcatttctgcattttggctctgattcattatgcaagttatcaaaatcaaatttgtaactataaatgagtaatattttattatttttatttttttagagacagagtcttactctattgcccaggctggagtgcagtggcaccattataggtcactgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagattagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatctttgaggacaaagcccgtacatatgtaagcattagtgagcaatgtagaatataaagatttggtagcagtagagagtttacgctctacatcccactgcaagtaatttgaatattgccatattatccactgtgacctgtgctgtttgttaacgttccttttccccaccttccccgaggagcttgtagtctctcactatatatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcaatgttcttttgttatatgagtaagaataactctggtatttgctaagagaatataattttctccacattgtatgtatctatgtcctttgtttataaagcctggggggcgttccctattaggttaagtgtccctacgtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggattaaaccaaatgaccgggttcaagactctactatgagttcacctttgcttaataaaaggcaagactgaacattaattaatgacttcttggcccagccttagaatttttcagtttagggattagtttggtttttaaaaggtacaaaatgttcatgaaattttctgattatatcaaatattaattcagtcttgttttttgtcatagtactttgttttgaaaagttcagatcaactgataatactagtgctgtgatgagactcagcttgtactcaagaacagatttatgactaggtgagaactaaaatttctctcagaaactaactaaaaactttcatggacaaattgaatccccttgggatttactatttatggatatacgccaatttaattattggactaaataaaatactctttattagtccacttatggaagatgactgtgtaaacatagtatttgcaagtaagtactttttggtattatatttatataatcagctcttgtatccatgtagcttatagttggctgcttcaccaggactctacaaattgctcagaacccaaggaggtaagatttttatattgcctgttttcagtatgtaaaagtccagccacaaaactattaatttacccttgactatatttttacagttgctgtggagctgaacctaaaattttgttagatggttacttggtttgttacatttttatatactaatttatatactataataatatactgtatatattttttaaagtctggggtttgtttttagaaagtatattctatcttcaaagaattatttggtagtttcatgtgtgtatctggaaaataactactgtacttctttataaaagtgagagtgaggtccctgctagttgaggctggaatctagacgtggctgtttatgtaggagttagtaattaaacagtgcctgtttgctgactgcctcatttttgccaggctctgtatgggtgccttgcaaggcattgcctcatttaaaccttgcagcagcattcagaggaaagtattaatatgcccactgtacagatgaggaagttgaggaatgctttattagtaggtgtgaagtgtcttaagcataatacctccctcctcaaccttgctccctcatcctagttaagggaattgagacacagagataaggcaatttgctattgaccttcagcagatgacttaacctcaccgtggcttagtttcttcatgagtaaaacagggtacctatcttttaggattggtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataaggaggaaagccaggctcctaatctgtctaagatagaagtgaatcttagttaagttttaagataatcctatgtgcttttaaaagatttcatggtttgcggtttgcttttctttggctcccagtttctttttttttttttttgacttcttagtacaggtaacttttgaaggaattcagcttaccttagatgaaccaaaggaaagctaaaagccgagataatttagaaaaactaaagcagagattatgttcctaaattccctctttctgcttcaaagtccaggaaacaccacctgcagatacagttgtatcccattgttagaccctttcctgaagccatcctcttttctttgtcttcccagagagaaactagtcattcgacaaagattgaacttcttctgtgtgttaggctgtgctccaagtgctgggaagacaccagtgaataaaacaaaaagtccctgctctcatggagtttacagccactattctaaagtttgtctgtattctgcctgtccttgtttttatacttttagcaaatatgtgtatagaattgttttgcagccttgttcagcatattgtcttcttttgttttttaggaatatctgtttatgtaattagatctgtttttgataaattgtattctgttatttatccttcctaccttctaatgagcagttaggttatttccaacattgactattatggttctccaaaaagatcattgaatatgtcaccttggatggatggatgggagagtttcttcaagacagcatgtttcagactttttgttgtgaccacagtaagaattatgtgcacctcagcttagtaaatacaaatatacacttgggacaaaaacttcaagaaacagtatttacttacttttatcacctgggatgcactctattttgttctgttttgttttcttgagacgttgtttcgctcttgctgcccgggctagagtgcaatggcatgatcttggctcactgcaacctccacctcccaggttcaaacaattctcctgcctcagcctcctgagtagttgggattacaggcgccagccaccacacccggctaattttttgtattaatagagacagggtttcaccatgttggccagtctggtctcgaactcctgacctcaattaatccacccacctcagcctcccaaagtgctgagattacaggcgtgagccactgcgctcggcctattttatctttttcaaatgcagtttacacacaacccagctgattgggttgtgtgtaacccatactgattaaactgatttatcacccgtgttcattatttttaaaacgttgttttgagatctataattagaagtggaattgctgagtagttgcttaagtgtatcttcaacttcttcaactagctgttgccagttgcaattcagagtggttgaaccaatttaaactcctatcggcactctaggggagttcctgtttctccacattctgaccaactcttgatattgccagatggatgagaaatggcatttgttttaaatgtgccttcccctatttactaatgaagtgtttaaagtgtcttttaaaatatatcacatagaagtttaatttaatggtaatcagagctggcggcaaggaggaaatattattgtgattgactgcctcctctggcagaaaaaatggtgtaaaaattatataataatatctatattatattgagtatttataatttgctagacactatactttgtgcactgtatacattattttatttaatcgtcataagaatcttgtaaggttagtgccttcttatatacttttttttttgagacggagtctcgctctatcgcccaggctggagtgcagtgatgtgatctcagcttggctcagtgcaacctctgcctccaggttcaagccattcttctgcctcagcctcccaagtagccgggattacgggcatgcgccaccatgcctggctaatttttgtatttttagtagagacggggtttcaccatattggccaggctggtctagaactcctgacctcatgatccacccacctcggcctcctaaagtgctgggattacaggcgtgagccaccacacctggctgccttcttatatgcttatacaggaacagatggagaaagagattcggaaaggttcagtagtcacactattactaagtagtagagccagaatttaaacccacattggtctaatttcataacttattttctttagtacttcatgctattggtgaattcgtagaggaaggaagtttgtcattactattcttttctgttggtttgtctcttaaatgtgtttaattttttgagtttcactcacgtctctttttttctttccttttctcaaggtagtggagtctttcctctgtaaaacttcaccttgttgtttctagtctaggatagtggtcttgtaacctaggatagtggtcttggttactgcaattttggttgattatttcttgttggcccttaatgtgcccccatcttctgccttaggcattccatctaatcttttccagcagtttgcaaccttactgtgcctcagaatcacatatgaaaatttaaaaatcatagatacctaggttccaaccctaccctggaaattctgatttggaaatatttatttttcaaaaagtccacagataattctgttgcacagccatggtagagacccattttcttaggggttaatgatgctttagagtcacgcagacttgaatcagagccctgattcctttaaacttattagttgagtgatcttggccaagttctttaatcttggctaaggttcttcatctataaattggagataatattattatctaccttagagagttgttgaagagattaaatgaagtaatgcttgtaaaacacttaccagagggacttagaatacttcttaaacattgcctgctaataaggtgtcattattacgttatcctttatccaatcaaaatactcacctttgcagtgtgtatcaacttgatgtcagaaaaataatctgataaatatcaccataagggatggatgatagctagttttcattacttacctttcgttagttgaactgtactaggaggcagaggagtaggcagatggttttatcacgccaatcagccagtcttttctgcctatgtatcagtttggacctataaggaaaatgaaggggaaaacaaatgtttttctttccttcctaggaggattttcttcttgccctttttctcccagtttcctctctgagctgagtatcattagcatcatcaataccctagtttcagagctgcgtagtgatttacctagatacttttctccaccattattccctactacctaactcctcttcacctccattaaatctctgttcatcatgctatccttcttttggattgcctttagttcagttgtgacttacttgattacttgaacccaggtgtctacatttctaagctattgttcaagtaagggccaaggtaaattctaaccagctgtctctttgccttgtgtgggcccattctagaccagcgggtgttaacttttgagtattggaaaaggattagattagctgagccttcaggcttgtcagcagggctgtcactagaccctttgatcttctttatatacctaatggtcatagagtataataataatggtacatgttattactatatgattaatagattactagtagtaattttgttatatatgtatacagtacacttcgttatgtatatatataattgcttgcaacttgaaatttgaggctacaacatttacagtaatttaataacttaactgactttatcaaaaactgaaaaacctcatggaaaaggtagaatgtaaggtagacttaaaaggataggtatacttttttctataaataggatgaggcaagagtttccagttaaggaaactgacatgagcaaaggcttgaaggagcatgcaaatttggagcattgtgagtagattattttttagtttttcagagttcatgcagtgggaataaaactagggagtttggaatcaagcttgaaaattcctgaatgttcaaccaagatatatttgagttagtagattttttgggtatgtcatgaattcgtttggcttttcttaattgatatacatacaacttagtcctgagcttacacatgttcattgtatcattaaacatttagcctggttggtttaagttgatggccactgccaggtctcctttctgccttctcccctttatcccaatgctttagtttttttctgcctttttgtctgttgtgatctgtgcttcatcaggctttcccccagttcctccttgttaatctccagattccaagtcagcaacacaatgaatgtctgcttatcgcgagttgtgaattcccgcatatctctttcacttattaaaaagattgtttggtacatattttgtttataagacagttattgactttcctgtttctcttcctttgcagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaaggtttaatggtctgtagcacttgaaagaggaatgtagtgatcattagacgtgatgtaatagaaatagccttgtacatggagtcagaagaacttgctctgagactgtgtatggttttaggtaagctatttaaactctaatcagtttttttcatcataaaaaggataagacattattatcttgtctcatggcgttgtcaggaggatcaaatgggataatatacacaggtgagctagctcagcccctttattttacagatgaggaagctgaagccagagaaggttctacaaacttaagagtcagacagacctgagaccaaggcttacctctattagttttgtactctacattcctgaacgaattgttcaacctctctcagctttaaaatggagataatagtatcttataagactgttgccgggcgcggtggctcacgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatatatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatgtttttttaaacaaatgttgactttttaaaattcttctgagggtatatatttgatactcaaatatttaattatagcatttgaatacttagatgtctttaaaaatgaatgtagttcctaaaagttgtcagtttttaaaattaatacaagttaaaagctggtttataaaccttaggtagttttacctcttatttcatatttctacttatgaagcgaatgtattagccccacaatttataatttattttaaaggtaattttatcaggtacatataactacaggtcaaatcctattgtaaacaatgccactaaaattttctgtcatgttgtatggaaggagtgtgtgtacacatgtatatttgtattaggtatcacttcaaattaagtcaccagtaaatgtttagaaatagtattgttttatagaattataaaaaattattattacagtgagattaacctgtaatgtttctctcctgtcttttggagtattggttatactgtattctctctatactgttcgggggagggggagtcattgcacacacacacgcacgcatgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaa

SEQ ID NO: 2699 - DNA, 53337 bp, Homo sapiens
  source 1..53337: mol_type = genomic DNA
aatgtattatgatgtaggggagggaggaaggagggccagggtagggggcacaccctctccctgaatgaaattcatttaggggcactgtctgctcgcatgttctgttctgggagaaaatgggtagcagaagctacaatttgtactaagctaatgaaaagagagaaaagaagaatggggaagagaagggcaaagaaggcaaaaagagaagagaagaaaaagggaggagagagaaggagaaatgagaaaagaggaaaccaaatgaagaggatgtgtgagagaaaaaaatatgaaacaggtagtgagggaggaaggaattgttgaacctatgttctggttggctttctaactcttgagtagtgactggcttcagtggaaaaggatggtgaggggtattctcaaatactagcctcctgagggggtcatttacattactgcatatattttgagaggcccaggcaagtctgcctcaagggtgactctcctggagagtaatttgggagcaggaatgtaaacctttttttaagtcacaattgtggtggaaagggaaagagagtattgctgatcagattaagctttagactccacactacagcccctgtcctcaccccaagcctcccaattactaggctatcaacacacactaaattcaggactttaaagccaatcttgtagataatctttttctttgttaattgaaatataaacagatttccaaagcagagcaggatagttttataatatacctataaaaattactaaaatgtcatcatcatggcaatatattcccactaaaatcttactgtgaacatcccaaatatgtgtagaggcccggcaaagtcttacagttcagaagagaactttcaatcctcttttttcaatgttattttccccttctatctgtccccccttcttagcataaggtttaataaaaggggatatgatgatattaaacatatttaatcagacaatattgatatctttttaaaatattaatcttataacccatgagtttcctagttcataccaaaatgtccctgcaagctgtattcagaaataaatagtaggaaggtgctgctttatcggcagtctgtacaatgcgtagactccttaaaaatttctttctgttcatattttctatttctctccctcttcttctacaattgacccagattctccaagtgcagaacagagagaagaaaggtgtggaagcctaaaggaaggaagcagaaagataggcaggcatttcaagttttctatggtccactaccgtcactagtgacccagcttctgcttataaataagaaaatttgtcttttaagagcactctaaatggttgccatatgagcttttgtagttcagaatgttaatgagtccaccagcatgctactcatgctgttacttgcctggagtattaaggattccaagaaggtagcgtttcaaagatctctgatctaatttctttttttggggggtcggggagatatgtggagaattaggaaatgtatcctcagatgatactgagaccaaatgcatagtgaattttatttttattttgtatatgtggaaatgatccacgatcatcttctaaggaattctggccgggaacagtggctcacgactgtaatcccagcactttgggaggccgaggagggtggatcacgaggtcaggaaaccgagaccatcctggccaacacggtgaaaccctgtctgaactaaaaatacaaaaaaattagccaggcgtggtggcaggcgcctgtagtcccagctactcgggaggctgaggcaggagaatggcatgaacccgggaggcggagcttgcagtgagccgagattgtgccactgtactagcctggatgaaagagcgagactctgtctcaaaaaaaaaaaaaaaaaaaaaaaaaaaagtgaaggaaacagaaccttccccaaagtcatgttgagaaaattagagatggctttttacaactttaaaagcagcagctaaatatttgctgaatgccagaaagaataaataggttgcttttgatctaagagttggggcaacaaaatggtttaggagatagaaagtagtagggtgcaaattgctatagtgagctcctcaagtaaaatagagaggccttcaacataaatttaccttttttactggccagaactcaatttggccagtaaaagaacctgccttctacaatgaagtctttggtttgtgtgtgcatcagaacatcttttaaaaatacggacttttcttctaacttcttttcctgcgaatgtggtgtaggtcaaattcgtgaactggttaagccgctgacaagagagggaagggcaccccagccaatgggaacccgtgctggtgatgtactgctcctaggctgcgattcattggctgcctagggtttgtcattctatccccggcgtctgcaagcagcgtgggtcgggttttccagctagctaaactggattttggccgctggcacgtgcagtttctattaactttagctcatctctacctcttaatagaagcagctgttatgtttctgattattctcctgattttgaaaaatcctgttcccttaacctacctcattggaggtcgttggaggtcccctgggacagaaccacgtgattatctaacatgtgcaaataaatacaatgtggaatcccctgaactatagagggaaaacctgccagaaactcagagcatgtgccccgtgcgtgaatcagttgcactcgcacattggtgggcggtggtagcgtgcttgtgtctctgccctttgggtcgcgaggtgtgtggccgtggcacctgcttgggcttcctggggtcactgggagaggaaggctctggaggagtgggactctggggtaggggggtctggcagctgcctgggacccaccatgggttcgaagggcagcggccagaccgcgacggcgcccaagaagggtggacagcttcgggtctgtgctcggggctgcgtgtacaccatcttcgcagggagtggggtttgtatctgcaggcaggtagaagagccagggctccgggcgcggacgccgtaggggtagcttccgagtccctacttggccaagggccggcacggaggggctgtcgatctactgggcacctaatagccgcacattctgtccagtccctggcgccggaacgtgaaggcccgggtcctggctgctatccgggatccggacgctcccttcggcttcggcctggtgctccaggccgtaaggcaaaggcggcggcagcagcagcggcagagaaagaagctgggtaaggcagtgacgtcatctgtggcggcccctcccccgcccgccagccctcaccgcagttcctgcccaacgacatccgggtctctgtagctgcgcgccgcgccgcagctgtagcggcggcggagccagcggggcggggcgagcggaggggtgggggaggggcgacgcggtcgtgagcgcgcctgcgcggggccgcgctagaggcggcggcggcggcggtggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccgggtaagtgcggcgctcgggccgacggcgggctggcgggcggtgcgggcctgcgcggcggcggcggcgggcaggcctggggcctgtaaacaagccgggcgtctgcccgggcgctcccgggaggagacgcgacaactccaccccctggccggcctcctcccccgagccgggcggcggacggcgaggggttaacgctcggcgagggcggtggcggggaggcgggggcggggtgttagttgcggtggcgcggggagggggcgcgaccctctggccgtccgcggccgagatgggtgtttgtggcggcgaagcaggcgacggccgcaggccggcctggccggagagcggcctgcagaacttttcccgagcggggagggggcgtccccgcgcccccacccgctcgggcgcgccgccccggctgtcctgggcttcagcccctgggagggaggcggggagacttcctttgaaccgggcttagcctcgaaaaacctaattctgtagaaattgcttaaggttttacagggggcagggctgagagactccttcagaactcaagtcagtgagtgatgcctctagttcattcattattaaggcatcgaacaaatccattgaagtaaattccgatttcttatccttttaactacgtaaatcgggtaaaacttcttgatgttagagcttggttgaggtatggttctgttctgcttgtagattttaaataaacttggagccttttcttgaaagacagctggctgtggagagccttctaccaactgcagttttagatacgttttgaaaatttcatcacctgaggtatttttcttctctcctgaaacaccacatggtacaaatccacaaaagtcatgcttcagttgtccaagccatgggatctgtgtgctagccccacctccccgcaagtttcctgctcattggaataatgagctgaatgtgttttaagaagtggttggaagagtatgagagataggtatcattttctcaaaggaaatgattttgacattattgagagaaattagacattttaacaattgttttgtaaaacagtcttttcaaacttgcacgttggggttttaaacacaaccactttacatgtgttgcgctccgaaaagtggagggatttgttgaaacactactctgctgagacttagggttccagagcacttgggaatttagcatagcttggtccccaactctctttgaaacactttacttttatacttttatcttgctacatattgggccttttccaaagattgtatttctgtaactccttattttacaaatgagaaaattgaaaataaggagattctctattcttagatgctgcttttactgacttaatgctttctttaccaataaataatttgaagcacaaagtaacatttcctagtgttatagttttgttcttgttatgtgtaacttatatgtatctgattaaactttcagtcatgtaaggatgattacttttaacctggaagtttacagcagtaccacattattgaaactataatgaacttcctgcacatggcagttgcctaagacattttaatttgatatcataaaacatttttagatcggtgaagtaattatattatgggaaaggtgtattaagactgataatgtttgaagttaactacctcaattatatttgagaaataatagtcatcaaattgctttttatttggcttgtatctttttatgtattttgtgtacatattgtatctttttacatgaggggctgaggtatatgacctgttgaagggaacagtgcagtaggagacaaggattgtttagtcatggctgtgctccaaaatatctgtgtccatggacaagtcctttaaccttttgagtttcagcttccaaatcagtaaagccagttgggcagattatattatcacatgtactgtccagttactacatttaaaaatttttttttatcaatattgtgtgtctagtcaacataccgttgccaaataaatgcctgttatgtgtcaggcacttagatgtttcagtgttctaaggctggatttctttctcggttctgttttatttaacaaattctaagttggtgatggttctttagaaaagctgttcttgtgttcttgtaagctattgatttttcttttgggattgggatgtgtagggaaactcttgagaggaaggaggatggagatttcatgggagacaaagggtggttgagactacaggtttgaacaagcacaggacccttggtagtctgatgtgaaggacattataaaaacacattatgaaggttttttctgtcacttcaagctgggtcttgttaaacctttgaaaattctctaatacctcatttgtttttgaaagaaatctatagcaacatcattttgtcatgtggtaaatattgctgagcagtcactaaatacctatagtcttttagtttgttcagattacatctaggccatttgtttactctaatagctaatagaatgtacagctgattttggtttaactgtgcgtgcatatttgtaatttttaaccaagaagtggcatatgtccacaaggaacttgttatctctgaaatactcacccatgagagctggattaattttttaagatgtaaatctatgctcatgtagaaataatataacaaggtgatattttgatgatcctctcaaatgattatctaactcttgcctgggcacctgactctgagtcagtatactcttgaatactttccatccttaatcaaatcaggagaaagagatggccatgtaagaaaattggccacggcagggttttataagagttaagcaagaagataaaacaacacatggccctgtgaaatatataaaccttggagaagaggagaaggtatagtgaggcaactgggtaaaagttgtgtcttcctctaagtaattttatgtcacaatatgtcctgtcttccatctcaaataacaaattttaaaattaagttgtgtttgttattttgctattagccaagatatataaattaactgacctgggattattagccatttgtatatgaaataaacttgggttaacctatatcaaaatcaaaagattgattatattctttacccttcactctttcaaatgtcttatgttctccatattacgtaacaattttatacttcattctgagtctccagaatatattctttgatgattttgacctttgaatgtcctggctatccatgtactacctagataatctcgttaccaggcttttcttttgctgaggcaggtcagagctagagaaagtaagcaattgagagaggcaagtttctgtatacctgtatctaaaatgtaatagactttataatttttgtaaggaactgaggaaaggtacaggcttttaatgtgtatcagtaaactagactcttatacagtttttataatattagagatgttttaagcttccttgagtaaatatgtgataaaggggggatcttgagtttttataattcttaatatgtttatttggaatccattgaccaagtgtatgtagtatccatatttaagatctggattaaaagtgattagtttctgtggctgatacgatttagaattaagatcttttgagactaaactacttctagatacagaagaacgtcatgaaagccgtactttcttggccatttatttgtgttaggctttaattttttgccataaccctctaaaatatgtgatgttatcttcattttataaataaggaaatacagggtcagagaacctaaataacgtgccaggatcagatctgggtagatataaaagtatttttcaagatattactgagtggatttttcccaattagatgaacctccttattaccaggaaccaaaatttcaaaagctaaacattaacacttacgattcatagattcctagagttaagcaagtccatgttagtttatgtaaagtcttccaatgcaagactaatgttttcttctaaaacattcagaaaagatttaagaaattaagttcattttctcattcccaaagtttcagaagttaacaaagctaaacattttatgtcttcaagtaccattgtttaggttaaggaatggaatccatgttaattctcaagtggttgatatccttaatgaaggatctagggaaatgtttctgaacagatgtaatcagtagagccacattgaagggccccgtggtggacatggtgataaaactaacctttgaaagaaaggacagtttgagtccctgttctcctatttcgtagccaggtgttcctgggtaagctacttgatttcttaaacctgtttttttttatgtcaagtggaaatacttttgtcgtaaggttatcttgaagatttaatgaaataattatataaagcatttgagatcttttctaccatgaagaaagtgccaaataaatggtagctgttattattgagtatatgaaatcttgagatacttaggggtatagagacttgcttagtatgagagggttgtctttcagtatagcttttgcagtgtgcctggaagccaaactagagattgagtagagaatttagaagacattgtaaactctgtgagtttagagagcttgcatttgaatagactaaaagttatagaagaaagagaaagttgagtatgagtagctttatttggctctgcaaagctggcaagatgtcaagggtttggagttaatgattaggtgggagtagatggttaaattgcggataaagagtaacagtaataaagcaaaggtgaatgttcaggctagaatgatcagtcagtaaggaaggacaagggttggtattttgaagaggagttacagtttatggttagaaatgagcaggaagatatcattgctacaggaaaggatgcaaaagagtaaggaaactaaatcattctgattaactcagttattaccattttttaaaaatggagtctttataaaaggcgttaaggctttatatgtgagttctaggttaagtctgaaaaattgtcttggaatagtgtgggtcttactactgcagacccaaaccaagatattagcattccaactggtctctttcctgctagcatcttgtactgcatctcctccctgattctataaaccatcaaaattctttctaaactatggtttttcattatatcatttctctcagtatacttcagtgactcccatttacctctggaataaagttcagaattcttggtttggcttttgacactttccatgattggacctcaagacattagtctgttataaccaaactagtacacttgctatctctggaacacgctcttttctctccatggatctttgctcatgctagtgtgcagtctggaatttgtgtctttccttctccagctttggttttctcttttagcaaagctcatttctaatatttcttcttccacaaagtcatctctgacccccagagtgtttaatctctcctttctctgtacttaaagcaatgtctgtgtattatttctatcatatgttttttttttttttgttttgttttgtttttgagacagagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctatcatatgttttacctttagatatttgtgtctaaattataattgcattcagttaattctaaagggaaaaataaatttttactttacacaaaggctagcggctagcacagtgctttatggatagtagacattcagatatttggtaagtattaagcaaaatctacctggagtgaaagtgattgttgtaggaggaggtagtagaagtagttacaagctttatcgtagcagacgtttctgactctcttcctgaatgttattttttctgaacctggatatttaagtgtgaagattatacaaatctgaagtgtggcagtgttcttatattgatgtagaagactaggttgactgatcctggacctacaagcttcattttaacttcctacattttggctttgagggttaacaggacatttataatcacatatctcttttcagagtattttacatttgcaaatattatcatgaactttgtgtccttttaaccagagaggaattgtggaatcacaggaattagatgatgtgttaaagaagagagataactatcagctgatttaatttgaacccaacaagtatctaataatatgcatactctgtgttcaaataaacctctaagctagactttcaagcttatcaaaatgctagactattttcagtgtttagaaaataccagccaggtgtggtggcttatgcctgtaatcccagcactttgggaggctgaggcaggtgaatcacaaggtcaggagatggagaccatcctggccaacatggtgaaactttgtctctactaaaatacaaaaaattagccaggcgtggtggcacgggcatggtggccacccgcctgtagtcccagctacccaggaggctgagcaggggaattgcttgaacccgggaggcacaggttgcagtgagccaagattgcatcactgcattctagcctggcaacagagcaagacatcgtctaaaaaaaaagaagaagaaaaaagaaaatacatagtaaaatttattggctttttaaatggataatttcatatagtcagtcagtgccggcttagatccatttgttagagaacaatgctaatgagacctcttgatactttgtgttcctcttatgttttcctagccttgacgttagcaactaacaatgataactaacattattgagctcttatgtgccagggactattacaatagattttcaattattatctcattaaatcttcatagcagccctatgagctagatactgttactacctatatcttaacagatgaggaaatttgaaacagagcagttatttgccaagagtttcagagctattaacagaagcctaatacatgttcttggactttgcagaaataatttgttgatccatgcggtttcattgctactgcggaaagtaagtctcttggccattgtgatgggtcaaaatctttgtacatgaagggtatgactgttgttccattgtatccagagagtgaatcttgtgattgagttgggatttgaggtggcagtgtatactaagtttgaaaagtatattatcatatgttagctccctttagaaattttccccaagaagagctattacattttttaatattaaaaaagcataagatatggccataatacaattagttccacaagccatacacacttttttcttatggcttaaaattttattcatgtttactactttgcaacccactgatataaattatttcacagatcctttattcaaatgaaattctcagtgagtctgagaagatagtcttaaacacaagctagctgagtttacaatagagattatactataaatggtaacttcaatgtttattgaaaataaattccttaaaaacaggtcttgtttcattcatttaaagagattatcaatatatgactgttaaatttttatagtctccctgttcattttctgatgaacacatgacagaaaattgaatgtgagctggaaatacagcagactatgagaaagcatgggtcatgtataatcactttaaatttaggctggtgttttgtattcatctataatatgaccacctcagggagggatgtaagtaaacattctttttttagttatactttaggtggcttaattattttaaagaatatgttattcaagaattgtctattgtactgttttaaagaataagaatataattcattaccaactttgaatgtcttggattcttagtactacctttttctttatcatgactagtaggatcacatcataatttggtactgtgtgtataaagatgaagtgtgcttacctttattaccaaaattcagaaatgaaaatgtgaatgataaaagataagggatggctatatatttttttgtttttgtttttccaaacagaatctcataacttaccaggctttagaaaaacatctttgcagtatgccatcatacctcagaatgttaagtagataggaaataaaattttcactttttgtaaagcagtagggtattatcctttctgacagcctgtaagactgttttggttgccaaggggccaatcttagaagtggcagtttttgttttgtgaccaacccacagcttaccctttgttagtccatatctgtcatcttcattttctctttctgcgtaaatgcttcttgatacagtaagcaggtgtttcaactagtcagccatctagtgtgatcttttctggtttgctacagtcagtaaaataagtagctctataagtgtaaatagtattacttgttttatgtagtaaaactccaagattaagttagagatatttttggctagactacattgaatgcattgacaatggatttcccagctcccagaaattcgtttgtgtctgaattactttatacttggcttattgtgtagagaaaactttagaaaaagttcatccatccatgaatgttgaatgaatgagcagattaataaataaatagctcagggaaagaaaatgtgtgggcttttagtcataactatgttttttctcttttgttcccttccttatgtgccatttttcaataatgggagtgtgtatctaatgatgttgataaactttttaaagtcattgatgaacagtaatctgaaaatcaagttttgattaagccgtagatttcttttagggtccaatattttctttttagaaatccactatgatatttttgtagggataaaagacaaccatgtattctatagatggaaaatggtaggatacagtttgttggccggccaacttctctgaaaatactttttcctgcatagaagataatcagtgttgacaagggagaagccaaggtataatggctgttattcatctgtctcatgtattcgtcaagtgtcatgtgttaaatatgaacaaaaaagacataatctctttcctcctggatcttaaaatctaaagtgagagataattcaccagataaatgctgcgataagggaaatagaggattctatgagcttatgactaaggatagatctgtttcctcagatgtggaactaagaagtggcagtagttgagaagttcattttgggccatgcgatttgaggtgtggctattcaagtataggaggtaggtggttacacattttttaagctattaaatagaactttcacttgaaaaggtttttttctctctttcctcagcatctatctccctacatacacaaaaaaattgcatgtcacaattcatgaactcagtgagtgactctattttgaaaaatgttagattatatcaactgaagtctgttagaggcaaatgcttttggtcatttttttcagcagggacatttcatatgtgtaaaatatttagaatccccatgtatttatatataaatgaatcttttaccatcttaaatgtttaataagttatatttttcctttctttcaacttaagtatacaaggttatcagcaaacatttgtagatgctctatgtgaggtgttttgtttattagttttaaggaagagaaaaaaggatggattggatcaggaagtcagttattgttttctgggttagtttgagtccaaatcctcaaatatgcggcgatttataagtagcaaactaggaatttaatccacttcagttttggataacttggataagacactttctgtctatagatctgtctatagataacttggataagacaagttatccaaaactgataaatctgaattagttaacagatgaggcaaattgagattgtaaatgctaaaagattattagaaaactttataaactaaatagttctatgccatgtctttttagtattttgcttgtactataattgtagtgaaaataggtcagtatctaatttttatagtcactagagctctccaactaaatttagcttagatgtttttctagcaattatatacttacaaagtttacttttaaaaattgtgtaatacatgcctttatagaaatttaagaaaacgacttatggattatgtacttcagatcacagcacaactagaagatgttgatacattacataaaaaatcaggaaacctatgaagaacatcaaaagtggcaaggtgtgttcacttgcactttgtgagattgaaactgctgccattatctgtgcaaactatggtttgagtacttttaatttagcaaagactaattattttttaaaaattttggggtaaaaaaaatggtctttagcgtagaagagctttacccgacttactttagttggttcaattggttgattttggtttgctttttgaaattttgtattgtcttaatttggggcacattgaactcaataacagttcagttgcattataattcatttgggtaaagtttattgttggaggagggtaagtaaatatttaactgaaaaagtgaagtaaatatttatttaaggctataagttgaaatatttgtcagctgagaaattttcaggtaacttttttaacctttgaaaaaaatttactatagcatgagtattttttatactgctatgtataatccatagtcacgttttttaacctttttatataaaatactgatacagaaaaccatacaatcatagtaatcttttaaaattgctttataattcacatagcgtaacattcacccatttaaagtttacagttcagtagtctttagtatattcagacttatgcaacgattaacacaatttaattttagaacattttcatcacctccaaaagataccctgtactcattagcagtcactccccattcaccagtctcccagcccttatcaaccattaatccattttctgtctatagatttgtctagtttaggtattttatataaatggaatacaggtaactttttattagtgatttttcacttacatgtgtcttgcatgtctcatgagatagctatgaataagttagccttcttttacaacttaaataacaattcttgtctgaccgggaaaaagtattaagttattgagagactgcatcccaatttaaaccaagaaccagactccttactagtattataactcaaaagaatgtgtaccattagcccttacctctggtggtgcttttcactgtgaattgttcagcagcctctcaacttcccgaaaataccacttaagtcttaaactcagacttgcatgagtttactgagatatgtttacctttgcagctggcttgcctagagtctaccttcttactaccctactaagtccagaatgaggaagaattaaaagcaagaaaggagatacagaagaagagattgctcaggctgaggaggggcaaagtgataagagcaggattagaaagagacattaaaaattcaaggatactgagtttgttggcatcagaataaatcttggaggctgttttaagagggaataaaacctagagggaaggaataaaaggcaaagatgttataaaacataggtaaaatatttaaaatattttgtcctgaattttgaattttaggcatatgtcagtgaagcacaaaggatagcccccttttttgatgagctttagtatccttaagatattttctttctagaaccttgtgtaggaattttacagctgaccataatcatgtgttctctttggtttgttccaacatctttggattggaaccagtacagagtaggaaacccatatcaccttgggattatttttcagataaatcttccagaggattaaatggcaccatccccgtcaggtccaagtaggaggggaagaatcctattttgggtgctgtcagattcagtgggctgtttagttcactttttatccagaaaatggagctaaatgagaaattgcagcttccaaagaaaatcataccttgattttatagatcaaagcctttctgattagatcagaattgttcctgagattttaggggcattcagttaaagtgccccaagaagagtgataaatcacatataggtgtaaagtcaataaagtcctatagtaagcagactggaatttagggggaggggaatacacactgttagactgttggtacctatatttgactactaggatgattatatattttaaattctgtattcagtttcttatcagaaatactgcctacaatatcttatacttaattttttaaggaacaggtgataaagataggttatattttcttcagaataattgatattcattatttaatagataaaatgtgttatctgaatgtttatagtagtagaaaccaagtttacaaaatgtctatatataatttgtttttaataaccaaggattctttctttacaaaagatttcctctatataaatcttcctgttttatagatgatctgtattataggagaaatgagtatttgttgatttaactggctaatctacaggactgagcattattagaggagtatttaaacatagaagtctgtgaaaatatttttagtgctgagggaaattggagggactttctagaaccgcaaactaatagaaaaccaggcatagtggctcaagcctgtaatcccagcattttgggaagccgaggcgggaggattgctgaagccctggagtttgagaccagccagggcaacacagtgataccttgtctctacaaaaaaatttttaaaattagctggacgtggtggcacatctatactcccagctacttgggaggctgagacgagaggatcacctgagcccaggagctccacgctatagtttgagttgtgatcgtgccattgcactatagcctgggtgacagagcaacaccctacctcaaacaaacaaacaacaaaaaaacccttctacctctgaacatgtggggatttaaagattgctatgatttaaatataaatcatgaatatagaaaatatgagaacagaagagtatttgttaaacaagactaagctgtgctgcataaagtaaggcactatcattgtgctggtattttctgattctcttagtgcaataaatgttaaactttactactaccttagccatgttgcagggaattgacatgaatagttcctgggttttggctgggtgcggtggctcacgcctgtaatcctagcactttgggaggcttaggtgggcagatcaggagttcaagaccagcccggccaacatggcgaaaccctatctctaataaaaaacttaaaaattagccgaacgtggtggtgcacgcctgtagtcccatctactcaggaggccgaggcaggagaattgcttgaacctgggaggtggaggttgcagtaagccaagatggcaccactgctcctagcctgggtgacagagggagactccgtctcaaaaaaaaaagttcctgggcttcaagggcactctaatgtgcacatcttaaattcttagagcctacttctatggacgatttatgttactgttgatggagaatttgattttcttttttatcttcccctttcccttggcctttgtaggttttttgaagtgaacatacttttatgtatttacttatttattgagcagttcccaaatggcaactttattattttatttcttcaactcagttgtctagtttacttcatttgtatctaatctatttaactcatcctttgagtttttaatatcaacattttaaattttatttttttagcttcaaaggtgtgcatatgcttgttacatggatatagcatgtataatggtggaggttgggcttctagtgtacccatcacccaaatactgaaggttggacccaataggtagtttttcaaccctcaccctctcccacccaattgtttttatttctgaaagtaatatttctttcttggtctgcctgataatttttttatagtttcttatttttcgttagttttcaaaaaataccttgttgggcattttgtccatagatgtactatcttatgtttgctaattccaatatcggaagtccttaggaagttgtacttaaggtagtttgtttctttctgtatttggtgattttttttatgagctaatatttgattaaaccgaatatttctccatcctctgtatagttgcctacaatgtaatttctacttttttttttttagcataaaagagtttcattttcctttttatactcaataacttgtttaattagccagtatttttaccagtttctttacttattgttccttgcatcttctctgagtccacttttcttcttgctgaagtacatcctttagtaatccttttagtaagaggctggcttgtaaatgtccttagtttttgtgtgaaagtatattttatgcattactttgtttttcagctagatagggaattcttggttgataggtttcctcccatcagcaacctcagtatattatttcattgtcttgtgaaacttggcaaacttggatctctgagaagttcgatctctgcctaattgttatgcttctgtatgtaattttttttttctggtagttttttaaaagatttcttttctttattctgtcaccactacttactgtgtgaccttgggcaagttcaaaatggatataaaattgtatctgtgtcatagggttgtaatgaggattaagttttaaagcacttagaacagagccttgcatattataactgtgacatgttaatatttgttttattttgccatacttgatattctaaacacatttctatgatatgcttaagtatgttgttttatccatagctcctctttgaaatacattgttgatgggaagattcatatctttctttgtttctagaaaattccttagccttcatatctttgaatattcattttccaatattccttcttagtctctgtattatgttctaggtggttcctcagtatcattttctaatttactaattcacactttgactttgtccagctagagtttatgtggcctcagttccagtgaattttttttaaatattcaggctgtctctctaatagccacctattctggtttgatttctgcctatttttaatttttcttcctttaatgactattgtggcttccttttaacatttgaaattattttcagattgtcattttttcttctagaatgaattacagttgttgattttattggctgtccatcttagtttagttttctttgtgtgttttgagtttgcttttgcagtctcctattgactggaagtttttgttgtgttttctttttcactcttcttatccagtgtttttacatgcacctacatctctgtctaaaaccacatctttatattggaggcttgattcccttgattcttggtaacatcaggatcaggcttctctttccaagaataagacacaaactaagatctatatttcttctcactggacacataatttcatctaaaccgtagccccatgcaatggttagtagtagctttttctggctcctttcattggttggaagagcctctccaccctaggtattggtttcaagcagtgagcctgagttctatcccagccatgcatgggtacctttttagtccctgttactatccctacaggatgtggacttttggccatctctgttacttgagcccagaaggctcacagttttagcttcaaaaactgctttgtatttaaagagttcagtggcttggtcttttttaatattttgtttgtatagttaataaatatttaacatacattaaaatgtttggaacagatacatttcaaaagtgaatatacaaatccatttggttggaagttagtccattttgtgttgctatcacagaatatcacagactgggtaatttattaataatagaagtttatatagctcttggttctgagggtggtaagtctaagattgaggggctgcgtctggtgagggccttcttgccagatggaaggcaggaatgcaagagagcacaagtgcaaacaagggcaagacggggccagactcgattttaccaggaactcactcctaagataagggcattactcaattcatgagggcagagccttcatcacccagttactttttatggactcactggttattactgtcacaatgacaattcaatttcaacatgagttttggaggtgacattcaaatcatagcagaagtcaatgtttaaaatcaatgtatatcctacatacccttcagaaagatactagttgactctcctacttatgagaggtatatttttttattcctttgccaatattgggtgtaataattttttaatctttgagaaggtaatgtataaaaaacaaatttgtgtttaatagctagcaggattggtcattgctccatatatttattacccatttatattcttttatttatttaattgcctgttcacattcattgcccatttcttttcctttaaggtgttcatttttattgtcttttaaaatagctgtttgtatattgtagtaatgttaacttttgtgtatatattgcagatgcttaaaagacgtttgcttttcaggttaatgagctttattttatagtgtaggagtttcttttctctggagtcactttttcttattcctttggaatcagtcttttcttgtcatccttagaaagtcctttcctaccataagattacagaaatatttgcatacatctactggtattgttttattattaatacttcagacttcaatctttaatctcttggtatttattttaaggtgtgatgttgaagggattcagctacccaccactggagggcaggagtggaaaagatcagctttcaggcacccattattgaatctctctgttcccagagagctctttctggattctcagttctattccactgataaatttattcctgcattagtattgcctcttaaatactataatttggaatcaagtttaaatatcaggtattgcagattctcatgattttaagaatgttttggctattcacatttattcatatatattttgaaatgatttaatcaaggtctgggaacaaaaaggtccagttgtgattatattgaatttatagattaaataaagggaggataaccatcttcacaattttgaatcttcctatccaagaaaaagaagtgtgtgttattctgaagccctcttcttaaaaaggttctatttcttgttatttatttagatatacttttatttctgttttaactttctaagtgattactgttaatcattttcatatatggttttctatagtcaaataatcttattgagtatttttttccctatcatttcaggttttgagtttgccatcatgtcattaactgcaaatagttgatctccttataattttatgcctctttttgttagccttggcttatctcaataaccattatttctacacattgctgagttacagggataagagttggtgtccttgttcttttttctttcctgggaattgttctagtactgagatttcctctttggcttgaagtaagtattatattaaggaataaattttatcaaatccctttcagaatatgatgagatgatcatatggattgtttttaacttttaaaaagatgacttacattagtcagctgcctaatgttggctcattgttacgttcctaaaatgatccctatttggtgatttgtaatatatattttactgactttttggcatctgtattaataagtatgtttggactatagttttatttttttagtgctgtctttgtcaaattttatagaaggattatgataggtttgtaaaaagaattggaaatttttttcctgtaatctatagataacttaggtaatttgagagttacatgtttccttagggcttgaaggatcttgttttgaaatagtcttgcctgatgcacttttatttttaatagcttattttgagaacaatccaaatttaaaatttgcaaaaataatacagtgaacttccatatttatttaaatggccaattgttaacatttttccacattagttttacagacttttttccctgtgtatgtgcatatatgtattcatattctcttggcatgcacacacacattttgttattttttagttttgctgaaccatttaagactcagtatggacatcatgaacctttactcttaaatatttaaatgtgtgtcccctaagaacaaggactatcactttctcttacataaccatagttcaattatcaaatttaggaaatttaacattcatacaatactattatctaatatacaatccatagtcagattttatcagttgtcccagtaatgtcctttataacaatcttcccctccccattccttcaccctttgccttcatccaagccagtccataatcacatattacagtttgttgtgacctccttggtctcctttaacctggagtggttctttagtctttttgcattttgtttttcatgagctctgaagttttttgagggatagttctttaataactttctcatattgttccaggtttctggtcttcactctagcactaattgaaaaaaaaaaaatttgttttccgagaactgttactttcctccatattttcaaatttattaacagagaattgtacagagtgatttattttacaacaataaaattctatttgtgaggtgagtatagcctgtttggcttctaattttaaataatttttttagttagactatttagtggcttacctattttatttttttcacatataacatgtactataattttacgtaatatattccttcagcttttattttattttgtatgtgtgtgtggttcatttttctttttaggttgaatatttagtatactgattttctttagtatactggtttttttaactaagtgtgaatttttttttttctattttcaacacactattgctggcttaaaggtgaggtttcttaataaggtttggtcacatctcagaatttgataggagatttttctcattattgtttctaaatattctataattgtagaaatatgtaaactcaatgcaaaaaactggtgtaggagcttactttttaagcaatttccacgtttgaggttttcttctttctttacacattatcaatatctactattaatgtataattcagatgtgtcatttcattatttcattttcttttttttttttttggtctgtggggtaggatgggggagtgtgttagaaatctataagcttttctttccaacatataatccaataattatttgatttttcaattaatgttttaagtgtgtttgaacagaatatatagtcttgaaattttggaccacatcttttaccaatttaaaacatggctcttattctgtttattgctttattccttgtgatttactttgtctgaaattgaaattgcaattcttggtatcttttttgcctagtgtatttcgaccacaacaaagtacttttatactgacatctttatttttgagtttcttggttttgattagtctcttgattgcatgaatctatctttaaatagtttattttttcagaaatgaaacatggataacactactttagtgctggcatatttgatcatgtcttcttcatgtcttcttattgcgtttacatataaatgacaaccttgctggtcgtagtattcttggaataaaacctctttatcctcaacgtttataggcattacttcgttgcctatcatctgatgttgcaaagaagtctgggaccagcctgatttcttttttctttttcttttttggcatgtttattttattttttttatttgagacagtcttgctctgtcacccaggctggagtgcaatggtgcgatctaggctcactgcagcctccgcctcctgggttcaagtgattctcctacctcaacctcccgagtagctgggattacaggcgtgcgttattatgcccggctaatttttatatttttagtagagatggggttttgtcatgttggccaggctgatctcaaactcctgacctcaggtgatcctcctgccttggcctcccaaagtgctgggattataggcgtgagccatcgtgcccagccgatggcatgtttattttgtctgaattgtattcttaaaatttgtaatcttcaaattatgcttcggtattggtcagtttctactaaatgtatctagtacttgataaacgccattcaatcaccaagttcagtctttagtttatgatttatttcttctgcctttgaaatttaatttttcttccattatttggttttcttatttacaatgtgctaattgagctgttggatctgcattgtttgtatcttttctcaagtctacttgtttttgtttctttatgcttacttgcatactggatgatttttgtcctgttcgtttttaccccttgcagattgtttgctgtagtgtcttcattcctcattattgcttttcatgacatttaaaatattgcaatgatattttttctctgaaatatctttttttaaaagctctgttgatactttttatattctggtttcttttcatccctgtttcacaaattaggttttttaaaattttcttatatgtaagttgtcacctagttttctaaggtaaatcttttagactgtgacatcatgttcttgagtacttttttagttacttttttatttcagaatttttgtatgggttctataaatttttttctgcttttttacttaaagggtggcagttttctctgttgtttgcccaaaaataactagctactccttgcctgttctgtcattatactaggataccattacctctttcccccttggaatttaacaggctgaattatattaaattattttagttatcatatttcattatttttgagagaaatgatagggattttgtcctattaacctgttacaggtaagaaactttgtctttcttgatttttctcgatgcttgttgaaattactgattattttagttatcatatttcattatttttgagagaaatgatagggattttgtcctattaacctgttacaggtaagaaactttgtctttcttgatttgtctcttgatgcttgttgaaattactgcacattttcatctttacaagtttggcagattttctttcccaacagaagaacttgactattgggcattctgctaatttccatggctgctataacaaattatcacgaacttggtggcttaaaacaatacagatttattctcacagttctggaggccacaagttcaatatcattttcacggggacaaaatcacggtgtcaccaagaatgtgctcactcccgaggctttaaggaggaatctgtttcttgctttttttcaccttccagtggctgtcagcctcatcacttgcctggtagccacatcactcgaatctttaagaccagcgtcttcaaatctgtgtctgctctgtcttcacatcaccttctctgtgtgtgtcagatcttcccctgactctctattctaaggacatgtgggttcacttagaggtctctggataatccaggatcctctctccatctcaagattcttaatcacatctgcaaagacctttttttccaaataaggtaacatttataggattaggactggtatctttgggagtcattattcagcctactaggtatcattttgttttgctactttagagtgaggcagacatattagtcaaaaattggattagagtaaagcctcatagattgtgctgtttgttagaatcacagatactgtcctctttaccgaatgatgcaaactctgatgccatggtggaaaagtatatgaattgaattggatgtggtcaataaggattgctagggactcgagaatgcatgttgttctagggagaggaaatacgtgaaggtcaaattcaggttatcaggttatcagtttgtaacctagtttgtagctgcttttttcttttcatttcttacaagctggtcttgctgtagtaaaataattttgtgtgtctcttataatcttgatattgagaataagaggttttttttttaatgggaattccatccacatgattttaaagtattactttactaatgatatttacctaggtattcctagaactttagtcttctcatgtaacattttatacatttctcagaacaaggtaattgacaaataatcaaggttgcttatttattgatgaggaaagttagacattaagccaaaggacttgtccagtatcgcatattggatagacctataatttttaactttaatcttgtggtgacaggtatttccatttttttttttttttgatgtttcatatgtgctttgatgttgatgtgtcatgtgacatgaagtgtctccctattgttggataattgggcaagtctaagttctttttactttatattcctgattttgtttttctagatgtgttatttttacagattcaggttacttctttttttaaatcatgttattagagttaaactaatgaaaaatcatatagagatgaacttggttttgaaatataatgagtagatacttgcttggctggaattttttctcacaagttttttataaagatggtatgagtgtatactttgtatccaggaatgtgtgtacactagggggagtgttggggggatgagggtggaagacattttaagacacacaggaggctggtgtggtggctcatgcctgtaatttcagcactttgagaggccaaggcaggggaatcacttgaggtcaggagtttgagaccagcgtagccaacatgatgaatccccatctctactaaaaataacaaaaaattaactgggcgtggtggcacatgcctgtaatcccaggtacttgggaggctgaggcacagaatcacttgaagccgggagccaagatcatgccgccacatcccagcctgggcgacagagtgagactctgtctcaaaaaaaaaaaaaaaaaaaaaaaaagacacagaagaccctaagtgtacactcagatgctctttatatccatatccattatcagtttggtgatacgttattctagtttcatgaacctttactcttagaacttggtttattctctaatatcttttggattcagttttgcagttgagatggctaatatcaatttgatactctttccttttatgattgctcatgtttttgtctagaaccttgcattatagtatttttttttcttttccttgcatttctatagttgtgaacaactaggagtgggtttttagcaattaattcagtgagcttgttaattttgaaaaggcttcaactgaggaacactttcttctcatttctttgatgatagcttctctgtttctccttcagaaagtcttgttttttatatgcatatttactttttgggtgcactctccttgttaatgagttatttgcatctgattttgagtttattcagcaaatatttattaatgatttactgtatactctgtgcttggggagttgacctagggaactcaaaggaggctcctttgaagaattgatgcttgagctgagatctcaggaatgagtaggaattatctaagacatgagagaacagctgttaaggtagggaaagtagcatttgtttatatatttggaggaaggaagtatgatgagtactaggtactgtaagaaaacccttgtggttggagtagagaatgtaggagaagggacagtatgaagtgagatgcggctagagaaggtacgtaggggcttgacttcccagggccttcatgtgagccatattaagcagttatttatccacctcctacccccagcagtggaaagccattgagaaacttttagtacagaagtgatatggtgaaatttgtattttgaaagatttacttaggctgcagtttggagaatgaattagagggatgccaggatccacgtgaagagactaaagacgctagtattctgcagtgagaatgatggtaacttgagaccagggcattggtagaaaaaagtggacagatttgagaatgcttaggaagcatataacccatgggatttgatgatggactgatgggagatgaggtagagagaggtatcaaagatatccttagtttctgtttctttttctgagttggggtcttgctatattgcctaggctggtcttgaactcctggattcaagcaatcttaccgccccagcctccaagcagttgggactacaagtatgcaacaccgcacccagtgaatgttcttggtttgtattcaccttggtgggtgatggtgccattcactggtaaaagctgcagatatgtgagggtgctcagggaggcagcatagaatgggaaaagggcctacatgtaacccttgaggaatgccaatgtttaatggcttgggagatgaaaatgagcctgcaaaggagacgacggaaaagcttaggggtaggaagaaagctgggagtgtgtgtgtagcatcttgaaaggccaatgggaagagtgtttctggagggagtgttatagttgaatgcttctgtgagcagtcaattagaggagggctaaaaatgtcccttagattaagtgacttggaggaacttgatttagtaaaatggccagacagccttttggagcatcaacattttttttaagaagtttaactgtaaagagaagagaggcacatgggtagctcgaggggaataagtcacatgaaaagttatttttaatgggtaacatgggtgacacttgtggctttaaaagtcacactccaactgagaaatgttgataaaaaggagaaaaaggaaaatagtgtaacattcctgaaaaaactgtcatttaagactcctttgaaacatgggcaccaaagctagtctagtagaggatttattatcagtgagaggacagagtcctattacagcagaaaagtaggaggggagggttatgaaagaattcattgaaatggttcactcatttattgatcttttttttctgtagtatccaatctgccattcattgtctctattgcaattttcagttcagtaaattgcttctcatttccatgaaactattttcagagtacctcttttttaattgacagtctgcaattgttttattcattcaatgtcatttcatatcttggttagtttctaattttgagctaatgaatactgagtctccctcttttcaacttctgaattaaaaaaaaagtcatcttatttttctctgttcatttttacactttatttagcctaagtatctgaaattggctttgctagaaattacaattagttcactgttgttttctttcagtcccagacaaaaaagaaaaattttagatttctttcttttctcttcttccttttttttttttttaaggtcatttatctttggcagttttagagatttagaaaagaaaatatatagacttgtaggcagaagaagatatggcactgagggaagttttagttttgttctgtgacagtcttccttatcttgtatgttgtctttaaaaagcctacacatttagattttcattacctcatttgcaaggatacaggatagcacatgtaggagaattggagtgtaagtccagaaacctaagtcttattcttagccttactgatgaaccagctttgtaaccttgggcaagttattctgtttctctgcaccttctcatttgtaaaataggtttacacaaatcatttctgcattttggctctgattcattatgcaagttatcaaaatcaaatttgtaactataaatgagtaatattttattatttttatttttttagagacagagtcttactctattgcccaggctggagtgcagtggcaccattataggtcactgcagcttcaaattcgtgggcccaagcagtcctccttcctcagcctcctgagtagctaggactacaggcatgcaccactatgccccgctaatcatttttacagagtcacgctattttgcccaggctggtcttgaactgccctcaagtggtcctcccacctcagtctcccaaagcactgggattacaggcatgtgccaccatgtgtggctctaatcatttttaaagcaacaatcagtgggaaatttcagctccaaatgggagaaaaatttccaaagattagccttttttttttttttttttttacagatttgctacagttttgttaatgtgcttatttctcattaccatagataactttgagatggctgccttggattacaaactagaatttattactatttcacatagcttgggaaattaagtgtagtttgtgtagcctaaattatcctttatagagatgtagctgcaagggttagcatttcttctttgaaccccaggtatgcagtatattgcttaatactctattgttccataaatatgcattccagaagtcagctgaccatttgtccttatctttgaggacaaagcccgtacatatgtaagcattagtgagcaatgtagaatataaagatttggtagcagtagagagtttacgctctacatcccactgcaagtaatttgaatattgccatattatccactgtgacctgtgctgtttgttaacgttccttttccccaccttccccgaggagcttgtagtctctcactatatatttttttctctttggatttcccttcagcctttagatttcttatctctaatgcaagtctactctagatttttctcccaaatgtttaaaaccaaacctattatctcagtggtcatcaaaggtcctctagttaccagtatccacccttcttggaatgcctgtttagcaatgttcttttgttatatgagtaagaataactctggtatttgctaagagaatataattttctccacattgtatgtatctatgtcctttgtttataaagcctggggggcgttccctattaggttaagtgtccctacgtaaatagaaaaatatgtagggttttattactcaactttttaaggtttctgctcaaattgtcagttgaataactcttgttactttggggctaacatgttgcatagggattttaacaataaaatatatagagcattttaaaaattattcactataattctgagtggattaaaccaaatgaccgggttcaagactctactatgagttcacctttgcttaataaaaggcaagactgaacattaattaatgacttcttggcccagccttagaatttttcagtttagggattagtttggtttttaaaaggtacaaaatgttcatgaaattttctgattatatcaaatattaattcagtcttgttttttgtcatagtactttgttttgaaaagttcagatcaactgataatactagtgctgtgatgagactcagcttgtactcaagaacagatttatgactaggtgagaactaaaatttctctcagaaactaactaaaaactttcatggacaaattgaatccccttgggatttactatttatggatatacgccaatttaattattggactaaataaaatactctttattagtccacttatggaagatgactgtgtaaacatagtatttgcaagtaagtactttttggtattatatttatataatcagctcttgtatccatgtagcttatagttggctgcttcaccaggactctacaaattgctcagaacccaaggaggtaagatttttatattgcctgttttcagtatgtaaaagtccagccacaaaactattaatttacccttgactatatttttacagttgctgtggagctgaacctaaaattttgttagatggttacttggtttgttacatttttatatactaatttatatactataataatatactgtatatattttttaaagtctggggtttgtttttagaaagtatattctatcttcaaagaattatttggtagtttcatgtgtgtatctggaaaataactactgtacttctttataaaagtgagagtgaggtccctgctagttgaggctggaatctagacgtggctgtttatgtaggagttagtaattaaacagtgcctgtttgctgactgcctcatttttgccaggctctgtatgggtgccttgcaaggcattgcctcatttaaaccttgcagcagcattcagaggaaagtattaatatgcccactgtacagatgaggaagttgaggaatgctttattagtaggtgtgaagtgtcttaagcataatacctccctcctcaaccttgctccctcatcctagttaagggaattgagacacagagataaggcaatttgctattgaccttcagcagatgacttaacctcaccgtggcttagtttcttcatgagtaaaacagggtacctatcttttaggattggtgtgaagattaaagaagttaatacatatacaaaactttagaacagtgcttggctagtagtaatctctccataaatgttagatgttattattaagcctgtgactacctgttatctcatgtagttgttcagagataaaaatgtaggctataggaaagaataaggaggaaagccaggctcctaatctgtctaagatagaagtgaatcttagttaagttttaagataatcctatgtgcttttaaaagatttcatggtttgcggtttgcttttctttggctcccagtttctttttttttttttttgacttcttagtacaggtaacttttgaaggaattcagcttaccttagatgaaccaaaggaaagctaaaagccgagataatttagaaaaactaaagcagagattatgttcctaaattccctctttctgcttcaaagtccaggaaacaccacctgcagatacagttgtatcccattgttagaccctttcctgaagccatcctcttttctttgtcttcccagagagaaactagtcattcgacaaagattgaacttcttctgtgtgttaggctgtgctccaagtgctgggaagacaccagtgaataaaacaaaaagtccctgctctcatggagtttacagccactattctaaagtttgtctgtattctgcctgtccttgtttttatacttttagcaaatatgtgtatagaattgttttgcagccttgttcagcatattgtcttcttttgttttttaggaatatctgtttatgtaattagatctgtttttgataaattgtattctgttatttatccttcctaccttctaatgagcagttaggttatttccaacattgactattatggttctccaaaaagatcattgaatatgtcaccttggatggatggatgggagagtttcttcaagacagcatgtttcagactttttgttgtgaccacagtaagaattatgtgcacctcagcttagtaaatacaaatatacacttgggacaaaaacttcaagaaacagtatttacttacttttatcacctgggatgcactctattttgttctgttttgttttcttgagacgttgtttcgctcttgctgcccgggctagagtgcaatggcatgatcttggctcactgcaacctccacctcccaggttcaaacaattctcctgcctcagcctcctgagtagttgggattacaggcgccagccaccacacccggctaattttttgtattaatagagacagggtttcaccatgttggccagtctggtctcgaactcctgacctcaattaatccacccacctcagcctcccaaagtgctgagattacaggcgtgagccactgcgctcggcctattttatctttttcaaatgcagtttacacacaacccagctgattgggttgtgtgtaacccatactgattaaactgatttatcacccgtgttcattatttttaaaacgttgttttgagatctataattagaagtggaattgctgagtagttgcttaagtgtatcttcaacttcttcaactagctgttgccagttgcaattcagagtggttgaaccaatttaaactcctatcggcactctaggggagttcctgtttctccacattctgaccaactcttgatattgccagatggatgagaaatggcatttgttttaaatgtgccttcccctatttactaatgaagtgtttaaagtgtcttttaaaatatatcacatagaagtttaatttaatggtaatcagagctggcggcaaggaggaaatattattgtgattgactgcctcctctggcagaaaaaatggtgtaaaaattatataataatatctatattatattgagtatttataatttgctagacactatactttgtgcactgtatacattattttatttaatcgtcataagaatcttgtaaggttagtgccttcttatatacttttttttttgagacggagtctcgctctatcgcccaggctggagtgcagtgatgtgatctcagcttggctcagtgcaacctctgcctccaggttcaagccattcttctgcctcagcctcccaagtagccgggattacgggcatgcgccaccatgcctggctaatttttgtatttttagtagagacggggtttcaccatattggccaggctggtctagaactcctgacctcatgatccacccacctcggcctcctaaagtgctgggattacaggcgtgagccaccacacctggctgccttcttatatgcttatacaggaacagatggagaaagagattcggaaaggttcagtagtcacactattactaagtagtagagccagaatttaaacccacattggtctaatttcataacttattttctttagtacttcatgctattggtgaattcgtagaggaaggaagtttgtcattactattcttttctgttggtttgtctcttaaatgtgtttaattttttgagtttcactcacgtctctttttttctttccttttctcaaggtagtggagtctttcctctgtaaaacttcaccttgttgtttctagtctaggatagtggtcttgtaacctaggatagtggtcttggttactgcaattttggttgattatttcttgttggcccttaatgtgcccccatcttctgccttaggcattccatctaatcttttccagcagtttgcaaccttactgtgcctcagaatcacatatgaaaatttaaaaatcatagatacctaggttccaaccctaccctggaaattctgatttggaaatatttatttttcaaaaagtccacagataattctgttgcacagccatggtagagacccattttcttaggggttaatgatgctttagagtcacgcagacttgaatcagagccctgattcctttaaacttattagttgagtgatcttggccaagttctttaatcttggctaaggttcttcatctataaattggagataatattattatctaccttagagagttgttgaagagattaaatgaagtaatgcttgtaaaacacttaccagagggacttagaatacttcttaaacattgcctgctaataaggtgtcattattacgttatcctttatccaatcaaaatactcacctttgcagtgtgtatcaacttgatgtcagaaaaataatctgataaatatcaccataagggatggatgatagctagttttcattacttacctttcgttagttgaactgtactaggaggcagaggagtaggcagatggttttatcacgccaatcagccagtcttttctgcctatgtatcagtttggacctataaggaaaatgaaggggaaaacaaatgtttttctttccttcctaggaggattttcttcttgccctttttctcccagtttcctctctgagctgagtatcattagcatcatcaataccctagtttcagagctgcgtagtgatttacctagatacttttctccaccattattccctactacctaactcctcttcacctccattaaatctctgttcatcatgctatccttcttttggattgcctttagttcagttgtgacttacttgattacttgaacccaggtgtctacatttctaagctattgttcaagtaagggccaaggtaaattctaaccagctgtctctttgccttgtgtgggcccattctagaccagcgggtgttaacttttgagtattggaaaaggattagattagctgagccttcaggcttgtcagcagggctgtcactagaccctttgatcttctttatatacctaatggtcatagagtataataataatggtacatgttattactatatgattaatagattactagtagtaattttgttatatatgtatacagtacacttcgttatgtatatatataattgcttgcaacttgaaatttgaggctacaacatttacagtaatttaataacttaactgactttatcaaaaactgaaaaacctcatggaaaaggtagaatgtaaggtagacttaaaaggataggtatacttttttctataaataggatgaggcaagagtttccagttaaggaaactgacatgagcaaaggcttgaaggagcatgcaaatttggagcattgtgagtagattattttttagtttttcagagttcatgcagtgggaataaaactagggagtttggaatcaagcttgaaaattcctgaatgttcaaccaagatatatttgagttagtagattttttgggtatgtcatgaattcgtttggcttttcttaattgatatacatacaacttagtcctgagcttacacatgttcattgtatcattaaacatttagcctggttggtttaagttgatggccactgccaggtctcctttctgccttctcccctttatcccaatgctttagtttttttctgcctttttgtctgttgtgatctgtgcttcatcaggctttcccccagttcctccttgttaatctccagattccaagtcagcaacacaatgaatgtctgcttatcgcgagttgtgaattcccgcatatctctttcacttattaaaaagattgtttggtacatattttgtttataagacagttattgactttcctgtttctcttcctttgcagacctagaggatcaagacataatgggagcatttttagacaagccaaagatggaaaagcataatgcccaggggcagggtaatgggttgcgatatgggctaagcagcatgcaaggctggcgtgttgaaatggaggatgcacatacggctgtgatcggtttgccaagtggacttgaatcgtggtcattctttgctgtgtatgatgggcatgctggttctcaggttgccaaatactgctgtgagcatttgttagatcacatcaccaataaccaggattttaaagggtctgcaggagcaccttctgtggaaaatgtaaagaatggaatcagaacaggttttctggagattgatgaacacatgagagttatgtcagagaagaaacatggtgcagatagaagtgggtcaacagctgtaggtgtcttaatttctccccaacatacttatttcattaactgtggagactcaagaggtttactttgtaggaacaggaaagttcatttcttcacacaagatcacaaaccaagtaatccgctggagaaagaacgaattcagaatgcaggtggctctgtaatgattcagcgtgtgaatggctctctggctgtatcgagggcccttggggattttgattacaaatgtgtccatggaaaaggtcctactgagcagcttgtctcaccagagcctgaagtccatgatattgaaagatctgaagaagatgatcagttcattatccttgcatgtgatggtatctgggatgttatgggaaatgaagagctctgtgattttgtaagatccagacttgaagtcactgatgaccttgagaaagtttgcaatgaagtagtcgacacctgtttgtataaggtagctagactttttttaaaaacataaaatgattttatgccatattaatcactactctagtatttaatcatcttagaatctgtaattctgaaaccagtttttggcacaactgtaggatactgttcaccaattatgaaaatatatcataggaccactatgtagaaataaattacccaattaccatctctgcaagagttataagctgaatgtttagtcttactacttgagctttgtaataatgtggaagattatcaaaggtaaaaagattttatcagagtgcatgttttgaaagaaagagggtggggagggttaggcctcagtgtctataaatgaaaagcattttagagttttaatatttgaccatgtgatatctcagtacatttatgatatcctaatcctttgaaactaaggtttaatggtctgtagcacttgaaagaggaatgtagtgatcattagacgtgatgtaatagaaatagccttgtacatggagtcagaagaacttgctctgagactgtgtatggttttaggtaagctatttaaactctaatcagtttttttcatcataaaaaggataagacattattatcttgtctcatggcgttgtcaggaggatcaaatgggataatatacacaggtgagctagctcagcccctttattttacagatgaggaagctgaagccagagaaggttctacaaacttaagagtcagacagacctgagaccaaggcttacctctattagttttgtactctacattcctgaacgaattgttcaacctctctcagctttaaaatggagataatagtatcttataagactgttgccgggcgcggtggctcacgcctgtaatcccagcactttgggaggccgaggtgggcggatcacgaggtcaggagatcgagaccatcctggctaacacagtgaaaccccgtctctactaaaaaacacaaaaaattagccgggtgtggtggcgggcgcctgtagtcccagctacgcgggaggctgaggcaggagaatggcgtgaacccgggaggcggagcttgcagtgagccgagatcgcgccactgcactccagcctgggcgacagagcgagactccgtctcaaaaaaaaaaaaaaagactgttgaggaattaatgagcgtatgtatatatatatatatgtgtgtgtgtatatatatatatacatatatatatatataatgcctagtttagcatataatacatgctacaccctttcctacagatattataaatgacgtgtacagggttttatacattgctaacagcattaagactagaaaatcaaggcccttgacttgggttcagtgttctttctgccacactctgttctgttttgtcaataatgcttattaacttattctttgatgtttttttaaacaaatgttgactttttaaaattcttctgagggtatatatttgatactcaaatatttaattatagcatttgaatacttagatgtctttaaaaatgaatgtagttcctaaaagttgtcagtttttaaaattaatacaagttaaaagctggtttataaaccttaggtagttttacctcttatttcatatttctacttatgaagcgaatgtattagccccacaatttataatttattttaaaggtaattttatcaggtacatataactacaggtcaaatcctattgtaaacaatgccactaaaattttctgtcatgttgtatggaaggagtgtgtgtacacatgtatatttgtattaggtatcacttcaaattaagtcaccagtaaatgtttagaaatagtattgttttatagaattataaaaaattattattacagtgagattaacctgtaatgtttctctcctgtcttttggagtattggttatactgtattctctctatactgttcgggggagggggagtcattgcacacacacacgcacgcatgcgtgcacatatgtatttttttctccctgaaagtaacattttcactagaacaagtataactgtaattggcacagctgtaaaggttctcaaggctttgaagagcaaaaagaaaactaaaatattctcaaatttttttcttcccagggaagtcgagacaacatgagtgtgattttgatctgttttccaaatgcacccaaagtatcgccagaagcagtgaagaaggaggcagagttggacaagtacctggaatgcagagtagaaggtggatcatttaacaaaaaataagtagctttattaaagaaaaatcttcaacacaatcaaactttaacattttagcttttagatttttatgtgtctttgacagctagtgtctagtgtatgaaagtggaaaaggacatttctgtagtagctgttaagatgtatgcagttgtcctatcacagttatattagaaataacaactagtgtggaaagtaacccacattctgttcaggatacttttgttttaaaaggctaaaatgtttgtgtgctttaaaattcttaatgaattcactggcatgagtaattttatgccgggaaaatctgatttgtggtctatttaattacaaagagattgtgatggtgataatttgaataccatctttctatgaaaagctgtgtatattaattttaatctctagggccttttttcaataacttgaaaatcacagcctcatcattagcaactttatatacacagctttaaaaaatttgctttaaactgtttcagagcttcttccctaagccataaactgtctcacctaaacaagatagacctcaataaaagacataatatttctccacctggcagaaaagtaactgccaagtaagattaagaaataagttgagcatttctggagtatatttctcataattctgcagagacttccagtttattgcatatatgcagtaaagtgtatatattatgcagtttctctaagtggaaaaacttgacatgactttaatagtgttaaaacatgaaaatgctggtgagctgaggtagaaaaaaaacaagaaaaaaattttaaaaatagcgttaaaatgcattttaggctcctaatgtcgttaatttgcacgttaaagacctctaatcgcatgcaagcattgacctaccacacctacatcccactgtgcctgcattattgaaattactactcactttaattttttttcccctttttactgtttgataccaatcataatcagtctgatactagaatcatgattggttttgttctttagtactgtctagagctactattttgtttttattgctgtccgccacttgatagtcatacatctagtatgtgtttgtactatttagtattgcattcattggacgtactattcaacgaatttgtctccttactgttaccaagggtcttggaatttttatattttaaattaatcattcaatataagttatttataggtatagtacaattttaaaatatttagaatgctacaatcattggttcaaactattgattcatgggaaaatttaaattcataagaataatatgtatagggataagttgatatttaatgtattggcactttaacttgggcagacatgttttcttattggtttaaagaagtaataagtattttaatatttttactatgaaatgggatccaattttagaaatgaattgctacttttctctttagtgtgtacactttaagttttagatggaattatgaaatattcactttacgttattttgttacaataataagttttatatttcttattatcaagcaagagttgccacctggacagagtttacattgatactcaatatttttgatatgttaaagtgttattatacttgtaccattcaattggagattgtcataaattaaatatggtattttttactcagatttgatgagactgcaactagagaataaatattacattaaaattgctgctattttaaaacatagaatgtaactgtttgtattgtaaaagttgtgtgtcctcagtgaaaaatactgccttcagcttccaaagcaggcacctgaatgcctttttcttttctctctctcttctttctttaaatacatgccttcactagattgctgtgacctactaaacctcattttatttgcttggaacatttttggcttctctgtccacaccatagaaaaggacaaaggccttccagctctccttttctcttatttgttcccttctaaatacttgactctctgggggtgtgaaaagattcagctcataatttatactactattaattttgtggtccttctaagccaatttaaaattatacttttgtgtatatattttcaaaatctttgctactgactaccttagctttaaagttgctaatttggagatgactgatagaatccctgaaacttggtggaggggagtggaaaggagcagaatgtgtttgtgtatatgtatgtgaaacatggatcttctatatataaatattctttagaaaaagcgttcagtctttttacaattctaagtaaaacgtataggtcaacagaaattaaaggaatatttcttaaaattcatttatttttcttttttgaaagcagacagaagcaaggctagtatagtatgaatggtcaggtagtttaaatgcgttgtcccacgtggaacaggagatattaactgtttttaaagctttacattatttttttacaagaatttgttttcctgtaattttcttcacagttaaaatatcctaatttatattttaacaaaagagatgtaagatacatcaaatatagatgattcaaggtaatgttttttagacctgaaactattgattcaatttatcatcagtgtttatttctattgtatctagttatctatccaaataattgtattggcttagcggagactgtatgttaagtgtattagttttagattgtgaaattgtgcagtttaggtaaacatcaaatccctttatttttgtacagcagatttccagcattagaaccatgtagaacaaatatactagatgttaaagattacacaataaaggaacttggcaaaccaaatctgagatccttgctttttgttcagatttaagactgtttttttttttaaggcaaaaaataatagatggtaaaaatttggcctttattctaaaaggacagtttgaaccatttaaagaaatattatgggtagccatgtctttaaaaattttgaggcctgatcaaaggacgaatctttatacacattgttattttcaaaggtatttacaaattgagaagcagaatgatgatttcttgccccactaatgacaaataaaataccatttcttaccataaacattgaaaaacaaactgaacaaaacttgaccatataacttacaaatacttttgacttgaatttgcatgtggagtatgtgtgctaaaactgcaagtgaagactttttatacttagaggaatagttgtagagttctttgtaaggttctttgttcataattttttatattttgtgatgtgaataatagtatgcatctgcatgacaacactgcagatcatattgctgtgcccttttaataactggatattttaaaattattttaaatgcagttgtatggtttatcaaatggttctctttttaaacattttataaggaaatttagaccttttctattcaaggctttgttgaagtaatcagtgaaggaaatggtattatatatctatacagtatattgtttaaaggtactttagagaagaattaaactgagacagtgatgttcaagtacataatctgtgcatgctatttaagtatcattttgcaaatataaatatatacataaaaataattgagttagtatataatctataaattcccctataattaagggttgttattttcaaatcttgaaattgtttattttttaaaattccacgcagtgtattatatagggcaaagttcaggaaacatgtttccagtctaaagagaggagtgatgtaagaagaaactagttgacatcttaagaaagggtattctcacttgtgcacacatatccttgattatataatatgctgatttaacatgaaatattttttcacattttaattttgatttgaagttaatcttatatgtcattttgtgcattttttgtcataaatcttcaaaggtcaacctgattttttttttttttaaatgataccagattagaaaaatctcagatgtggtaaatgccatctttaaaaagctaggttatctttgtttcggttttcttttcaattaaatttggataacacttacaaaaaaagtacttctgattcccagaaatcataaagaagcagggggaaggcgtccccgacttagtccatgtgatgcgcacattagcgagtgagaacatccccagcctcccaccagggggtgaattggcaagcaagtaagttacattctgtacactcttatgctttatgtcagtgtatgaaaatgttaggtattcattgataaaatgtttgtttgcctaatttctgaactgatgcagttatctgtgttttaacctgtgatttcaatttttttttagtattagaatatctagagtttgtttagacataggtatcagtatcattgtaactaattgcagtgagggttgtctttattggaagcttggttggcattgatttcctcatagagcataaacgagataatatactgaaagaactttttaaactaaattacatagcactacataaaaatttacaaaattctaagtgtcgttgttagtagtagtataatttgatttggtcaatccctgagtaacttaacaccctgaaaattccccttcctcatatggaccatgtttctatgcctgattttcccagtatttttggttgttgattgctggttagttggttttaggtgtcagggaagaagatagaatatatttcttgtcttttccctttccactttagttcatagaattggactactttgtgttaaatattaagcttacacctttacataataaagtggaaaattcaagcaattccaagggttaaaacatttttacctcaaatatccatataattgacttacaaacataaaacttgcaaatacctttagcttgaatttggatatagagtaaatgtgctaaaactacaagtgaagacttcttgtacttacagtgaagatatattattgactaattttctcgattctctactgtgttttgcaagtgtgaccatgttctttgtaatcactaaatagtgattgtaaaagctcctgtttgaagcttttattttttggaaactttttttttccatatgactttctatgaaacgatctataaaattgcttcaagtcaattttggaagtagggagactataacttataaatatactacagatttttaataaagtgttactcaaaactaattcctagacttgtcatggaaatgtcttatttgacatttcagttttaatagaacttttgaaaagggcattaagaaaagtagaagcttaaatataaagtataatctgagacttcaaaactacgatgcaactcaactagcttatgttagtattatatcttaagaatggcattgccattgatgactcataaccatttaaaccaattcaaatggaagtagactatatagactttttttttaatctgtaatttttagccttctattaactgggttggtagagtgttataacacattttagagtagactcacctctgctttaacataggagcccaaatatcttaaaagtgaggctcactattgacagcaagaaatagaactaaaataatatctgagtataagattatcttagaaattttaataaacacctggctatgagttactaagcaatgttttgctttctgaagaattaattttctgcatttttttacacttaggaggaatgttattgaagccgtttacaatagactgaatccttacaaaaatgacgacactgtaagtagcattttagctccctctgctttcccttcccctccactctaaatgcatatccttcctacctgtttttgcagagctgttcactgtacccattctcttacacacacccctgattgattgctctgaactctgcttgctctgatctctgcctgcaccacagttctagtgattgaggacataatcatggtgagtggccacctctctcaaaaaagaagaaagtccttttgaattattctagattttttaagtctttacaaacaatcaacttcagaaggtttgcctccactacatggttttttttttttttttttcccgaagttgggactatctctactcagaatattgtcttattctgagttttgtaagcagctgcagcagaacttcggaatgtctgtctcaactaaatagttcttatggttggaaatacctttgtcaggaatcctgaagtatatacttcacttaaatattagagaattgtttgcataaatagacattagaatgccatactctccagttaagtgttctgttgcaattctgttgtatgatgtttatagaaaagtgataacttaaagatcatgtgggcacagctctgaaatattttatgtattgcattatgaagcttcctcacatattgagttcttaatcttttctgatgcattaaaggtttataaaagtggtattctaaaactgtattggatttcattaaaaaattctttttagtagatttattgattgagtaatacatttggacagcctcatcataaaaccgcatttcaaatattttccaaaacaaaacaaaggattaacaattctttgaacagattaaacattgctatttcatatgtacacatatatacttatatactttaaaaaacatttatattctaaaagtcatctttacagaacattatctttctccattatccagaaagtatggtgtattttggcaccgctaaattttaacgttgttccttattttgcttccttttacaaaggactctacatcaacagatgatatgtggtaaaactgctcatctagccatggagtttaccttcacctccaaaggagagtacagctcaactttgttgaaacttttaacatccatcctcaactttaaggaaggggatatgacatgggtgagaatgattacatcagagaacttcagcagtacaacagctagcccagaactgatttttttttttttttttgtaaatttgagacttatgtaagcgtgatttcaaaccataattcgtgttgtaaatcagactccagcaatttttgttgtatgattttgtttttttgtaaagtgtaattgtccttgtacaaaatgctcatatttaattatgaactgctttaaatcactatcaaagttacaagaaatgtttggcttattgtgtgatgcaacagatatatagccctttcaagtcatgttgtgtttggacttggggttggaacagggagagcagcagccatgtcagctacacgctcaaatgtgcagatgattatggaaaataacctcaaaatcttacaaagctgaacatccaaggagttattgaaaactatcttaaatgttcttggtaggggagttggcattgttgataaagccagtcccttcatttaactgtctttcaggatgttccttcgttgtttccatgagtattgcaggtaataatacagtgtattcataagaatctcaatcttggggctaaatgccttgtttctttgcacctcttttcaagtccttacatttaattactaattgataagcagcagcttcctacatatagtaggaaactgccacatttttgctatcatgattggctgggcctgctgctgttcctagtaagatattctgaattccattttatcaataaagcttgatttaacaaacaagaaacttaatcatgtatgtgtaattcctcttttaccctggccttttaaaacactgtgccgttgtaatgagacgtttctcatagggaaagatgttagtctcttttaattggacaacactgtcactcaaggcatagatgaaactttccttccattagaaagactaaaagatttaattcttggttgtaccttaatctattttttaaataggtttctttcaggctgcttatttttcattaagatgtgtatcagcttggatttgcctactgtttaattaaaatatttattgtcaaagtttgacaatctaacactctatggtaggggtgtgtgtgtgtgtgtttgtgagtgtgtgtttgcctgtgatttttaattggcccatgtctttagaatccaagtggttaagatgtatttgtgatttgaaatatagcatgttgataatatttagctgttggcctttacaaataactttcaaagcttaaggaattgtagatataaaaataacctaatttaatttaggcttaaattcctctgattaagcatgtgaaagtaagttttaaaatctgtcgcattgaaaagattactgttccgtgcccttctgtatttttgtctctttaggttgaatattgtatttatcaccatgtaatcattcagtaggcagattcccactagaaaactgttgaaatgtaagactaaaatacaacattgaatacaaaatcaaaattttgtgtataaaaaccagtatagtccattttgttatatttgttttttccctaacttggaaatatacatatttgtatatatagccttaaaattaatgtaaagttaggggagtagtggggaaagtaatgtgaaatgtctcagatttaagtagttaaataccagcaaaatcttttcattatccctcttattttgtgaggtgattaaatgtaacttaattgtatttaatttatatcttattccagcatgaatgaggaaaaactgaagtactatttatatttagaaattcatatcagttgaaattacagaaccaattccatacttacaataaatacttaatgtctaaatctgtggtagagtgcgaagtatgataatgttctaagttatggctttgcaagcatctaaatgtgcatttaatgaataccagtgcttctagtatagactaattaccagacatactggtactgaaagctaaatccctattataacaaaccagttccttaatattttaagtagactgacaactttagttccagaaattgcaaaactttgaactggactgtgtaatcttttgagatgcaaaacttaagtcacaagtagagtatgtgatggaaagctgtatttcaaaccataacagcatatttagagccttttttttttgagtctttaaacaagagaaaattaaaatattcctgtcaaaattattagtattgaaattaggcttggacacgagagagaaccgtatttgagtgatgtgagaagactaaatcttttccacatgagtcagcactgccatactaataatttttttactataaaaatacaggaaggaagtatacattataacagcagactgtgtgtgttcctgattcctggaggtaatagtggggggaaaccaaccatactttttaaaggcacttttgcacctctattgtgcacttcattcttgtaccacttaaattcttcacccccatcccctttttttgtgctaattagcatctcagggcaatgcctcaaaaatgtttgatgtgttctgttctttggagggaaaaagttcttatgtgatgataatatagtactcaaaatatacttttatcatttaaatgtcttatttgctgctatgaataggaaataacattttgtatagcaggctctgttttaccctaacattaaaaaatttcactgatctttctttcattaacagggtagaatctcctaatttccactttcttgggaatatacttttatagacaatagaagcagttctcaatattagcatatactttaaaaaatcaaagtgataacttaattcagctttggaagtatctcaaacatatttttactttatagtgcattaacttgcttctagagtacttaatgcaactgctctagccacttaattttttatactaatctcaacattaagaaatttggattaagtaataaattagttatgtaattcaagtaatctgaattacagcagtacttttagtgatcattcataggactatatattaacccagctaataactcagtttttttacaaaatgtttcgagtattattggtaaaacactgttctaggctaagcacattgggactgtaaagaaatgagtagatccttggcttcaagtttacatctggacaatttataatctagtgtatgttagtattataactggatcactcatcaaaaaatatatatatatatctattgcccacctgctatctaccaggtacttagctgatcaaggcaggcccctgccctaaagaccttgtttatacttcctttactcacctgaaaactgttctccagtttattttcttctctctaaagttaaagagtaattcagaagaaaattttgcttagcataagaataaaattggactgaagaggcttaagcccattcagtatccttgattgcatttatccaacggcctttattcttcctgctgacagcagtaactcagaggaataggtagtagatttctgaaaattatccagccatggaaatgtaggtggggtttgagtttaaggcatttaaaaatgtaaatatctctagctaaatttatcttaagtagaactctgtgtttttgtaacacactgccagtgttaatatcaaattttagccaaattattactatgtgttttaatattttaaaataatttcactgcccatctttactggacaaactcatttggagttcaacttgtgatttctgaaagaactgatgaaattgggtactgctttttttctccatttttcgttttgttttaattttgaatttcatggtatatacttttagttcaaactcagctgtttgtacagtattgtattaggatttggtattagaaaagatgtgtaaatatcttagtatataattgtttctcatttgaggtttttcttctaagggaccttaaagagttttatatacttttgctcacagaaactgctggtgagattaccattttttgagtatctagtcttctagtttttcttttaggcattaggaagccttctttagagttcaaaattttagaagcctaatttgctcttacttccttcaattatgtgccatgtgttttggtttgtatatgttttaaattgtatatttccttggaatatgcttgaaatatttaagaatacattttcaaaatgtataatactgtattgttttgttgatcagaataataagtctcagttaaatgtttgttattactgatagtcaaaatgctcaatagaaatgatgagaggcattggttccaattcattgtcaaatgaacgttttctaattttgttcacagattctttccctttcgattgttctgtatgttaagatagtggcttctgctctcactgttttcctatttatattactagcaggtaggagtgctaattagaaaaacttagatggtattgaaattacagttgacaacttatatttttatgagatggagaaaaaagattaagttgatataacaacaaagtggactttttttcttccttatcctgcacgaaatattgcccttgtttcctctactttcctcttggtgttttctctttttttcaaacagaaacaggccaattccattttcttgagcaagaaagcttagtgtgttacttcatcaaggccagctaatactgtgttaaaccgggctgaaaatgagaaaacttgggagatggaggaatggggaaatggcagtgggataggtagggaaggattactcttaattgttttaaaagccataggaaagtcttccttgtacgtggctgtaaatttataagaactattgtgtcacataaaccaacaagaatgaacctttgctgcttcagataatttgatttttccagcaaggaaattaataagttactgattcttcagcatagaaacaactgagaagaattaatgcaatgtttcttcactagaaaacccaacccttcatttcttttcattgctccaaaacccagttttcaactaatggttttctcattaaactaaatgtttagaaaagttgtttagagtttttctttttcttttacatagtcctcctgatccagtataagactatttagtaacgtgcatttgtatggtactatctaaagtaagttagattgatgtaagagatcgggtagctgcggaacaaaattagttatatcctaattaggtacagtgaatgacacaaaatcattttagcaatgcttcttaaccttttggggtcacaggcgttttgagactgatgaatcctagggacttatttacccaggaaaatgcgtatataacatacatatctccctaaagtttacaatattgtagtggttcatgggccccctggttaagagcccattctaaagtacaatagggcatcatcccttttcctgcaaagcccaaaagtatatttctagggcatgaaaataacttgagtctattttaaggaattgtttcactctagaggtagataggggacctggctagaatctgacattaaaatatactttttaaaaaatattatatttggggtggggaaagtgattaaaaggtgaaaaaaaaacatagtattcagaagttttggaggttaatgtctttctctaagatttgccactttagaaattcaacagaaaagaggtaaaacagaaatggaatgtatctggaacatttttggcctccatagtgcagatatactatattaacaagtaatacatttatttacctgtcagatctccaggttttaagattttgagctttctagtattaggattcattaaatgttcaattcatttcatattctaaggaattaggttatttacttactaattcaggatgttaaaataacatccaagtcggacaaccaccaccaatgcacacagttaatgagatttctaaaatataataagtacaatgtaacaaacgtatagaattttgcatttgttgccaaaattagatgtttaatgacagcttatttaattcccatttgtgggacttctggaacatagaaaccattatcttacctggttatcccttgactaaatagcatatctgcaggaaaatatcttgtttgtagtgatatgccccaatagtgattgatttcactcttgaaatgagttatatcacttaatttgtataaatgttatgagtggagagacatgtacatgttaaaagcatgttgcattatatattcattttttaaactctataaatgttaagaataatataattgcagaaatatttttcttaaatacaatgtgtaacaaaattctccgtagcaactcacccactttgcagtttatgtgatccacacttttaaagaaattccataaatgtatattttgtattatgtattatttcctggtccaaagaaaatatgtgaattcagttctaactttaagaatgtactgtttgttttcaagttcattgaaaaattgcattcagcctgcgaatggttgcagattgtatgttagatgaaaagtagaaataatttctagtttggaaaactggtgccactaaataaacaggcaattacataat
